United States Patent 8,781,750 (CELL-TYPE-SPECIFIC PATTERNS OF GENE EXPRESSION) - sequence listing, part 34

SEQ ID NO: 37297 - DNA, 658350 bp, Homo sapiens
atgctcctgctgctcgtcccagtgctcgaggtgatttttaccctgggttagtaacattccattacctttcttccttttgtaaatgtgactgtgttgtaattttttctgaatagagacatcttttcttcatagcaaagtctgtgctgcctttacttacacagcattggtgttgcaggaggaaccagagcccagtcggtgacccagcttggcagccacgtctctgtctctgaaggagccctggttctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagtgacacagtgcttgagactgcaggagaggtgaacataaacctcctgagatgctgagactttctgtgactcaagaactcaaccttgaagtctgttttataatattaaatagcatttccaagtttctgatgcttattgatgtatgctgtatctttttcatctatttatttttaaactatctgtgactttaaagtgtgtttcctgtaggtagcataaaagaccatcttttctttttatctactttgttaatctctgtttttgcattgtgaagtttagataattaaaatggaatataaatatcaatcaggttggatttaagtatacttcattattgtgtttcacccatgttcctttttttgttctttttttctgactccttttggattatttaaatacttttcaatttacattttaatttatttatgaactttttggctataactctgtactttttgagtagttgctctgaagatggcaatgtacatgcctaaatatccagggtcttatgtgagcaaatactgtacctccttatgtgaaatgtcaaaatcttacacaacgtctctttatctaccaacactaaagtttgttattgttgttcatatatattagtcacatacattgaaaacttcaccaggcctggcacagtggctcatgtttgtaatcccaacactttgggaggcagagatgggaggattgcttgaactcaggggtttcagaccatcctgaaacaaagtgagacccccatctctatgaaatataaaaaaaatagctgggtatgatggcactcatctgtagcctcaactactcggcaggttgaagcattatgatagcttgagcccaggagttcgaggctgcagttagctaccatcatgccactgtattccagcttaagcaatagagcgagatccttgtctcaatttttttttttaaaaatcacaatatatagaaaacttcaccatataatgttataatttttgctttcaacaattatatgcactttataaaatttaaggggaagaataagaactattttatacttaacagctatttatcatttctggtatccttcctttgttcctgaagatctggattttctctgataccaggggatataactgaaattcccttcaaacttaaaaactccctttagcatttcttctagagcagatttgctgggaaacatatttttcatttgttcattacctgaaaatgtatttttaacttgccttttatttctggaagatagtttttactgggtctgtaattctgtgtcaacccttccacccctcccgctttaaagataccatttcattgtcttttggcctccatgctttctaatagaaatccattgccattcaagtaattgtccttcaatgatgtaatatattgtttttctctagctgcttcatatataagctatgtacacacatacacacacacacacacacacaaacacatgaaaaattatacaatcttttgttgtcagtggtttaatcataatgtgtttaggtgtggttctctttgattttaccttgtttggggcttgaattgataaatgtatgtctttcgagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagtttaccaactaaaaagagtccaggaccagatggattcacagccgaattctaccagaggtacaaggaggaactggtaccattccttctgaaactattccaatcaatagaaaaagagggaatcctccctaaatcattttatgaggccagcatcattctgataccaaagccgggcagagacacaaccaaaaaagagaattttagaccaatatccttgatgaacattgatgcaaaaatcctcgataaaatactggcaaaacgaatccagcagcacatcaaaaagcttatccaccatgatcaagtgggcttcatccctgggatgcaaggctggttcaatatacgcaaatcaataagtgtaatccagcatataaacagagccaaagacaaaaaccacatgattatctcaatagatgcagaaaaagcctttgacaaaattcaataacgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcgccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagctacttcagcaaagtctcaggatacaaaatcaatgtacaaaaatcacaagcattcttatacaccaataacagacaaacagagagccaaatcatgagtgaactcccattcacaattgcttcaaagagaataaaatacctaggactccaacttacaagggatgtgaaggacctcttcaaggagaactacaaaccactgctcaaggaaataaaagaggatacaaacaaatggaagaacattccgtgctcatggataggaagaatcaatattgtgaaaatggccatactgcccaaggtaatttatagattcaatgccatccccatcaagctaccaatgactttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctaatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagttctaaaaccataaaaaccctagaagaaaacctaggcagtaccattcaggacataggcatgggcaaggacttcatgtctaaaacaccaaaagcaatggcaacaaaagccagaattgacaaatgggatctaatgaaactaaagagcttctgcacagcaaaataaactgtcatcagagtgaacaggcaacctaaaaaatgggagaaaattttcgcaacctactcgtctgacaaagggctaatatccagaatctataatgaactcaaacaaatttacaggaaaaaaacaaacaaccccatcaaaaagtgggcgaaggacatgaacagacacttctcaaaagaagatatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccgttgtggaagtcagtgtggtgattcctcagggatctagaactagaaataccatttgacccagccatcccattactgggtatatatccaaaggactataaatcatgctgctataaagacacatgcacacatatgtttattgcggcattattcacaatagcaaagacttggaaccaacccaaatgtccaacaatgatagactggattaagaaaatgtggcacatatacaccatagaatactatgcagccataaaaaaggatgagttcatgtcctttgtagggacatggatgaaattggaaatcatcattctcagtaaactatcacaagaacaaaaaaccaaacaccacatattctcactcataggtgggaactgaacaatgagatcacatggtcacaggaaggggaatatcacactctgggaactgtggtggggtggggggaggggggagggatagcattgggagagatacctaatgttagatgacaagttagtgggtgcagtacaccagcatggcacatgtatacatatgtgactaacctgcacaatgtgcacatgtaccctaaaacttaaagtataataataaaaaaaagataaatgtatgtctttcactgaatttggcaagcttttggccattctttcttcaaatatgttttctgacccaatatctttcttctctccctctaggactccagttagatataacttagactttcgaatattttcccacaggtctccagggctctgcctttttttctttcaattttcaaattgattttaaggtttgtcagtgtttcctgaccttggcactactgacattttggtcctcataattttttattggggtgtggggctgccctgtgtgttgtagaatttttaacaacaccactggcttctccacactagatgcctgtagcactacataccccaagttgtgaaggccaaaattgtgtccagatttgccaaatgtctcctgggggaagacaaagtcaaaattaattggattaaataatctgtattgatctttttcaattttgcatatgctttcctctatcattttgctactgagcccttactgtaagatttttatttttgatattgtatttttctgttcaatttctatttttttctttactttgtggaacataatcaaaagagctactttgacatctttttctatgagttttagtatcttagtcatcttggtatttgaatttgttgatcttttacttaaatattagttcatttttctggccctttgtcaaataattttgaagtacatcttaaacatttcaaatattatgtgtgtacactctgttttctcctcctcttccttcttcttctttaaaaaacaatcatctaaagaatgttaatgtttttatttgaggagaaaatcaacctagtttggtttatactactagttgtgtctccccttttgtggaatttggtagctcaaaatcacagttcagttctctaatcatttgccatgttggtttgggtttatacctgtcgtgtgtagctcagggattagtgaaaccagtttgcatggctcaaatctcaggtcagttcctgaactctctgctacattggttttagtttgtcctgcatgggtgccacttgggggtagtctgagactggaatagtggttcaaatatcagttaagtaacctaaaatttgttgttctggtttgagtcagtttcacgtatgtagagccttgggattagcctgagacttaaactattttccatctcttccctagggtctcccttttctagcctgacccacagaggcagaaaattgtgtttcttgcagagttttgacttcctacaccattatcatattgctgtgtgcattggggcctccctcagggcaaagccaagagaaagaaacagaaaaaatatgaaattcacccttgtgcaggttgtttctccaatttttgacttccctacacaatctgctagcttttgggtaatttcagagtccacaggtagtttctttttttaaatttttttattgtttatttattttttattttgttcagtttttacttacaatccatggcagagattggccgtaggtatcttaaagttatctcctattctactgtggtcctgcattaatttgtggttctcgataatattaatcaagaatggctatttggcgtgtgcttttaccaccatctttagttgtattaccctttttagttaatctaattcattttttatatttgcaaatttttctcatcaagattataagaccatttaattaagctcttaaatttttttgatatttcatttcttattttccaaatttatgaaggtctttctttggtgcaaaagaattgagaatgcatacttgtttttataaataattcaagtactatattttttcctaaagtctaaaaatttttgtattctgaattatatctggatttaagagtatgttaaggcatagtaggactattcaaacactattttttttagtacataaaacagagctgattagtttttaattttctctatttttttcatttctgactttttgcttcttttaaatgaaacatgtattttggtatttggggctgtgtttggagacccttaaatcttccgggaaatcatgtatttcttagaatgctgccaacacccttaagtgagaatattctatttatgatcttattcttatttaactaagaggtgttgcttctactactatagaggattgaagaattcctttacattcttccagtgcagagcaaaaggcaatgttccaagacatcacacaatcctatggcctttgactttgaacatactgggctttgcaaatgctcagcaactttgagaaaagttaaaatgaccaccattctgaaattcagaaggagttgctccttatagcttattttccaattttttttctgctctgactttaatcttcaatatgatcccacctactttctgtgtcctagaaatatgtgtcaccctttcctcaccagatgaccttcattttttttttactcttgtgaattttagtctatttccattttatttctattctttaatttaggaagaaatattcaagagaagggaaatgagcatatagcattaggattagaagttcacactcaaaggctacacttttacaaaatgacagcattactcaattttcttcattcaagaaaatcttttccaacaggaacaaatgaatcaagaacccaaggagagaactgggcttatgctttcaaatcaaaggaaagaagtattctgactttgtcaagggtcccattagccacagagaaagcagtgactttctgcattctcgtgttttcagagttttatttttttccccatgcactatctacatttattattatttgtttttatttttaaatttcaacttttatttctcgcttggtgtggttgtatttccttcagccccacaggtgtctgtagttttattttctttacccctagaggcaaagccttcccatcatgagttacgccttgtcattagttgcatggaggcactactctccttatgtgaaatcttttcctctatggctgcacaagcatcatccgagggaaatatctctaccatcctccatcagcactgtggcaacactgaaccatccaaaactcagtccagggcaattggtctgaacccaaactctcatggactcatatctaaattctgatatgcttttcaataacgattcctcttgatgtattactccatctttacatgaaatcttattgctaatggactctaggactaaaacaccatcatagatttggtcaggaagaaacacgtcttgtggaagttttgatacatctcagaaaacaggaagaacacactaatgaacagtctgtgctaaactctggttctgcacttggcctccagagagcgatgctgcacacactggagcttttgtttctgttgaagatcagtccactgctcagtttcttcttcctgcagctggttgagttctttccagacaaagacaagtgacaagaatcagagttttaaaagcaaccagattcatctctgcagcttttgtagttttatataaacaaagagcttgtccagcaaaccttccccacacttcttgttcttggtctcttcagccgctttccttcctgttctctggagatcttgcagaaaagagcctgcagtgtttccattgctcagccatgctcctggtgctcatcccactgctggggatacattttgtcctgagtgagtaaaatttctttatcatctctagttccacaggttctgactagaaatgcttgctttttatactgagtctgcactgctttcactgatagtacattactttttcaggaactgtcagagcccagtcagtgacccagcctgacatccgcatcactgtctctgaaggagcctcactggagttgagatgtaactattcctatggggcgatgttgtgggaagtcagggaccccaaacggagggaccggctgaagccatggcagaagaatgtggattgtgaagatttcatggacatttattagttccccaaattaatacttttataatttcttatgcctctctttactgcaatctctaaacataaattgtaaagatttcatggacacttatcacttccccaatcaatacccctgtgatttcctatgcctgtctttactttaatctcttaatcctgtcagctgaggaggatgtatgtcacctcaggaccctgtgataattgtgttaactgcacaaattatagagcatgtgtgttcaaacaatatgaaatctgggcaccttgaaaaaagaacaggataacagcaatgttcagggaataagagagataaccttaaactctgactgccagtgagccaggcggaacagagccatatttctcttctttcaaaagcaaatgggagaaatatggctgaattctttttctcagcaaggaacatccctggggaagagaatacgtgcctgggggtgggtctatagacggcccccttgggtgtggccatcttctatagtcaaaactgtaggggtgaaataaatcccagtctcccatagcactcccaggcttattaggaagaggaaattcccacctaataaattttggtcagactggctgctctcaaaaccctgtctcctgataagatgttatcaatgacaatggtgcccgaaacttcattagcaattttaatttcgccccagtcctgtggtcctgtgatctcgccctgcctccatttgccttgtgatattctattaccttgtgaagtacatgatctctgtgacccacacctattcatacactccctccccttttgaaaatcagtaataaaaacttgctggttttgcggcttgtggggcatcacggaacctaccgacatgtgatttctcccccggactcccagctttaaaatttctctcttttgtactctgtccctttatttctcaagccagccaaaacttagggaaaatagaaaagaacctatgtgactatcggggcaggttccccaatacggcaacaccttctctcttctggcatgtccagtcccccggccaaggcctccagctgctcctaaagtacttttcaggagacactctggttcaaggcattgaaggctttgaagctgaatttaagaggagtcaatcttccttcaacctgaggagaccctctgtgcattggagtgatgctgctgagtacttctgtgctgcaggtaccacagtgcctgggtctgcaggggagctgaacacaaactgcctatgctagagaagttttcagagactcaatgtatcttcctgtggcattttcaaagatctcttatttttatgatggtgagtgaggcaaagagagctgagcacatccagccatttctatataattctgcaattcctgctatgtcccatgtcagataaactttgttttagaagctttttgttaattgaagaaactgcataataggaaatagtattctagaatgatggaggagacatacttcttatcacctaacaatcaggttctcaaggacctttccttgactgtgactgcattaagtggttgactatgggaattttgatatggtctaggagaaccttggttttcatttatcatttaatctctcaactaacccagaaaacaaaacataagtttctcatgttcttaccttgcaagttgcatccttgagctggtcattcacaggatattttcttagaatttatttttctggctctaactgcgcaattcagatttcaggatattttgtctcatacctctatttaggaggaattatgagaaattgttagctaacagtgaaagtttcattagaatcacgaaggacttagaaaattgtcacagtgatgtgagttctggcaactaggaatagcacacaaggagaatgaagatttagaattcatcagtgtttctccaaagactttttcagttataaaaatagcttctattctattggtatattaattatgcaaatctacattgtaagtttgtctatggaattccattcatctcttctagctactgacacttttacttgttgctttcactctgttgttacatggtttcactattgaaatattaaagattgattctcttttttgagatagagttttactctttcacctaggctggaatgcagtggcatgatcatagctcactgcagccttgacccatgcccccaggctcaagcaattctcccacctcagtcagcttcctgagtagctgagactacaggtgtgcaccaccatgcctggctaattttttttttaatttttatttttagtggagacaagatctcactatgttgcccaggctggtttcaaactcctgagctcaagcaatcctgcaacctcagccccccaaagtactaggattacaagcatgagccactgtacctggccaaagattgattcttatatagtaacattttgataatctgtcatgtggtaagttttgcaatgccaagctctgctagaaatacggataagagttacaatggtactggattccaggcggctgctggaaagtataaatatgtgactttcttatgtctagaatggaaagaactgtataagaagattttatactccttgtctgcttgctgcctcggaggataaccagtgcttcggaggaaaagtagaaggagaaggagagagctctttagctgccatttagctcacactataaatgtctaagagggtaggtgcatagggaccctgaaaatatagatcgaataagtaaattgtggccaatggcactccttagccaaatagtgaaccaagatatcaacagtattttttaggatgtagtgttatgagtacatgtgataaatatgtttaagcgatttctggaatgctgtgaggaaggtgaatggagtgtcagatatataaaattatgaaaaagaaatgtatgctcatttaatgttcctgcctcagtcccttccttcttttctgtttttggaccacactctcatctaccactgataaggcaaataatttcaagtgactcattgtcatcagctcagccacactgcccaaaggtacttgtcatagtatcatgagcacttcatgcagatcgatttgagaaagaactgcccgtttcttttgattctgatctcaaactgaatattaaagaaaaataaattccataccaaggaccctgagcagctgggagagcattccccatctcccctacctcacctctgcctgaaaaatcaaagtaatcttccttccttctattaataatttgttgcttttatatgagtacgtgatttgtaggagaaactttccaaaataaggaattatattaagaaagtggagattctgagttattttatcaatgatatcaatcattctgacttttcagaaagaattctgacttttcatgaaattaactgatcttaccacatattccatcaccgagaagcagctgccctaattgaaaggcggaacactttactgaagaccaagctagagccctgactgggagacaacagcatgtatgctaaacattttcttctctccctacatcgtattttttatctgatatacaagctgttggaaacaaactttataatttagtgtaaaggtaacagaattttcaggctgggtgaggtggctcacagctgtaatttcagcacggtgggaggtttaggtaggaggatcacttgaggcaaggatttcaagaccagcctgggcaacatagcaagaccacatctctacaaacaattaaaaaaattagccaggcatggtggtgcccacctgtagtcctagctactcaggaggattgcgtgggcccaggagttcaaagttacactgagctgtgatcatgacactgccctctagcctggatgccagagcaagatcctgcttttaaaaaaaacttaggaaggactgtcactgaatttgaagaattattaatataatcagtgatgaagtcaatgacttttgggattgtgcatcttctcattttggagaaaggatgaaaagttcttcagttgcaagatggagttctgtatcttgaaggagatagaggaatagaattattttgttgttgtacatgtttcaaatgtttgtagaagaatgtgtgtgttgcatagggaagcttgaagtagttgaaggtatcgatttattgactctcagctccaaattcactccttgcctcttctgtgaaggtgaatctggaaccttcgaccatttttctttgccagttgacacaatgttaagctttgtagtagagagtcaggaagaaaaagttttgctttctgctttccatgtgctcactcatcaggatcctgcaccatgggaggcacctgcagtgcacagtgccctgcagtttcctccagaacccccccattttagggcgattctgtgaaagagatcctgcagtgagacacctccctgtgaacagctttccccagtgtcctagaggatgattttctgccatgttctagagggtgaatttctagcaagttctgctgggacagcaccacagcaacttccctttcatccagtgagccacagctgtttcttttcaataagatctgggtctcagccctgagggtggggctacaggcctcttccctggttatcctaccctgccctaggagtagaggctgcaccttatgtctgctattcctacaggaataggaatagcagaatttcttttcttcatattattcattctcttgttactctaatactctgtttattaatccttaaatttttttctgttgaaattctatggtttctctttcctgattggactcgacttagacatgcaccaaggacttcaagcaactggagagcatcttccatctccccgcccactcctgcctgagatatcaaagtagttttcttgttttatttctctattgatttgttttgcctgcttattgttttatttacattgttgttatataattatgagaaaattttacaataattttattaagaatttggaaatattgttaatatattaataaaattaattttactattaaaatttttgtgcacattatacacagaatgttattataccattggtgcaaattgaaatcaattttaaaaggtttagcatactgcacaaataggcattaattcacctatgaggatgtgtctggagatcgtaattctaagtcatttttcttgcatgtaactctctcaatacatcattattttttgattttctatttccttcagatggaggaagaagacaatgataattgcaaaactatctgtagacagaatatttctgtcaccccagaaggttttatgtgtgcctttctagtcaactcaccttctggaggcaatagatgttcttatttctatcaccttagatttactttacccattgtagacttcaaatcaatggaatcatacagtagttactcttttgtgcctggtttctttcattcatcgtgttttttagattcccccatgttctcatgtatatcagtcattcattattgctattgctgagtagtatcttattatatgaataaagcacaatttgtttatccattcagctgcgcacaccactgactggacatagaatctttcagggattaaatctttggtatcattcttaagagtgcaaggtacagttgttctagatttttctatcctgtctttcaagggtagggcgtgtctctaaaatacttcagttgaaacatgtatcttaaatacctttatttaaaaaccaatttctatcattcattatggtacctactgtatcattagttttgcaaataaaaacccaacatctaatattccctatgctatttagcaaagctttgggtattatccaagctgtgggtagctgaactgtagtttcctctgttgtggccttacgtattaataacaacagtagctgaccaccctggaatttgctttcctgactaagtcaattgactctccttagagttgagacttaactagtacatatccaatattctctggcttttgtcgaaaagatttaatgtaaattatacatcctaacactgtgatatatttatttttacttggtaactgatagatattatgaacaaaatttagatcattgttcctgcaggtcctgaagatctgtaagtcatgtaattataatccttgctcaacagttattctagagaacttatttaatatttagaggcactttgccctttacagtacatactaaaaccttttaaagcttgttaggtaacttatgaagaaaatttcactaatctattatttaataccaaatatacagcatatacaatacacattttcaatcttttaagcacattaacaaagttctcaggatagttggatctctgtacacagttttttacaggaatatctaagacaagggaatacctttatttaggacacaaatgcgccaaaacatgggtataaaagtagaatgtggccaggcacggtggattatgcctgtaatcccaacactttgagaggctgaagcgagagaatctcttgagtccaggagattgaaaccagcctgagcaacagaatgaaatcccatctctacaaaaagtaaaaaaacatcagctgggcatggtgacacatgtctgtgatcccagttacataggaggctgaggcagggagtattgcttaagcctgggaggtcaaggctgcagtgagccgcaattgcaccactgccctccagtctgggaaacagagtgagaccctgtctcaaaaaaataaataaataaaaataaaaataaaaggtagaatgttaaaatgttgaagatagtttatatgtatatttataacttcatattgttttttgtgatatgtcttatataataggaaaataaaattgacctttatattaatattctaaggctggcataacaaaatatcacagactaggtgacataaacaacataatttattatctcacagttccacaggctagaagcccaagatcaagttgtcagcagggttaatttcttctgaagtttgcagatcatgttgccttttcattgtgtccttacacggtcttgcccctgagggtacgcatgtctgtgtccaaatttacttttcttataagaagagcagtcatattgaattagagtccacttatgtgatgtcattttacattaattatttctttaaagagcctattttcaagcaccattacgttctgaggtactgggggtaagggcttcaacatgtaaattttgggttggatagagctcagtccataacaactctccaagtaaatattacattcacaaacaagacagttgaaacctttctttgtgcaatgctttactaacttctcgtgcacacaatgatcgtgtataactttgatggagattttcctgtattgagtttctttctagaggaaggagaaatgtgcaattacaaatacagatagcttataaaacattgcaaaagaccagtgataaaaattaaaagctgtttttcagacttgccttctttttcctctgctccactggggtgcagaattctctcatgtttagatttgttcttttctgaagataaatcttaatttctccttggtattttatctctgacagttttcctttctttccccattctgttttctgtctgcatgttactttttttttacctctgtcttatcgtttgtctaatattagattctacctgtgcagaagccaatttagctaacttgctgtttttctcctgcactcctcctttaccacctcatcagcagaactgacatttaaaaaagaaaaaagaattgaaattcttttgaagttgtttagggcaagtgaagcgggttaagtggatgaggaaggtggctacagtccttaaacacaggggcagcaggaagaattccatcctatatgctcagctttcttgaggattgttttctgtttttttttcaagtagtatgtatcaatattttaaattttgattcaaccagataatcttttttaaaaaatatatgctttggttgctgacatgcttggattcattttaaatatatttgttttatgcagcattctcttgatttttttcttatttctttttagcctggcttctcttgcattgataaagtttgatttttcttcatactgctttgaaaatgtaatgtgtatttctgttatgataagtacccttgttatataaatgtatgtatagaaatataaaatacatatgaatgtatgtatatatgtgtatgcatatataaatctaatttttatgcccaatgttattcttttttttccctcagtgttattctgtaacattttgcttgtatatcccagtccttctcctttacctcctgctgacttatgaattttagaattaccttcgtggctgattggaagaaactacacataagctatatacatcaggacaataatttcagtaagatattatgaaatgaacaataaactatagctccaatgtacattaagaaaagtaataaaaaagaaaagcatctgacacaataattgcaacatgaatttgctcccttcatcctcagagccattgtccctgatcttccttctgcctggagtgtttttcaccattagccacatagatcccttcactggctcatagtctttgctcctggagaaacatgggaacatgtgaataaagtagaatgctcaaaaagtttattgcagcattgtatttcatagttaaagaaaaatcattgtattagtccattctcccactgttataaaaatgctgagacatgataatttataaagaaaagagatttaagtggctcacagttccacagaccatacaggaagcacagtagcatctgtttctggggaggcttcagggagcttttactcaagatggaaggtaaagagggagaggccgtcttacatggcaaaagcagaacctagagagaaagggaaggtgctacacacttttaaacaaccagatctcaggagaactcaggactgtagcaagtgggaaatccacccccatgacccaatcacctcctaccaggcctgacctccagcactgggtatggaatcctgattagggaaaaggagtcaggctagcaggaccaggggaaagcaaagggataaagaaaataagctataggtctgcctttttttcatggtccaggacatataaacagaaagaggaagcagataagctataggtctttctttatggctcaggacctatagctctcctgagcaaataacgtacataactcacagacttcctgcttatcatcaaacacctctatctatcatcaaaaacctcagttgacagaagaatgcaagttagttccttgctaccttggcattaccagtactgcatgcagcactcggcaacccaaaaacatcctataaaatctccagcaggcctttgtttccttgccatcagctcctcttcggctgattgctccctggcaactactttcatactttctttaatagatctgcctttctttatctacaacagtcttggtaaattattttatccccacaccaccagcccaggtagtcatcactcacctgggacattggggattacatttcaacatgagatttgggcagggacacagatccaaactatatcacacatcatcttaagtcttcatcaatagggagaggactatataaaccgaagtatatctctaatagggtgcaatgtagcagaagttcccgtatgtgttaatataataagctctgcaagatatattattgaatttatagtgtgagttacaaaaaggtatacatgagatgcatcatttggtattaaattttaaaattataaatgaaatactatttattttcagcattttttgtatttagtacatgtatataatgctatagtaaaacatttggaagtatcaactccaaattgataagatgaagggagaattagggtaacgagtgatgaaagaatcagaactgggagtggtagtaaaagtggattttcgtctacctggtatgttgtattacttttaataatttcaaatgttcatgaattctttataatattaaaccaataaaaagtcataaaagccatcataaaggtttatccatattctattctattatcctcatgaaaaaggagagaaagagggaaatgaccaccctttttataaggtcttgtccaaccttcctaagtatttctcccacctctgggatcatatagcttttagttcacattctgcttaggatcccactctttgattctattatagacatgtgtagtttcgtactcttcagtagattatgaactaatgtctcatcactttttacatactcttaaaacctaataaattaatcacttatggtaatacttcaaaaaatctttttggattttctaaaacaaaatcagagaattcaaataaatagcgcaagatgggaattgtcaaattattttaagatattaatttccatgaagtggcattttaaaagtggtaattggttcactgttaatccccattcagtctaggcagctatattgttttctgaccgcctccatttccttcataggaaacatgaagtgaatggggctgtgtgtgtgactactgaggagttaagttggtgcaaagtggtctttgttgatggtttcagtccactagggggcactctaggacttccgaaatgaagactttttctgatggtctcagcggacggaacaggatacaaaagggcatgtgagtcagtcaaatcacagataacagggagctggggcggggtggagcgtgatgtgtgtgtaaggttcatcttaggttttcagctctgacattctatataaaacctcagaaagctggagttcataggtctataaatccattgtgaggatgattctgtaagcagaggtaagggaattggagttttactgggcattgcgagcatggatgttcattagaaaacatcttcattccatgttttcagtttctaaatttttatgattaaaattcatgaaattcactgacttggaaattattctaaatacccctgatatctgatcttttcatatatcttctctgagactagaaggaaaaagaataaacagaagagaagaaaataggaataaaataaggatgaagaacagaaagagaatagggaggggacaatatttaatttgaccagcaatatgtggcctgatgagaacagctgtgagggcctgcagggtgtgtggggaaaggtctgggaagaggaaggggagaggtagaaatgcaattagagtggatatcatacgcacatcctatttttcctctaaccaaccaacctctagttggaaacattttctaatgccctgatttcaagaaactatttatttctaaatttgcaatgcatgctatcaaatagttttcctttattagaattttcatatatttgaattctccaattttctgtcaaactgtgtaatttgggaaatgggatctctcttcccatgactctttaaagctctatttaacctagctgagacacagattcttctgagaggtatcatcccccttcctcacatactatccataaactagtcttacataaagtgcttcttttttttaaaaaaaacctatatcttcatacattagaaatattgcctcttcctctcgtgaactattcacacccatgaatttggagagattgctgtgcagtctcactgggccactgtgggtggtttcctcttcagatgatttttaaaacttatgtttttaaacttaaaaacttttaaataaaagactgatcatgaacattgcaataaggcaagttgaagagtacctgaatccttcaaaaagtttagaaactctagtattgaaaattaatacattacaatttgaatatctgcaggtttcaaaatagaaattaaatctaagtgtagcagcttgatagaaaggaacattattttcatgcaaagttttgaatgacccagttatcgacatagaggctaattttcaaatcaatttttcttataattgaagatacaatgataggatgcacaaacaaacatagtgaatcatatacatatcatgaagccactttgttacttttttaaacaaattttttttttaagagaagtggtcttgctctgttgcccaagctcaagtgcagtggcacaattatagtttgctttagccttgaactcctgggcccaagtgatcttcctgtctaggtctcccaaagtgctgagatcacagaagaccctgtctctgcttctgaaggagcccaaggattggttagggtaagctcagacccactagattgcctgtgggtgtgaaaatggtcttgggagttccttgatgcaggataacttctgcctactcccatgctctatgctgtacacaatcagtcctcagtaaatatttgccttgttaaatagtataaaagaattttagacctataaaagcatttagaaaccttttagttcaacttcattttataaacacagaaactatatccaagatgccagtatgaaaccattagatagtaaatgatctagcagtagaaagaaactggatttcctcccttcctccttagcttcttgctcttgcctattcctgcaggcacatattgttgaacaaagagaaactatctaatggcagccctgccaggttgacctctgcattttggttccgggaaaggcttggttcaatcactttgaccatgagaacggagagttccagtttgtgtaaacatttaccactttgggcaagaaagatattcaggctgagccactgttattctaccaggaaatccagtccatgactcactggctgctgtaggagtgagccaaacatggtggtgccaccctcaacccccagaggtatttctaaggactttcctaaaaatagtaagatatattcattatgctgggtggatattccttgaaggaaggatgtggacatagtgagcattactctacattgtcaaaaaataataattagaatagggaagctaagggtaacatgtcctcaagtggttgatagttcataaaggtgtgagaaaatcttttctggaccaacacattgacaatgagttaggtaatattcaatgaaataatcatagggttgggaattttgtccaggggatggccatacctaaggcatagttaatatgtggaatactatgatccatatgagtggtcatatttagaccattacattcagttcttaatgctatactcaaaaggccaaatattgacctaaattatctgtcaccaaaaggagggaaactcatccaataaaggatttgagaattatattgtatgaggaatgagtgagaaaagagaaaatccttagaatggagaagttttacatatgtaaaaacacacattttatgtatacatatctatatttatatgttttagttgctatttttcatcataactgtccttacatacttaagggtgcaagatgtgaataagaaattatattcagtctttataattccaggggcctagtgagtacaagtcacaggaaatgcacttttcttctggaaaccagatagtcttggtatctgaggaaccatttcccatggtcacttatttagttttgcactctccctcctagcagacacaggcaatattttggcttccatagatttagttttatggaagtaatcagaacgtatcaaaaattaaagtagataagcaattttttttgcaagaagagataaacccagaaatgtacaagactgaaggactttatcaatatcttagggaagaacactgtagtggagtttgggagaaaaacggcagatatggaacctgagctagcaatggctaaggcaagagcagtccatgccagaggagttggctcatattttagaggcaagttccactgaagatatgagtcaatcattgtatttaaggacatgccatattgatatcattcattttggtatcagaaaataaaagcaccttaatagaaatttacatgtggtttcatttttggagcctgcagcctgatgttttctgagaatttctccttgttttttctgcactttgcagaatacaagccacatagcaataggaaaaggtttcttaaaacatgccagatttctccttgcaaaccagcccaatctatgggtcaaactttcctattgttggagtatttaataactcatggaacttgttcccttcctcctttatcattgtactttaattctttaccttttattaaagccatccttaccaaagaaagattccacatttcgactgttggtactgtcaagtctctgggaatagaaagtcatggggaagaccagtcttggagaagcagagcctgagataatatgcacgtgaaatattgagtagtcctctctctcttactcttatctttggcttacatattcctttaagaaagagtctttctccataacaaacaaatcatgatgaccgatttgactgcaagggaatgtattacttttgtttgtccaggacagtgaatcatggtgttttcctgatttcaaacatgtaaacttggtgcatcattgtataaacacctgcaacatctacctctttctaactttttaacaatgactcattagtttgcataaatatcaatcttgatatctacattcttactgtgaacttcatctcagagtgaagactttatttgtttgacctattgctccttttgtgcatctgagtccctcctagggttatagaaaaacattcaaactgcaagtttagtagctacgaatgtgaccacaagatggcagtgcttctctgctgatgcagaacacacagaggtttcattttagtggattctgattaaataggtttatggcagaagtagagcctttttctattggctgagtagacaatgtgagaaaccactatgattgttagaggaaagaaaggaatacccgatgatggaagtagctcttatggctggagattgcaggtttatgactgatcctatttgggaagaacaatgatggcaggcattcgagctttatttatgtacttgtggctgcagctggactgtaagtttagagttttgggtaacacagtatattagttgatgattttgagacatccagggggaagtcttgctttatttaggcttcctctagttactatagaaaaagaaaattctggagaataataacttgataaacctttctctttttctttctgcacaggggtgagcagaggagagagtgtggggctgcatcttcctaccctgagtgtccaggagggtgacaactctattatcaactgtgcttattcaaacagcgcctcagactacttcatttggtacaagcaagaatctggaaaaggtcctcaattcattatagacattcgttcaaatatggacaaaaggcaaggccaaagagtcaccgttttattgaataagacagtgaaacatctctctctgcaaattgcagctactcaacctggagactcagctgtctacttttgtgcagagaatacacattgctttccaggcatctgtaaccatcacccaaacctgagatgggaggtgaagcagcatccctttcctttgcaataaattttagttatagcacttgtcattttgtttgttcataagtggaaactaacatatagatattaaaaccatgtaatgaggttagattcaaagtgacccagaaaggtttagagcattttgttggccagttgatgcttaatggattccgtttttcaaaaaaatatatggtacgcatttaagttaacaacatgaagttttgacacacatgtacatagtaaagtaaagagtcagctaaagagacgcatagggcaaggtatgggaaaaatggccctgagcttccatgccttctctggctctgccacccaccacgtgttcagcaatcaggaggttctgctcaagggatccttacagagatttagtgatgttggattttgtaatctagtcttcaaaggtgactttacatttgctattcagacttctctcctatgaataaccccttagtgtcaatattgcaatccctattatggataaattttaacttttagttttcaaaaattgcttttgttatctttttcttattgtaaaacattacatgccaaaaccagatagtgtaaaatataaaaaatacaaaattgataattctgtacccagataggttttgctaatattaggttggtgcaaaagtaagtgctgtttttgccattaaaagtcatggcaaaaataacaattacttttgcaccaacctaatatttagatttgtttcttgatagagtcctattataattaggatcatgattttttcacctattcttatatctcgaattgagcttttctcacttcgtcctctcctcaaacacatgctttttaatagctccgtgagaaattttcactagtcacagttatttttattttcttactctctgtatctgtggtaaaatttggcagtcccttctacctgctgtttcttgttgggaaaacgtgatgagttttcctttagagtctagtttggacatatactctgtgtgtgcgagggaaattaaaacaggaagtgattttaaaatgtgagcttcagattagagtcatcagtatattcttcaaaatcttattggtatctcttcatatttactctctcacataattgagaagagttatgttttttaatcactctgtttctgcagaacctagcataagctttttcacattgttaataatcaatagatgtttgttaaagaaagaaaaaatggattaaactattgtatattcaaaattttaacttaggctttgtggttgaattaaacgtataattttatgtgtgaataattaaactcctgaaaatgtatatttgaataagttgaatatttgagagcatatttctttccatttatctatgtcattcttttccataaaactttatcgttttaagataattaaatttttttctagacatttcatttttattgctacctttatctttctttctgaggtatgtggcaatgtttttaataaatatttttcagctacattattcaattcttattagtaaattgcaggaggcatttggatagttaatttatgctaggttgttccaaataccccgcctcactttcgtgttttgactgctttaaacattacgagtgcagtttccttttcaaaagttgtatcttttcgtgttgttgataaaaataatggaaataaagaagttgcataaataattaattccctaattctcccacctgtggtcaagagtaggctaatttcaagatccctcatattattcctaaggatggatataaccggcgattggtagggtgagaatgatcccttctggctgagttatggctgttagttattagctaggtcttataggaaaagtcattagattaaattggggtttaaaaacaactgaacaaggaaggtcagtattgtagcccagtaactcaactggcttttgttatttccctgtctataccactagctcctctccggagaagcaagctgactcttgatcagtccatttcctccaagaatgaaatggagtgattgggaatcatggcttatagtctatttattttttgcttgtttagaagaaagagtgtaattgctattggcttaattgctgtatcttacttggttgtcaatttttccaatgtaagaaaaaaaattatccagctagagtgtgcaaagtcagtacccagcttagatccagacacattcaagcattaaactttaaatggaaaagagtactgatgaggagagacattagcaggtaataaaatttactataaaattaccttctgaggttggcatacaatgaaacagatcaatggagctaaataaaacacattgaacaaataaaccaaggtttatgtatttttttgttgcctctgtacaaacttgctgtcttaaaacaatagatacatatttttttaaatcatcttcactgggctgaaatcaaggagtcagtaaggcccgcttcagaggctgcagagaagaatctgttccttgcctcttctagctctgccagcatttcttggcttgtggtgccatcaccccaatccctgttgctatggtcacattggcttttcttcttatgttgtcaagaacacatttccacaagttcaaaggcaatatttctttgaaaatttttttgaataccaagtcacccaggtttaggtaaagtaaaagctgattaaatgaaaggccaggaaggaaaacctgtacctgttggttaaaggactgaatataatgagtttatttatctattaatagttaagtgtgtcagaatggaatatgtgtggttcagaacattctgagtaatatgggcctactagtgaccagttcatagtgagatgacacatgactttgggatggggaagaatgcagggccactagagctaagggtaataatgctttaggccacgggagttcacagatgtctgatagggtaactaattttattcttaatagtcatacattgtttcaacattttcagaggaccaggaggtgataagaaaagcagtttctgagtgagagcaaaaccttacataactgtcctagaaaaaacatgttcctctacatatagataatttgattggcacagataaaaaatggaaatcaattgatttagctattgtgagtgctgtatctttatgacaggtgagtgcttcaacccatgtagaaaataaaacaactcttactagtgcatactcacaaccccttagggagtagaactgtctaaaacatactcaactgttcccttaggacagtattccagttcatattccacttttacagttttcatggaattttggagcttccaaaaaagacatgaactgtctgcattccctagtattctagaaaagtctccccacaaatgtttaatattgcagtcaacatgtccctactgcgatgggtggtccctggagggtattaacaagtgttcattggcaatcatctggttccaccaaacagcctttctggctttgatatatcttatcctcactgatcaaacaaatcaataattcatctaaggtggagttattgacattttccatggatgcatctttaagttccataagaggtgcttgcataaggactttagtcagaaagccatgtttagcatgatcccctgctcacgtatttttttctagcttctaaagtgcctttcatacatggaactttgtcttcattaggaaatttatttcaatagcgtcaagacatcaaataatttatgtatttggtgtccatttttataaagatacatgaaatatatgagaaggttaagaagaggtaaagaaggttaaggaacctcatcggctccattatatttggaagttgtgacctgtgttaaagcattgactatcactgcttatatttatcataatttggcatgcaaaaatgagagtcacaatttcagctacttgcattaattttacttctaagagattgaattttataatagagtcgggtagttattacataaaaagttttgcgttattccttttcaactttgagtttaatacattaaaacaattaattcagaagttgatatgagactgtccaaaatatctgtttgagtgtggacacttcttaaatgacaaaagcacagttaaaagatttattgattgagaagtgtaatggagttgaacactatgaagataaatttgtaatatttcataattactccaccaactggtagaacaaataatggatgcttttacaaaatagataacttgtactgtatgtgatatcataagatatctgaagacgcttcaaccaattttgacaagaaagatctgaagacgcttcaaccaattttgacaaggctaagataagctattttaagacaagagcgataagctatggctactatattaataaataaattatggtaggcaaggcaatgacctttgttgtttgcagtgttgttgagtagtatcactagggcatggtctttaatgtttacacagaaagaaaatttgtcacaatcggtgatcctgtaatcagttgtcctgtatatgggatcgtccagaacacattctcttcagagcggggcatacagaacggcgtggcttgctggggcttatttggggtctgaattgaagtcatggaaaaaatataaattcgaaggtttgataacctaataaccaaactctgtaatctaatatgatctgtatgaacagagctggctgttgaaactgaatagaaaagagaatgggacctttaaaacacaacttgatatctgaggggttaattctaaactcttcgtcaaagagagattcgtttttctgctgtttggccccaagattggcaactggataggcattggaattgaggaggaatactgttatatcaatagataagtcaaaagatctgcagagatttgtacaaaccttcttatcataacatgatgtatttgtactttaggagaaacaacaacatacatagatgtgaggctagaggattattgtatcttacattgtctgtataattcattacaggtatcaaatatgtgtcaatctcccagttccatcacaggtgcaatgataaaatacagtagttggtcaaatgatcatttttcctctcaatgtgaccatgtttattttcagatttgttaacaaattaagagttggttgatccaaaagaaagtctgcattgggtgagcttctcagccagtacatagagaagtgtgaggtgacacacactagtttgctataccaggaaacctctgtttcctgttctagggcagcagtagcagcagcacatggcccagtaattcttctctcaccatgccaggttcacctcacagtacagagtcctgaaaataaagaagaagatttttttttatctagaaaaggaaccaaacatgtcactttctagcctgctgaaggtggtcacagcttcactgtggctaggtacgggtggcccagtgggaatggactttctgtatgaactaaggactttggaagtatctttatggaaactttgggaaggaggggtaatggggtacaaaaattgaatttctttgtcccaatccactttatccttaaatcttcaaattctatcttttttccttcaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagagagggcacagtgacagaactgtcggagggaggtgtacaaaagccctggggacctgcttgagacctccacctgctggagaaccaaggcgggaaatcaacatcacagacaggaagtggctacagctgtggcagcccagatgcagtgttgtaggaaatacactcaactctaagaaaatacctctttaagttcatagaccatgatcaaagttatcattaactaaaaactttcttatccctgaatctttggtttaaagtttagacataccaaatttgtgactgaagattgaagagaaaaaactgccgcaataaacaatttgccatttggccactaaattgaactggattcaaaaacatgtgactgaaaaatcatttaaaatctctgtgaattttcacatcaatttgttcagtaaatactggagatctacaaaaagttcatgaaaaatatgtattataaaaactatttttggatttcaatttttttttgcaccaaaataaacttacacttaaattgctataacatatgtagacagaatctactttgaggcactaagaaaaataggacagcaatttgaaaagaacccctattagagcaacagattctgctaaaatgaagcaaaagaaagcgtcacatttatggtgaagggtgggtagtagaatggtgaaatcatcaattctctatgaaactttacgaggtcagtgctccaaataaatcagcagtttgcaagtggataactcattttaagaagggatgagacaatgttgaaggtaaatcctgcagtggtagaccatccacaccaatttgtttggaaaaagttaaccttatttgtgccctaattgaaatggactgatgattaacagcagaaacaatagccaacaccacggacacctcaatcggcccagcttacacaattttgattgaaaattaaagttgagcaaactttccattccatgggtgccaaaaccattgcacctagatcagttgcagacaagatcagagctttcaataaaaattttaagcaagtgggatcaagcccctgaagcatttctttgaagagctgtaacaagagataaagcatggctttaccagtataattctgaaggcaatgcacaatcaaaacaatggctaccaagaggtggaagtggtccagtcaaagcaaaagtggaccagtaaagtgcaaaaattatggcaacagttttctgggatgctgaaggaattttgcttgttagctttctggagggccaaagagcaaaaatatttgcttattatgagcatgttttgagatatgtagacaaaactttaggagataaatgcctaggaaagctccaccagagatttcttcttcacgatgacaatgatcctgctcactcctctcatcaaacaagggcaattttgtaagagtattgatggaaaatcgttaggcatctacatagccttgatttggctccttggacctctttttgtttcttaatgttaaaaaaatctttaaaaggcacccattttcttcagttagtaacgtaaaaatgaactcattgacataattaaattcccaggaccctcaattatgcagcaatggaccaaatggctagtatcactgcttacaaaagtgttttgagctcaatggagcttatttcaggaataaagtttatattttttattttaattttactttacacgaaccttttgaaatctccttgtatttattgtgttatagacattgttttaaataggaaaggcattgaaatcttttatatttcccttctaaatatattatgttgtttatattgtttaatggattaatttgatttaggtttgtttgctgtgagtaaatggtacttaaacatttattttctaaaggtgtctactatgtgctaagagctcctttcatcttattaacaccttgaatgtggaagaaatcagtctccatactacagatttacctgcctctcaacattcctatccatgaagtgatcattatttagtggcttccagaaggacatgtggagaatgttcctcacagaggcacaaaccttttcatttatatattaataagacatcttttcttctaaaatgaatcaccatttttgaaatatatgaaatttccctttccctataatgtttccacatggtttatttcgttccactgatctatttgtttcactctatgacaatctcagaatgtagttttatagtaaattttataatctcttagggtaaatcacttttcaccaaaaatctttttcaagattttaaaaaataattcttgcacatttacttttcagtatgttaaaagttctgtcacattttcctcatgttcaatacccttctattaaactgacaaaacaaaaatgtctaaaaaccagacagttgaaattgcatttaatgaatatgttaacaaatatcaacttgttttcgtatgtttttattcagaaaaatgatattttttctaattgtaaaggatcttttatgttctctattacattgtgaagtttcttacttttatcttcatatggatttgtatataactgttcccacacgttcatctatatatatgcattttaaatgaaattatcttttatatattcatttttactgatattcccagtacaaacaaatgctatttaaaaatcatcttggttatatagctaagagtttctaactttaaagtacagataatttgcaatatattcatactacttgaaccattaaagtttattttatgaacctagcctaaccttaacccaacacctaaaaaatagcatgataaaaatatttactctccaatttttttttttagacagagtctcgctctgttgctcagactggagtgcagtgccactatctcggcttactgcatcctttgcctcctgggttcaagcgattctcctgcctcagcttcctgagtagctgggattacaggcgtgcgccaccaccacacccggctagtttttgtatttttagtagagatgaggtttcaccctgttggtcaggctggtctcaaacttctgaccttgtgatctacccgcctcagcctcccaaagttctgggattacaggcttgagccaccaagcccagcctactctcctattaaaaagtcaagaaacaacagatgctggcgaggctgcggagaaataggaatgcttttacactcttggtgggaacgcaaattagttcaaccattgtggaagacaatgtggagattcctcaaagacctacagccagaaataccatttgacccagcaatctcattactgggtatatacccaaaggaatataaatcattctattataaagatacctgtacttgcatgttcattggagcactattcacaatagcaaagatgtacaatcaacccaaatgcccatcgatgatagactggatgaagaaaatgtggttcatatacaccatggatactatgcagcaataaaaataaatgagatcatgtcctttgcagggacatggatgggggtagaagccattatcctcagccaactaacacaggaacagaaaatcaagcacctcatgttctcacttataagtgggagctgaacagtgagaacacacggacacaggaaggggaacaacacacactggggcctgttggggagggaggcggagggaaagcatcaagataaatagctaatgcgtgtgaggcttaatacctagataatgggttgataggtgcagcaaaccaccatggtacacgtttacctatgtagcaaatctgcatattctgaatatgtatccaagaacttaaaagaacatatttaaaattcattgaagaaattgaacatatatttgcaagtgtcccatgccaatataaaacacattataataagcatgtatacatcttattaaatcagaatgaatatccatatattcatattcatataacttgatataaaatagcagttggatacatagtattaatttaaaaattctagttttaaaatttataattttagatttttaatttaaattttaaatttcaaatttttaaaatacctcattttatttctgatgtctggaatcttatttagttgaaaatgtctctttgaattctctgagtaccatgagcttgtatagcttatgctgctgcctctaatgtagctgctattgttttcaatatggaatgaacaaggtgattggatttcttgaaccacttactataatagaacctctagatatttctaccaaataaagagtagagaacaaattaaaatacgccaaatgtatttttacagctactttcacatctattagatggagtctttcatagacattttatgaaagagtttcataatcctcacacttgttacaacatacagtctaaacaggcaagatctattcactctaacataatatctaagggatggtgtgaaggatattgcaagcatatacacacacacgcacacacactcacatctcaccacaagttagagtttacagatagcggtttacctttgaggtagttagagagaaccagtaaagaagtcacacatattcagcctaataagtaatgagttcaaatctaatagaaatgacatctaaaattggaatcttagaaacaagactctactaaaagataactttggaatgcaccaaaaatcagttttttaattgagaaatattgcctttcactaactcttcagtcattatcattgtatttcttggcatctacatctgggaaaacctttgtaaccacaggtaaaatgtaatatggaaatggtcactctaccttagtttaataaatgtattcaattgtcaagtgacagaaaatttactcttgaatagagatgcaaatatttaaattaagtaattaaaacccagaaggcagtgtattaacaaaataatgcagcttgatttttaaaaagttattattattattattttttttattattatactttaagttttagggtacatgtgcacattgtgcaggttagttacatatgtatacatgtgccatgctggtgcgctgcacccactaacttgtcatctagcattaggtatatctcccaatgctatccctcccccctccccccaccccaccacagtccctagagtgtgatattccccttcctgtaaagttatttattcacttatatatccatttatttttaaaaaatcattcagcacctacagagtgacaaactttgtgctgagaactcagtccatttaacaatcttattgcaatctctagcatgtaatagctcaatttctatactgtaggtttacctgccccataccagatttatccataaaatgattaataaattagtggctcttagagggacattgtagagaggcagaatttgaagtctttcttttctctgcttttgtgcttcattttacccctctttcaaaaacatttaatgccatcatgtggatcaactttgcacacccccagacctgttccaccatccaaaatcctcattcttttcaatcttctccttctacctccaacaccattttctccttccctaagctttgaatggtaatggttggttggtaagtgatcttgtattgtaacatcctcttgtatttgcatttgaaaagtagatgtgtatagtataaatcttaaagagaaatatgtttaaaaatttttaaaattatttttaattgtggaaaaatatatataacataaattttgccatgttaaccatttacaaatggacacttcagtagtgttaagtacattcctttgttgtgcaaccatcactaccatccatcttgagaactcttttcattttggaaacctgaaactctgtgactactaaacaatagctctctattttcttctccacctaatccctagaaaccagccttcctttctgtctttataagtttgactactctaggtactttgtataactagagtcatacaatttttttttgtgactgccttatttcacttagcgtaatgtcctcaaagttcattcatgtcatagtatgaagcaggctttcagaatttccttcctttataaggctgcatattattcaattgtgtgtacataccctattttgttaaactatttatctatcaatggaaatttgagctgtttctatcttttggctattgtgaataagctgctctcaacatgagtatgcaaacgtctcaatatttggggtatatcccccaattctctcaactttagaagtgatatacccagaagtgcaattgctgaatcacataataattctatttttaattttttaaagaactgccaaactggtttccacagtggctgctgtaccattttacattttcaccaacaggacacaggtgttttgatttctccacatttcatcagcacttcttttactatcattatttttgatatgaatagtagccatcctaatgggcatgaagtagtatgtcattatgatttttatttgcatttccctaataattcgtgatgatgagtatcttttcctgtgcttattggccaattgtatatcttccttggaaaaatgcctattcaactactttacccattttgaaatggggtgtctgtctttctctctctctctttctctctttctttctttcaagatggtgtttcaccatgttgcccaggctggttttgaactcccgagctaaagcaattcacctacctcggcctccaaagtcctgggattacagatgtgagccaccgcgcctggcctgggttgtcttttttttctgctgagttgtaagagttctttatatattctggatattgatcttttgtcggatatatgatttgatatttttttttccattccatgggttgtttatccactctgtcactccattaattgtgccctttgatgcacagtagtttttaattttgatgtagtcaagtttatctaagttttcttttgcatcctatgcttttggtattatagccaagaaattattgccaattccatgctttctgaaggctgaaaaaaaagaaaaaaagaaaaagaaattattgccaaatctaaatcgcgatgcttttcctgtaagataagagtgcagtttcactcttttgcatgtggatatccagtttttcccaacactgtttgttgaaaagactttcctttcacccttaaacagtcttaggaccctttcctaaaataatttggttgtaaatgtgaaggtttaattttgggctctctattgtattgcattggtctatatgactgtcattatgcaagcaccacacagcttttgctatattactgtagctttgtaatcagctttgaaatcaggaagtgttagaccttccaaacttgttctttttcaagattattttggctatttggggtttcacaagctgccatatgaacttttggatggatttttctattactgcaaaaacactattgggattttgatagggattgaattgaatctgtagattgctttgggtagcatcgacattttaatgatgttaaattctccaatccataaatatcagatgtctttcaacttatttgtgccttatttaatttatttcagcaacatttttgttttcattgtgcaagtctttagcattgttgtttaagtttattcctaagtattttattctttttgatgctattgcaaatggaattattttcttaatttccaaagtgttcattgttagtttatagaaatgcaattgatttttgtgtgctgtttctgtatccttcaagtttgttgaattcatttattagttctaactacaagcatatttaatggtggaatttcaggtgttgtgacagcagattggagaacaggacatttgtctcatgtccctcaggataactcatgtaggctgcaaaacttcaagcatacatagaagcatcaacttcataatgtaatcattttatatctttaatacatcaggcccttcaaaatttagtttaaatgttgagaagtcaaagaatgatgtccttctaagaataaatattctaacacatgatgatgtgctgaacaagatgaagaatttgtatttggatacatatttttaaagcaatgtttagttagtaattgaaaatactaaaccaggagaaaataatgtgcactctggtttccatactagagagatatagaagcagaaagttttacctcagtccacagttctagtaaataaacatccaacacttaaacttgggtcatttgactccaattgatgaattttcagcaaacaatgaaatataaaagtaagccaattcaatatacaactccagaagttataaaattaacagtaaaataaaatggttgagagtagattgaaggaattaaaaataaaagcaagaaattaatggctcaaaggaaaataacaaaatcaatgataaaaccacaacatgatattttgaaaataattacaatactaacatgatccagaaaaaaaaagtgagaagggacaaatgcatgcacaaaaaaaaacaacataattaagttgaatttattttgggaatgtaaagatgatttaatacttgaaaatctattaatataatgcttgaaattaacaaactttaagaaggccaaagatgttctaatgcctggtttggtggattgtttcatttggatctaggatgattcactgtacctgtgcatttgtgcaagctcatttaatttggttggctcttaaaaatattcggattctttctcttaatttgaccccaattatagatatagtgttattgttcttaaatttcttgttgcatttagattatttctatgaagaaaggggaaaatgataaatttattcaatcatatttatgacaaagttttggcttccatattattgtttttatatttttcttttattgtgaagtgtaccaagttttattttagaaattgctggaccagtaaatattgttcaagttgatgggttgtatagacttcagatttttggaatgttcttgaaaattattcccatttatgtccttaaaccttgcataatcttgtgaaataatgcttcataacaatgactgactgtgcacagattaaacaatgctttaaataatgttagtcattaggaagaattaagctatgatcctgtatgtgagaaattttcatactggttaatttgaacaactatgctttagactcctttatcacaagcaagtttccaggaacagaaagagagtggtcactggccatgaataaagttccagtactctggtggttcacagaagtttaggaactttttcagccttgctaccatgcattgctcatcaggtgtttaataattggtctgaaaggaatgcttatgccactacctggtggtcagctcctaaactgcagtttattcatcctttaaaatatgttttctttcctcttttagtcaaagaatgagacctgaaattatttaattattttaaaaaatttcatttggataaatagagcacctattaacttgctgtcttaaaatatttcaagggcttgggaaaaagtcacgttggtgtcttctaacttctctctgaaatttctctgaaagcaatttatactggaaaaaatagggaacacatgttttgctattaatgagatttatgttcaaaactattaactttgccatgtacttacttgctgaatacttttgtgttttgttacattttttttgtaaagtgtgatagtgatagcttctttagtatttgttgtgagaattcatcaataatgtatcaaagaagattaacaagtagcagatgatctaacaatgagaatattctcaatagacccagaaaaggcatgtgacaaaatccagcatccattcctgattaaaaactctctctaaatgagaaattaaaaggaactttctcaacttaatataggaaacttacaacaacctatgtcaagtgtcatacttggtgaaaaactaaaggcttctccctaagatcacacataagaaaaaagttattgctctcactgtttctgtttaatattgtactagaatgtctatccagtgcaataaggcaagagacagaaacaaaaggcatacagtttggaaaggaagaaataaatcaagctttatttgcagacaacataattgtttaagtagaaaatccaaagaatctgcagaaaatataccagaacaaataagtaagattgtaaaggttgcaggataaatgatcagtttgcaaagattaattgtatttatatattttcacatgcgacaatcagaaattaaaaataaaaacacaataccatttacaatagcatcaaaaatattaaatgcttacagataaatcttacaaagtatagaagacttggtaacttaaagccacaaaacctcatgagagaaattaagacctaaggaatggagagataaactatgttcatagattgatagactcaatattgttaaaacgtcagttctgtttcaattattctacagattcaatataaccacaataaaagttctgtcatttttttggttaaaattagcaggctcattataaaatttactcagaaatataaggcacctagagtagccaaaacagggttggaaaagaaaaaatttggagggataatattatcttacttcaagttgttttccacagtaatcaaaacagtgtggcatttgtatacagatagactaacagattaatagaacagaatagagcccaggaatagacccatatatacatgaacaactactttttgacaaaggtgcaaaggcaattcaatgtggaaaggatagtcttttcaacaaatagtgcttaaataattgaatatccatatacaaaaaaatgaactttgacactctcataccatatacaaaaagttacttaaagtgatcataaacataaatgtaaaaccccaaatcataacacttcaagaagaaaataggaggaaatttttgtgaccttggcctatgcaaacatttcttagatatgatagcaaaacatgacccataaaagacaaaaagttgataaattgaaaaattggttttcattacaacttaaaactgcctctggaaacaattctgtcaacagaattaatagatgagctatagactggaaaaatacttgcaaattgggtatctgagaaagtcatttatttgagttatgcaaagaacccacagaacccattaacaaaaaaaaatagaaaagtaaataaaaggggcaaaagatttgaacaaacacttcagcaaagaaactatatgaatggcaaataggcatatgaaaacatgcttagcatcattagtcattagggatatgcaaattaaaatcacaattaggtactactgcatacctattagagtggggttgacaaggatgtggagcaactgcaactctcaggtactactggtggaaatacaaagtaatataataactttggaaaataattgggcaggttttaaataagtcaaatatacacctgatatccgatgcagccattctactccaagttatttgctctaagagaaatgacagaatacacctatacaaaatcttgaatacacgtttgtagtaactttatttgtaacagcctcaaactgggactaactgaaatgtacatcaacagataaataacaaacacattgttttatatctatataatgtaatagtactactcagcaataaaaagaaataaaccattgtttcaaatgacaccatgaaagaatctcaaaataattatgctaagtgaaagaagataaaccaaaaaaattgtatatgatttaatttgtataaattataaaatacacaaactaatatatagtgacagagaattgcttggaaatgggcatgggagataggaaggttaagagaaaaagtacaaagaaatatgagaaacttttggggtgatgtaaatattcatcatgttgattgccataatagcatcacaagcctatatgtatgtcaaatcttataaaaatgttcactttactttggcgcagttaatttttatgtcaattatacatcaataaaaccatttaaaaatccaatttaaaagtacatgtcttcaacatcacagaagtattctgatatggtccaagatgcaaactgttctcactgggtttaaactatttttcttaagtatggatgacaacagtctacacccatgtgctctactgtttattttcaacccagcatcattccagcttattttgcattcccctttgtatatcagaatagaaatttgtagctgattttccagaattcattttcaacatagttctaggcttgtttctgacaaagtgatttggaaggtggaggagaaggagaagagatttgcaaacccaaacaatatctgggcctgaatttcttaatgaagtctgtatctgagaaactattcatatgctgactctggacgcattctttatctgaatctggggagagtgaactccaggaaacagactgaactaagtgtctgttcttagctatgtgtctaggtataaatgtttacaggtccttgcagaaagttagatccttctcccaaattttactctgataacacttctggaggttttttcttttctttttcattttatttttagatttacatgcggaggtttgtaacaagagtatgctgcgtgatgctgaggtttgggctcctagttggtcacccagatagtgaacatagtacgcaacaggcagtcacctggatagtgaacatggtacccaataggatgtttttcagcccctcccccctccatctctccctccttttggagtccacgatgtctattattcccatctttatgtctgtgtgtgcccacagtctggcttccacttacaatgagaacatatgatattttgttttctgtttctgcactaattctgcacttaagataatggcctctagctgcatacatgtttctgcaaaggatataatttcattcgttttatggctgcatagaattccatggtgtatatgtaccaaattttccatagtctatcacaattgatgggcacctaggttgtttccatgtctttgctattgtaaatagtgctgtgataaatatatgagtgcatgtgtcttttggtagaatgatttatattcctttggatatatagccaggtatgggattgctggcttgaatcataaatgtttttttagttttctgagaaatctccacactgctttccacagggctgaactaatttgcattctcagcaacagtgtataagcattccattttccctgcaaactctccagcatctgttattttttgaattttaataatagctattctgaccggtatgagatggtatctcattgtgattttgatttgcatttctttgatgattagtgatatgaaagattttttcatatgcttgttggccacttgtatgtcttctgctgacgggtgtctgttcaagttctttgtccgttgtttaatggaattatttgtttatttcctgttgatttcttaaagttcactacagattctggatattagtcctatgtaggacgtatagtttgcaaataatttctcccattttgtaagttgtcttttaactatgttgatagtttcttttgctgtgcagaagccttttagattaaataagtcccacttgccaatttttgtttttgttgtaattgcttttgagaacttagccaaaaattctttgcctaggctgatatccagaagtgcgtttcctaggttttcttttaggatttctatgaggtgttacatttaagccttcaatccctcttgaattaatttttgtatatggtgacagataggggtccagttttattcatctgcatatgtctaggcagttatcccagcaccatttgttgaatgagtcctttccccattgcttatttttgttggctttgtcaaagatcagatgatcataggtgtatggctttatttctcggttctctattctgttccatgggtctttgtgtccgtttctggaccattactaaggccaagttttagttacttagccttgtactacaatttgaatttgggtaatgtgatgtctctagttttgttctttctttttgttaaggattgctttggctattcaggctcttttttggttccatatgaattctagaatggtttctactaattctgtgaaaaatgactttgacaatttgataggaatagttttgaatttgtagattgctttgggcagtatggacattttgacgacattgattcttccaatccataagcatggaatgtttttccatttgttcgtgtggtctatgatttctttcagctgtgttttacagttcttcttgtatacttctttcacctctttggttagctgtattcctaggtatttgggggcatgtggctattgtaaattggattgcattcttgaactgactctcagtatgatcactattggtttatagaaatgctcctgattttttaatgttgattttgtaccttgaaacttcgctgaagtcattcattagttctggagtcttttggtggagtctttagtgttttctaggtatagaatcatattgtcagtgaagagagataatgtaacttcttctttccctatttggaggccttttacttctttcttttgcctgcttgctctgggtaagacttctagtactatgctgaatgggagtacagagagtaggcattcttgtcttgttcccgttctcaaggtgaacgcttccagcttttgcccattaagtatgatattggctatgggtttgtcatagaccactcttattattttgaggtatattccttcaatacttagtttgttgagggtttttatcgtgaagagttattggattttatggagtgctttttctgtatctattgagatgatcacatgggttttggttttaattctgcttatgtggtgaatcgcatttactgatttgtgtgtgttgaaacaactttggatcccaggaatgaagcctacttgatcccaggaatgaagattagctttttgctgtgctgctggattcaggatgctagtttttgttgagaatttttgtgtctatgtgcatcagggatttgatctttagttttcttttatcattgtgtctttaacagatttttggtatcaggataatactggatttgtagaacgatttagggaagaatctcttcttgattttttggaatagtttcagcatgattggtatcagttctttgtatgtctggtagaagtcggctgtgaatccgtctggtatgtggcttttttattggtacattttttattactgataagctgcacttcactaaaatttaaaagttacgctcttatgaaatgcaatgtcaagaaaatgggagacaaaatgcaaactgagtaatccattgcacttgaacaaatctttcttgatattttagtttctctccatgtaagagacatatttcagctgcatttagtctgccatcttaccaaaaacaggtttttgttttcttttgttatgttataaaatgaaaactcacaggaagtaagcataatgaagtgtttgtttttactgcagacacttcataggaaaagaccagctttaataatctgtgtaatcatggggacatttttttgtgatgacctcagagtgttatctctgatagttgataaccgtcttggtataggacagtgttcacaaataaaatcttgtaaacaactatcaggctggcagcaacaaaaccatcagggaagtttttaaaaaatgaaaccctttgaatcttggaaattgtggtttgaaatgttggaaatcgtgattcctaaagttagtggtcttgtcccaacatctgtaattttaaatgactcacaagttaattcagttctcacacaaccaggttttagaacctcgattatcagccgatgtatctttatcaatttgtaaagcaagagaagaggaaagttctaactcatgcttcagtctgttgatgcaaatctacatgtggattccctacatcatcagaggaaattgattaaactttggcaataaaatgttggcatatgaccacagtagaaagcgtccttgaggccagatctccagattatagggttaacacttgttgcctgattgtcataagcaagcaacttgtcttggagtcattgaaatcgtgagggaataaactattaatctgaggtcatatcttatcagtaaatgtcagtcactgctctacatgttaggatacagtgctgaaaaacatagactcagtaacagcaagacttcttaacattccctctgatttcaactcaaaacccttgtctgacatcccattgaattataccactggtctgcaatggatacgtaaaaatattggcctgtattaaaatatccaagaaaatggaactctcacctacagtcatactctaggatgctttgctaaagatcttttgtttcaggtagtgtccaaagaacaaaattgacaaaatagaccatagagatgacaacatctgcccttcatatttacaaggaccacctgagactggcatgggccttataaatgaggtcagggttgaggacctatttctgacttttggaaggagtccaggaaaacattcatcccagttcagcccctgtccaccagagggagtggcttcctaacacaaactcatttcctgctatcactgtaggtttcactgtgatttcttcatgttaaggatcaagaccattatttgggtaacacactaaagatgaactattctccaggcttagtatctctgatactcttactgcttggttagtgagatgccttttaaaatttggtctctgtcttctatcaagccaaaaaaatctttaaccataatttgacctaagagcattatgctcaaggctaaacagatctctctctctctctctctctctttttttttttccctaggaagaacccgtggaaattcagtgacccagatggaagggccagtgactctctcagaagaggccttcctgactataaactgcacgtacacagccacaggatacccttcccttttctggtatgtccaatatcctggagaaggtctacagctcctcctgaaagccacgaaggctgatgacaagggaagcaacaaaggttttgaagccacataccgtaaagaaaccacttctttccacttggagaaaggctcagttcaagtgtcagactcagcggtgtacttctgtgctctgagtgacacagtgacagggactgcagggggagctgagcacaaactctgagcagcacggggggcccggctgctgagtgtcagccactgtgatccactctggttctagcacagtctgtggttgtttgtgcctcagtttctctgattgatgcagtaatcatacacatggccagaggagaaaaacaagaaatgaacatccccaaacccagctcttggttagtgaaattaaaaacagacattgacaccaaatagttcctcatccagtgccaaagtaatttcaaggttaaaccacagaaacaatgaagctgtctctgtgatcatccttgcagacaaagttcaacccccacctcttgttccaggtcactctggtagatattggaggtggatgtgttctattacatttttacagagccaaatatgccagagaaggtggcgtctgtacaatgtctctgtaacagagtacagcaggagagatgacgtgagagccacagctcctcaattcagttcaaatgtctatgcaggattcttaatagagaaagaagggaagagaagaaaggaggagggacagaatgtcacatgtaaaaaaataatacggagaagaaagcaacaattgtcagagagagggaagttttcttttttggtaagccagatggtagacaaaggctgatgttccaaaaagaaagggaaggatcaaaatcattattgaagaaatgactcatttgtaaatcataagtattccttgcttgttacattgatcaattggctttctaacaacaagtctttaagtgagttagttttgcagtgccaatggaagattaagcatacagatttatatttgtatccctgtgaaatcctattaaagacacagtaaagaaattgaaaagggcataaaaccacaaaaagaatagaaaaggaggtgacagcagatggtgataccaatacaattttagaaggcaggagtgtatggagaaatgaaaacttgcatagcagaccagataaagaagaaacctgggcccagtgaaagaagacaacaaggaacaccaatgtgtgttgagcctttgtggaaaggtttagaaatcagaagtaccaatgacctttgaataattggtgaagataatgctttgtgtgtgtgtttctattttgagggtatttgaaaagagggtatgaaaagaggaggagaaagtgagaaaatgtataattaattgaccacccatgctctccaccactgcatgtataacaagcaatgctcacttcccaaacccagaagaaagctggaatttaatatttcatgaattgaagtgcagaacacaataacacaagaaagcagaataaaattaaaatgtaaaaatataatagtcaattatttaatataagaaatataaaatattgtttatgaaatattctcgtagtagtctatgtgtttcaacccaattgtcttctagataagtttcactaatttatactatcagtagtggtgatttggcaggatacctattttccttaaaccttatgtattactaaactttttgacattggcttatgagttagaatttcatttaaagaatatttcatttatttatgaattagatggagcgtcatttaatatacttaaaagctatttacattttttgatatattgccatttatatatctgccccccccccttttttttttttaccatttattgtctttattttccacatctaccattgttccaactatgagatactggcaaaccctcaccctttgaaaaattctttattttttaagagcagttttagtttacagcaagattgagagaagggtacagagatttgccacacaccctctatcccttcccagatatatatcctctcccattatcaacatccaccaccagagtggtacatttgttacaaatgatgcacttacattgacatgtcatagtcactcaaagttcatagtttacattagggttcacgcttagtgttgcataatatatagatgtggacaaatgtgtaatgccatacatctatcattgtagtatcagacagagtaatttcactgtcctaaaagtcccttgtgctctggtattcattcatttcccaatataacccctggctacctctgatcttttagtgtttccatgattttgccttttccagaatgtcatatacttggcatcatacagtatgtagactttccacactgacttctttcacttagtaacatggatttaaggtttctgtttctttcatgtcttgatagctcatttttttttagtattgaataatattctattttctggatacatcatagtttatttatccattcttcttctgaagggtattttggttgcttcgaagttttggcaattatgaataaagctgccacaaatatccctttggaggtttttgtgtagacgtgttttccactacttggataaataccaatgaggaaaactgctggatcatatggaaagaatttttttttttttaaaagctgccaaactgtgctcaaagtggctgttccattttgcattcccaccaacaatgaatgagagttcttttttgtttatatccttgctagcatttggtgttgtcagaggtctggatgttggccattcaaataggtgtatcatggtatctcattgttgttttaattttcatttccctgatgccatatgatatagaacaacttttcatgtgcttatttgccatttatatattttctttgctgaaatatgtgttaaagtcttttatccatttttttttggtcagactgttttcttattgttgaattttaagatgttttgcataacagttcttgatcagatatgccttttgcaaatattttctcctcgtctgtgttttgtctcccattttcttgacattgcatttcataagagcataactgttaaattttggtgaagtgcagcttatcaataattttttttccagagaacatacctttgtctttgtataagtcgttgccaaacccaaggtcatctagattttctcctacattgccttcttggagttgagttttgttttgcattttacatttacatctatggttgctttttgagttaatttttgtgaatagtataaggtctgtgtctagagtctagattaattttcttttctttttctttttctttttttttttttgcctgtgaatgtccagttgttccagcaccatttattgacaaaactgtctttacttcattgtattgcctgtgctcctttgtcaaagattagttaactacatttatgtgggtctatttctgggttctctattttgttccattgatctatttgtttattcttttgccaatgtcacagtgtcttgattattctagctttacagtaagtcttaaaatcaggtattgtcattcatctgactttattctcctgtaaaacctttttttgttttgataattctgggtcctttgcacctccatataacctttagaatgagtttatcaatattcacaaaaaattgctgggattttaattgagattgcattgaacctacagattaaactgtgaggaatgaacattttgacaatattgagtcttcctactcatgcacatgtcatctgggaacaaagttatacttctttttttcctaatctgtatacttttttttttttttacttgtcttgttgcattagctaggactcgcaatatgacgctgaaaaggagtggagagaggcccatctttgccttgttcctgatgttagtaggaaagcatcagtttctcataattatgatgttagctatagattttggaacatattacttatgaagttgaaggaattccactctatttctagttcaccgagagtttttatcatgaatgggtgatgaattttgttaaatgctttttctgcatttattgataaaatcatgtgatttttctagagacttgaaaagttgagaagtttatagccgatagacacaggctcattaaaagactgagaacaaattgtgggcctatagaacacttcctctcccctcacaccttaccaccatagcactaacagcctatttacagccgttccttttaccaagtatgtcatgtctggctatcaaataaaaaattacagggcgtattaaaagggaaaatacaattgaaagagacagaaaaatcatcagaaaaacacatcagggttgttggaactatcagacccaggaatttgaaacaaatatgccaacggctctagtaatgaagtagagagcatgccagaacagatgggcaatgtaacagagagaccgaccttctaagaaagaaccaagagaaaaaaaaagctagagatcaaaatacagcaacagaaatgaagaatgtcgttggctgacttattaataaactggacgtagctgaggaaagaatttctgaacttaaggatatatcagcagaaacatccaaaactgaaaaagtagagaaaacaaagactaaaaaacacccaggaaagagtatctaaaaatattcaaaaactgtggaacaactatagaagtataccatacatgtaatgggaatgtcacagggagaagaaagagagaaattaacagaaaacatatttaaaacaatgatggagaatttctcccaaaataatgccagatgccaaaccacagatctaagaagctcagagaacacttggtagcataaatgccaaccccctccaaatcctaagcatatcattttcaaactagaaaatcatagacaaagaaaacatcctgaaagaagctggcaaggggtggagtgggggaagtgccttacctatacaggaacaaacacaagaattacatccaacttctcttcagaaatcatgcaaggaggagaaagtatagtgaaatatttaaggtattaacagaacaaaccaccaacctagaattgtgtacccagagaaattatccctcaaaagtgcaagagaaataaagacattttcagacaaaaattggggatacgtgttgccaagtagccctgccttgcaagaaatgttaaaagttctttaaagataaattaaaagttcaggtttcttctatggcagagttgtgtaaatatgaatacattcaaaatataaatgtataaataaagataaacctcaagtaagtctcagttcaactacagaaaaataagaaagtgcttttatgagatatttagctaaaagtgcaattcctgtttgtcttttgcacactagtggagactgtcccataaccagagaacccacttgcaaatttgaaaacctaattagcttccttctcagaaacactctgcttattcttacatttatcagcttctgagaacatgacagcaggtgtaagaagcttctccatcagtaatccaaactcggtgcctgtcattgtaaggaatatgcaactgatgctggagaccagggatttcattcctgcttttgcagggacgaagtgagcttgtgtagaccatgatctctctcctgaatctacgacaagaattctgctactgcttgatgaaaagggggtcactgagaactctggattttttaatgcttatttgattccaatgagggggcaagtaaaggctctgagagcctgatggttgctctctctgaactcggtaaaacattgtaaaaatagtacatgaaaataaaataatacaattttattattgtcttgtaagtgtgcagaaaatgatactctgtcttagttttcccttagtcgtatcaaagtcttgaaaatttagcctttaccaaagcatttccttttccatctaggcataacacttctgctctaaactcatataaactattagaacattcctcaattaccacaaaaaatccttcaatttcctagtaattagtcacagaagaaagctattatgataaaaacagatggtatttgttctagcatataagtgaataatttatgtttcatgagagtagaagtcaagcatcaaatgatcaaagctgaatagaatttttagcagtaggtttttcgtatcctcctctccaaatttcatcctctcctttcttgaaggggttgacaaagacaaagtgtggcctgcctgtgttctctctcagctcagtcactttcacgtctttgaaaccaaataatgccatggggctgagtccttctcagctgaatccatgaaaaatagttcatcttttcacaaactggtaaacaagtgaagcatttcaattcacacattgggaatgtcaccatttaccatgtgatttgttgattagggaacaaaaaggagaggtggtgaagtgagcagttaagagtaagaatttaggagcctgtttgcctgggtttgaatctgatcttgaatgcttataactgtaaaatcttggctaagttgcttaactttctgactaccatttgttgtggggattaaatgaatatatatatttgaaattctggcccatgataagtgctcagtaattgttagctgattataaaagctgctataaaatcttctataatattgagaaactaagaagtcacttgtgttcagggagagaaaaattaccatttcggtagttaattatttagtaaataagcaagaaaagaagaatacatgttgacctaaaataataatgaagcccttatatgtacaatgtgctgtatcaggacatttgtctactgatagcagtataaattattgcttttacctggaaagaacttatcagaaaaaatttattccataaattgaggaacaagataaaatacataaaaacttaaccaattgttaaaattataagtatgtggacaattaagttttaaaggtattttcaggaggagatcactgtgttacagaaaagtcaaggagaggcatcatggggaaatagaaaatttaatcaggctttaaaggacagacacacattaaatttgttcattatacaattatttcttaaataggcaacaggggtttttgtaggtttgatgaatagaataataaacaaaatagacaaagtcagacaccagaagagcttacctcatgaggctcgagtctagctttgtctacagtgttcaactttctcttacagaaatatcctatgaagttttcgttctaacatagatattgctcttgcttaccataataattggcctgttttatgtgatgattaaaaggtaaggtttttttgttttgtttttggaaacaggtatcactacgttgccaaggctggtcacaaactcctgggctcaagcgatccacctgtctcagccaactgagtagctgggactataggcccacactaccacacctggccaaggtctaagtatttaagtgctgtatctgtcacttactaaattatgtggccatggacaagtacttaatttagagcatctacacatcatcaattttaataacatacaacttaccacatgattgtaaagattgaattaaattaaatgaatttaattacatgattgaatttagtcaaaaataatttttcagctgatgatagttattctggaatgtggatgaaatgttgataaaacagaacataagataaaataactaaaaaatttaagtatagattaaggtttagctttccactctcctgctattgattatgttattttactatggttaaggctgagtcaccctttatttcatattgaccttattccatccaattatttgaactgactgtaatggctttcttgtttggtttctttagttcacaggttttatgcacagaatgaaacattcttgcccctggtgtaacttaatgtaaattctaagatgaattcacatgagccttatggagcaggtgtcagatataatactattatattgagctatggtgccaataattagatccgtatctgggggctcatttaacaggtttctgcattgaaaggagagaaaataacctttctaggctttccttggggaggaatgctttttggatattcaatttatgacttgtacatacatggtagatgctcaggaaggattatagaagaaaaaaaggaaggacaacaatctggcagacaaacaagcatcactctccaacaaatcagcacctggtcctaccaaggtccttttccatgttacctcttcagacatcaggaggagctgtgttatctgtgcatgggggaatggatcttgtttgtggttggctgggaggactctcagcttcctgtaataacagaactctgaatattcactcagagaaacaagctattggcttggtagtgtttgagggctcccagaccccaaccagagtccgcagtaagtctcatggataaagtggagaagcccttgggagtttgtggagaagcccttgggagttttgttcttgattttctcttggcagctgtgctgtgagttttggggctctggaaatatcattgaaaagagcagtttgtagtatcttctttaaaagtctgcacttggacacaggaaggggagcataacacaccggggcctgttgtggggtggggggacggggtagggatagcattaggagatatacctaatgtaaatgactagttaatgggtgcagacaccaacatggcgcatgtatacgtatgtaacaaacctgcgcgttgtgcacatgtaccctagaacgtaaagtataataaaaataaataaataaataaataaataaataaataaataaataaataaataaaataaaagtctggaagttatagaagggtggttagggcctctgtgctcacctgtggggacttgaaaggagagtatatcttccaaaagtagtcagccatgaatgaatgtcctctgtctgtggttctctgtttaaacaggggtgaacagcctccatattctggagtagagtccttcattcattcctgagtatccgggagggaatgcacaacattcttaattgcacttatgaggagagaacgttctcttaacttctactggttctggcagggtctggaaaaggacttgtgtctttgaccttaattcaatcaagccagatggaggagggagacaaacattttaaagaagcgcttggaaaagagaagttttatagtgttttgaatatgctggtctctcatcctggagattcaggcacctacttctgtgctttgaggcacagggtccccaagcacctgcagcctgtaccacaacctgcatccgggacccttgacacagccttgccttgcaggtgggagtgaaggtgttgtctttatatgtagagagaacttctttataaactctgtctccaaacagaagcgaagggtagtgcagaatctttcttatgtgatgaagctgaatttatattaaattaaattgcattttgttattattgaaatttcattcttcaatgtagattgtgctgtgctggttctgggcctgtttgcccaccgatcccttccacagctctgtcctttactctaaagtcgcagaccactgtggcacaggctctgaggccaagaggcaagttttctccatgctatactctcaccaacagtattttacccatttgcttgtaaattcatgatgtttcttgtatttgtatcatctatactattatttacttaattaaatgttaaattaacttttatgttgagtagacttcaaaactgtgtaaaatattgttcttattttaatggatactatcagtgaaattatattttatataaactatacatctgatgtgcaggctatgtttgttcctgatacaaactaaaataacattacatgtataacaattaaaaagaccatctgtgtactgcctaacatgacctcctatgttaaccacaatttagaaaatactgattcagctcatgtccctcatttaatagatgaaaaaagtagaatcaacagggacagcatcacttactcaaagcatgaattacagcaaaatggaagctaggaatggaacacagacattgtggccccttgtcacttgctttttccatgaaggatgtaaagtaggattcagtgtttgaaaaaaggagtggtatgttgtaattttaaactaaattatacttttattacttaattatatgttcattagaataaattaggagatataaacacccagaaaacatagaacactcctataatttcataacctagaaatgatagctattcgcatgcaataaaatttttggtgcacatgtaaagctatatttttgtataaatgtggtttataatacatcaagtatttattagcacacttttctttcaactttatatttaggtattttcaactcaggaagcaaatattgaagaataattttaaattattgcctagtttccattacataaatatgcttttttaaaaactcttttttttggtattgtttctacttatacagtattacagataatgtttttattaacatcattaaaggtgtagttttaatggaagtgaagttgctggaataaagaaaaacacatgatactgaatcccttatttccatggagctatttctcaccaaactgtaatttcaacagtagcacatgatgatgctaattttccaatattttaccaattgtaaacattattattttagattagcttccattttgttaagtaaaatattgttttttattattcttttcttttaatttgtgattttatacctttgattattaaaataaataaataaaatgagatgagaaaacatcagatgccatcacacagaataggtatcctttcatacagtaacatgtattttttgaaagtgtgaaaaatactgctttggtccaagctaccttctaactggtctctcttttctcaaggcaatcaattctctatgtccttgctacttgaagtgtgagccagcattgtctgaacttgtactgattctcaggctctaccctaggctgattgaatttgaatctgcattttatcaagatttccaggcgattctatcacatcaaagtttaagaagcacccatctgatgagttgccagaatgattttttaaagtataaataaagagctttctccacttgtcaaacgtgcttcaatggctttctactgctcctggaataaagtgtggtggctttcaggctgtgatataaaaggatctatataatcggaacctcccttggccctttggctttaaattctcttttcctggctctctgtgcagcaaaacttctgattctctttcccacatgtaggctctctttcatccatctgaaatgctctttccctaaatcttgttgagcctgactcaacaagagtcatccttcaggtctcagctcaaatgttactactgtagaagaaaaacctactgacctctgctactcttcctgactaatatatctgtctgtaatcctccccctaactctgtcagaacactctagttatttctcctatgttatttatcgtaacttacagttacatttttggtttatttgccagtatgttcattggccataccttctattagaatgcaatctttatgatatcaggggtattgttggtttagttcatggcttgattctttttgtttgtttttctttttttttttccaatttttattttaggttctgagggtacatgaaaaggtttgttatatgggtaaattgcatgtcacagggacttggtggagagattattccatcacccaggtaatgagcatggtacttgataggtagtttttggatcttcaccctcttcctactctccacctccaagtaggccccagtgtctgttggttccttctttgtcttcatgtataatcaacggttagctcccacttataagtgagaacatgcagtgtttcattttctgttcctgtattaatttgcttaggataatgccctttaactgtatcgatgttggtgcataggacatgatttcattcatttttatggctgcatagcattccatggtatatatgtaccacatttttttccagtacaccactgatacgcatctagattgtttccatatctttgctattgtgaatagtgctgcaatgaacatgtgtgtgcgagtgtctttatggtagaatgatttatatttctttgagtatatacccagtaataggattgatatgtctgatagtatttgttttatgttatttgataaatctccaaatggctttccacagtggctgaactaagttacattctcaccagtggtataaaagcattcccttttctccccaaccttgccagcatctgttattttttttactttttagtaatagcctttctgattggtatgagatggtatctcattgtggttttgatttgcatttatctaatgattaatgatgttgagcattttttatatgcttggtggttgtattgatgtcttcttttgagaagtatctgttcatgtcgttttcccattttgtctgttcatgttgtttgttttttgcttgttaatttgcttaagtttcttatagattctggatattacacctttgtctgatacatagtttgcaaatattttctcacattctgtaggttgcctgtttactctgttgatagtttcctttgctgtgtaaaagttctttagtgtaattaggtcgcatttgtcaatgtttgggtctttttgcaattgcttttggagtctttgtcatgaaatctttgcaaggcctccagaatataatttcataagttttcatctagggtttttatagttttaagttttacatttaaatctttatttagtccatcttgaatttatttttgtatatggtaaaacaaagagatccagtttcagtcttctgcatatggctagacagttacaccagtaccatttattgaataaggagtcctttactcattggttgtctttgttggctgtgtcgaagatcaggtgatcataggtgtgtggctttgtttatcggttctctattctgttccattggtttatgtgtcgatttttggattattaccaaggctaagttttggttacttagctttgtactagaatttcaagttgggtaatgtgatgtctccagttttgttccttcttttgttaaggattgctttggctgttcaggctcttttcttggttccatttgaattttagaatggtttctactaattcggtgagaaatgacaatgataatttgataggaatagtgttgaatctgtagattgctccgggctgtatggacattttgatgacactgattcttccaatctatgagcatgaaatgtgtttccatttgtttttgtggtctatgatttctttcagctgtgttttgtaatccctattttaggtatctttcacctccctggttagctgtattcctagataactttttttgtgtggctatagcgaacaggattgtattcttgattttgctctcagtttggaggttttcagtttatagaaatgctacttattcttgtacgttgattttatatcctaaaactttgctgaagttgtttattaggagccttttagcagaggccatgggttttctaggtaaaaagtcatatagtctgtgaggatagagattttgacttcctctcttcctatttggatgccatttatttctttctcttgcttgaatgttctggctaggatatccagtactatgttgaataggagtggtgagagtgagcatctttgtcatgtttttgttctcaaagggaatgcttccagcttttgcttgctcactataatattggctgtggatttgtcatagacggctcttattattttgagttatgtttcctcaatgcctactttgttgaggagttttaacctgaaaggattttgaatttcatcaaatgttttttatgtctattgaggtgataatgtagtttttttttttttagttcagttcatgtaatgaatcacatttattgatttgtatatttaaacaaccttgcatttcagaaataaagactacttgattgtgctggattagctgcaggatttggtttggcagtattttgtttaggatttttgcatgtgtattcatcagggatattggcctaaagttttcttcttttgttgtgtctcttctaggctttggtatcagaataatgctggcctcatagaatgaggtaaggaggagctcctattcctcaatattttggaatagtttcaaaaagtaccagctcttctttatatgtctggtagattttggctatgaatctttctagtctggggcttttttcttgttgtaggtttttattactaactcaatttcagaactccttattggtcagttcagaatattgatttcttcctgagtcaatcttgggaggttgtatttttccaggaatttatccatttcttctaggttttctggtttatctgcatagaggtgttcaaaatagtctctgagggttttttgtactgctcctgtgacatttctgattgtatttatttggatcttctctgtttttttctttattagtctagctatcagtctagcaatcatttttattctctcaaataaaaaccatttggttttattcatcttttgtatggtttttcatctccatttcattcagttcagctctaagtttgttatgtctcttcttctgccagctttggggtgggtttactcttgggtttttttagttactctagatgtgatgttaggttggtaatttgggatctttctaactttttgatgtggatgtttagcactatgaactttcttttcaacactattttagctgtgtctcagtgattctgttatgttgtatcttttttttcattagtttcaatgaatcccttgctttttccttagtttcactgtttactgaaaagtcattgaagagcaggttgtttaatttccacataattgtatggccttgagagatcctcttggtattgatttctatttttattgcagtatagtccaagagagtggttgatataatttggagtttttttgaattttttgagaattgctttatagtcaagcatgtggttgattttagagtgcagataagaagagtgtgtattctgaggttgttgggtggagtgtcctatagatgtctgttaggtccatttggtcatgtgtcgagtttacaacccaaatatctttgttatgtttctgcttcaataatctgtctaacactgtcagtggggagtttaagtctaccagtattattgcatggttatctaggtctcttcataggtctctaagaatttgctttatgaatatgggtgctccagtgttggatacatacttatttaagatagttaggtcatcttgttaaattgaacacttatcattattcattatttaatgcccttccttgtgctttttcatcattgtatttagaaagtctgttctaactgaaattagaaaaagtaacctctgctctttttggttttctatttactttgcagatttttcactgtctctttactttgagcctatgtgtgtcactgcttgtgaaatgggtctctaggagacagcatacagttgggtcttgcctctttatccaaattgctaccctctgccttttaaagtgggtcatttactctgttcatgtttaagtttaatattgatatgtgtggatttgaccctgtcttcgtgttgttagctggttgctatgtagacctgattgtgcaatttcaccaggtgtggtgggtgatgcctgtaattccaacactttggcaggacaaggtgggcaaattgcatgagcccagtagtttgagaccagcctgggtaatatggcaaaaccctgtctctacaaaaaaataaaaaaatttagctgagtgtgatgctgtgtgcttatagtcccagcaggctgaggcaggaagattgattgagcctgaccagtcaatgctgcagtgagccatgattgtaccactgcactccagcctgggtgacagaatgagaccctgactcaagaagaaagaaagaaagaaggagagaaggagagaaacagagaaagaaagaaagaaggagagaaggagagaaacagagaaagaaagaaagaaggaagaaagaaagaaagaaagatagatagatggtggagctgttttacagtgtcaatggtctgtcttaattgtgtttttgtggtggcttgtagcagtcttttttccccatgtttaagcattcctttagggacctcttataaggcaggcctggaggttacaaatttctttagcatttgcttgtctgaaaagaattttgtatttcctttgctgataaagcttagtgtggttggctatgaaattcttgtttggaatttattttctttaaggatgctgaatataagcccttaatctcctctggtttatgaggtttctactgaaaagttcactgttatcttgatggggtttccttagtagatgaccagccccttccctctagtggcctttaatattttttctttcccgttaaccttggagaatctaatgacgatgtgtcttggagatggttgtcttgtacaatgtcttgctggggctccctgagtatcctgaatttgaatgttgaccttcctagtgaggttgggaaaatttttatgggcaatattctcaaatatgtttcccaagttcctttctctttctctctctctttcagggatgccagtgaattataaatttggtgtctttacataatcccatatttttcagaaatttttgttcattattttttattcttttttctttatttttgtctgactgagttgattccaagaactattctttgacctctgagattctttcctcagcttgttgtattctcctgttaatacttaacaattgtattataaagttcttgtaatgagtttttcagctctatcagaacagtttggttctttcttaaaatggctattttgtctttcagatctcatattattttatttctttacattgtttagattccttggattgggtttcaattttcttatgaatctcaatgttcttacatccaaattgtgactgctctgtgtgtcatttcagccatttcagcctggttaacaaccattgcctgggagctagtgtggttgtttggaagtaagaagacactctagcttcttgaggtgccaaagttgtcgtgttggttatttatcatctgtgtaggctgatgatcctttaatatttgaagttcttgtcctttgaattttttttttacttttgtattattttatgcccttgagggatttgactgtggaataagttgcgttcagtcaactggcttcatttctggatgatttcaggggtcccgggttcagatgagcattcctgcactgcatgctctaaccctatggggttgggaccaggcccacttctttgttctctggcccctttaggttaagtaccgactgaactggaggggctgaggtgttactggtttgctgacatcaacactccacttgggggtgctggcaaaagcacttcattgaacttgtggcagcaggatcagggctcatgtacacctgtgccaggggcaatggcgggagggtgtggatatgtgtcagcagtggcctgtctgcagaagctctctgatggttaggcagagtttgctggtgaagtagctatgacaccagtcaccaggaagtgccctggttggacacctaacgcagagttgcaagtaggcatggtcaggtagggaccctgggagaggtcggcagacaagggggtgctcagatcagactagtcctgacccatgggcaagacaccgctactctgtccaggtctgacagtcaacaaaggctagagccacgtagaggagcatggtgcaccttggggaatgggcatccctactgggctcactgcctctattcccatgctaaacactctgggcttcacacaggctagagtcctgtcactgccagcactccaagtagctctccctgccagctcaaatttctatgggcatcatggggtctcctgcagttaggattcgagaggtccatgggaggagttagcaaatgctcacctatctaattcagcctttcctctggagacattgagcgtcatgaatgagtcccagtgcttggcagccctgtgcagggttcccgggttcctctcactttggtccagggtctgagtcttgtctccatccattctcaatgcattctttctgacgataccctcagagaatgcaagtcttcctgatggtctgatctcttggtaggagaagctctttctagctgtgtctaattgacgatcttggagctcctcttcctggctttattcttagtgtctagaataatgactagcccatagtaatcagtcaaaaaatctactgagtgaatgaagaatgaaatttgtttggccctcccctctttctcccttttcccttcctctcattcccactctagcaactttgacctttgtgtatgttgtctctacttcactatgtggggcagctcaattttctctggccctcacccccagactcagaacccagtctttttgtacttagtggcttctgtcaaatagattcactcagggcctcaacctttcctcacttaattgacctcaccttatcagatgtgatgtgaaggactgagtcaactcttaaggctagtaacccatagcgaaatatctaaaagaaaaacgacatacttaaaagatgtttggaaagtataaaagtaacttctcaagcctaataattatgagcacatatcaaagttttatttcaaattactgcaagagaaaaagctcctaaagaaacaaattcaaataattagccttggtatattgttacaggaatccagatttttaaaaatctggttaaagatcatttttgcattcaaatgacggttgcataattaccctgcttttgactgcctgtgtagtgactattaggcttctcacaagattaatggtcatttgagtttgtaacactaatttcccagaaggaatctttatttcattaaaggatattagaaaattgctcaagcgttttattagaagtgatggttaattaccatatggggctatgtatattatatcctccgaaaaatgcctgcttcataccagtttggagaaacttacctttctcagctatgtatgttatatcctccataaaaggcctgtttcataccagtttggagaaacttacctttctcatgtgtaatttaaatctttactttacaaatctttacaactcctttagtgaggatttgtcaggtcttggattttgtcccttcttacaagctaataagcttgtttcattgaggctgtcaataaaaacacagggctccttagtaagagacaaaggatttttattacttatggcacaacaaacagcatgaacattgatatatttccatcagtttctcctgcctttaagtcctcaaaagatgatgtaatgggtagtaagggatgctacccatgaagtggtattatgtcacaggtgaggaactctgagcttaggaagttcattgcttttataacaagcactcagccagcttgctctttgtctcagagggagacattacctcatctcccaaggttgcttgctggcataactctgagaagtgatccaggtagaatgctcatgtcattacactgttggcacactcatcaagtcacgtttgagtacaagagactcatggtggactgcctttcaataatatccactccatggtcttacactgggttagttgctagaaatttattttatgagtatgccagtttgtcagtcattctgatttgtgtaactgagagatgtcatgactaaatgcattacatttgtctcaagtagcatttaattaaggctactatcagcagaactctaagaagcagaatgagaccaacatgcagtattaaccttaattatgcttgatccagccaaatgtgagtaagttccaaagtacagacagctagcatgtagtattttatctattataacccatacatgaaagttcagactgaaatgttggtctttctttgaattaccacaaagaaaaaaccctaccattcccaatatagagatgttatatggtccctttcccccgggcataacccaaaatgcacaagttaatcaaatttgggatttattattaaacttgatttggataagcattgcatcactttggttaaactacgtgagcagtgtcagtgagtatttgcaatatttgcaacctctgtagccattcatgacataacccaactgtcaagatatcaggggaagcatatacatttgtgtcagtcaatttgagacaaggttgtgctgattcttgtgtttgtatacttatgaagatggggaatctatattggaaagctgccactgataaaatagtctgggagccacattcacaagagttttcctgttttcttgggatgtgggaggagataacaaaccaatagcaggacacagagttgctgcttggctccagaagacaatatgtttgtttttctatacttgttctagcatacaaagagagcattagaccctcacttctccccactggccagggtctaagagtttctcttgctatgtgctcatcatcactaatcatcagagagatatccatcaaaaccacagtgagatatcatctcacaccagtcagaatggctattattaaaaaattataaaacaacagatactgttgagactgcagagaaaagggaacacttatatgctattgatgggaatgtaaattagttcagtgcctgtggatagcagtttggagatgccccaaagaacataaaacgaagctatcattttacccagcattcccattgttggatatatatgcaaaggaaaatagattgttgtaccaaaaggatacatggcttcttattattattgccatggtattcacaatagcaaatatgtggaataaaactctgtgcccattgatggtggattggataaagaaaatgtggtacatatataccatggaatactatgttgccacagaaaagaatgaaataatttctttgcagcaacatgaatggatctggaggccattatactaagtgaattaatgcagaaatgttaaaccaaatatcacatgttcttacttataagtgggagccaaacacagaacctacgtaaacatggcaacaactatggattaccaaagggagcaggaactggggggtgcattaaatagtacctatcgagtactatgctcaccacctgggtgtaatatacacatgtaacaaacctgcacatgtacctcttgtacctaaaatataaactaaaatatttaaaaatagactcaaaattagcaccattttcagaagcgtttattttaagataaattgcttttaaatgaaatcttgttttgcaatactctgaggttcacaagacatatctagaaaatgtactattgcggaaggtgaagacggtgtaaaaccagtgggggagaggtcagtggtttttcttattggttgattatcagaacactgtcctttggggatatgaaagagttttatatattctttagacataattagacaaacaatggtccatagggcaggtttgatgctgtacaaagtctgtcattttgctagcactgatatggttcttgggtccaccacagcattagatctgttgatgcatttatattatgctttgttacaaatcttgaaaagaggggtgcttcttacagactttgcttcagatattagattttgttttagtaaattttccaagactgtagtggctgccagcttgtgttactttcacttttcctctggtttttgtatttaccgagaaatggtcatggtttctgtcaagtgcaatgtacccttggagaaaggaatttcaatattagcatctattccctcattctatttcctaggtagttgttggtgggaatgggaaaggttagcctcagccatctttggtgaataccgattacatggctcttgagtggaaaaaagcctgcttcattgttggcctcttcaaggacatgaaacacgttgtggaacagaagagaacagtagttgtctgtccttgtttatctatagactcaattgagtttcttgcatagatagctccctgatagatttggtttgctggttatgtcaggatgaacaaaacctataacttttagagattgattcctaggtatcagctttatacaagaaaggcaataagagggacaggacaaatgaacaggcacattgggttttattgacagtctaggtactaaaggcaggttcatctcaattgcaccaacccaagcaagagctgttttggcacagatgcatcattggtgcaaaatggaatgacaaagtccaagctcctccagttcctggccttgttaaaaaatattgcttaggctatgggctgcaaccatgtttgttttgttcagctagattttaggccatttcatcttggaagacttattttgagttataagaaatttctttaaaagttgtatataacagagtagtataggaatatgtggcctgacattaagaagagctatacagtgtgaaattctccctgaattgcaagaatctcactcagatttctataatagaatctgttatgtctgattttttagttcaggaaagtggctattagaaataagtggtcttactgacccaagagttgccatttgatggaaactcatacacacatatatacccctctgcctttctcacacatacattgactttgacttttaatatagcttaaaagctttattaaaagtttttatttttaattgattcataatatttgtacatatttatgtggtccatgtgatattttgttaggtgcatagaatatacaataatcaaggcagggtgtttagaatatctattaccaagagcacttatcatttctgtattgagaatatttcaagtcctcacttctagctattttgaaagtacaatgtgttgttgttaactttagtcattctactctgctattgaaaattagaacttattccttctgtttctacccactaaccaacctccttttattcccccaaccacatccatttccttcccagtctctgataaccatcattctagtctctgtctccctgagatcaactctttttttttagcttccacctatgagtgaattcatgcaatatttatcttcttgtgcctggcttatttcatttaacataatgacttccagttccatccatgttgctgcaaaggacacgatttcatttatttttatacctgaatagtattccattgtgtaactatacaacattttctttatccattcaccagtagatagacactttgttgatttaatatctttactattgagaatagtgctacaataaacatgaggaggcaggtatgccttcaaaacacttctttcctttggataaatactcagtagttggattgctggattgtatggtagttctattactagatttttgagaaatttccctactgttttccagagtggctgtactaatttacattcctaccaacaatgtttgagagttccattttctatgaatcctcatcacatctattattttctatatttttaataatagcgattctaactgggataggatgatatctcattgtggttttgattcgcatttccttgatgattagtgatgttgagcatgttttaaatacctattggctatttgtcttcttttgagaaatgtcaatttagatcttctgcccatttttaaatgggattgtttgactttttttttttgctgttgagttgtttgagttccttgtatattctgaatttaactaaagtgtcatattttcacttttagcagttcacataacacaggtctgtagttggaatacatctttgatcactttcatgagtcctcaagatggcagtgtcttctcagggaccttggggcaagctctcatgtgctcctgcggtggggaggggaggggatgcatgtgcacttgcaagtgcacacacacacatgaataagagcaagacagagggagagatgagggaggagcttaatgatggagcagaggtgttaaaaagaacatcctttttctaattggtaggacagatttcttttatgattcctacagcagaaaaatgagaaacgtttgttattatttttttttcgtgtttaaggtttgaatcctcagtgaaccagggcagaaaagaatgatgaaatccttgagagttttactggtgatcctgtggcttcagttaagctgtgagttttgggcatctctgtagaaacataatgtatattgtttgcaattattgtgtattctaggcctgtgggtagaaacatgagtggttttttctctaacaaagggagactggggagagtggggggcccatgaaaagatgatttaaattctgggtacgaagtgtcccctacccaatctgtcttctctgtctgactgctgtcttttttcacaggggtttggagccaacagaaggaggtggagcaggatcctggaccactcagtgttccagagggagccattgtttctctcaactgcacttacagcaacagtgcttttcaatacttcatgtggtacagacagtattccagaaaaggccctgagttgctgatgtacacatactccagtggtaacaaagaagatggaaggtttacagcacaggtcgataaatccagcaagtatatctccttgttcatcagagactcacagcccagtgattcagccacctacctctgtgcaatgagcgcacagtgctccccagacacttgcagtctgtacccaaacctgctgggccccaggaatgcctgatgtagagcttagactgcaaggcaatgaagttctatttgttctctagatgcaaatgaaaactaaaagcagtagtattgaaggtttgattaatttgggacatattttcataattctgaaaattattgagaccccaaaggaaaataaaagacaccatttggtctacttgaaatattttctagtcttctctttccactttagttttgaaattttttttttgctgactttgtggctcatgtctgtaatctcaacacttctggaggcatagggaagaggatcacttaaacccaagaatttgagactagcctgggcaacacagggagaccttgtctcaaaaaaagaaaaaaaatcgccaagagtggtgacatgcacctgtagtcccagcaacttgggagggaagaggtgggaggatttcttgagtcggagaggtggaggctgcaatgagctgtgatcacaggactgcactccagcctggacaatggagtgataccctgtctcaaaaaacaaacaaaaacaaaacacaaaacaacaacaaaacacaaataaaatatttttattgaggtgttattgacacacaaaaaggtgcacatattcactttatacagacaatataatcgtgccataaacatatgtaccatttctaaaaatttgcttcctccctggtttctttttattaagttattattgctatacaaaaaggtacatttatttaatccatgcccagtctacttttatgccacatctttactttatgagattggttttatgattctttttatcaaagacaagaaaatatttccatacaataacagatatgctctcatggttcctaagacattttgctctttccccaaggcatttgatagacattgctttaagaatgaaacagcaaagcagaaatgcaaagagaagaaaaatcataagcagactaatttgaaaatccggtaagtcataaattttttaagttacagaaccctaactccatctccagcctcaactacaacatcactcctgagttatataagggtacacctgatggacagctggaagaactagagtgagagagtgagaactggttgagaaaaagcctaattagttgcacaaactaaagattagagagggtctatgttgccattttggggtaaagttttaatcaaattcaaaactcccagcttgagcctgatgggatagttttttgattcctatgtacttgagtgtggcctggagatgggaaggagcattggctgtagttatagagtgcctcatctccccagcagggcatgacagcacagaaggacttaaaatttttttgagaagggtctctaagtatcttaaagagatccagacaccaaggtcctttgttatgatgagtaaagacctgtatgaataagataccaaagaccgtatggaattgagaatgcttcaggaaatgtttgtctggagagttggaaacactaaacatcatatgaatatctccatcccctgactacaaggcaccacagatttgccctgcagtgtatgtcaagtatggggaaagcatttgtggcctgacgaaataaggccttttagtagacattactttgaattacaggcaaaatatttgagaatcatatttactgtaaaaatgaagttgtggtctgataggcataacattatttatgtagcccagaaggtgggaaaagcttggaaatgaagaataaatgtttctgtccagttttattgacagtcactgatgaaaatgatgaagccaagtcagaatttgctgcaacttcttactctgcagaagtgaagactctgaacaaatatttcccagtcatagaagaaagatttaaaaagcaaggaggaagagcaaacagttgtgctggaatcaaggtacttaaatttttattccacttttatgatttgccttctggcatcatggcactctggaaagaactcaggctgtggtgctggtttgaacatcgattatattacttatggcctttttcatattaagctctacaattatatatatttcaggactggtttcaggattccgtgagacaaaatattgtcttgggatgagttccttaaaagcagagactgcatttggaattctctgtctgtaatttatttgggaaaccaggttgagatgggggaaaggctggacatgagggggaaaggttgagatgctggacatggtccagcagaggtcttgatccagcctgacctcatggggagctctggagcttgaactgtatcacagggttgattcctcccaccctgaggcaaggaggccagactgctcggacctattgtgggtaagaataaagtcatcattggttgtggtgtttcttggggtagaggtatatgctactggacaatggtgactctcattggctaaggtcaattttctagggaaagaggcaactgtgagccaagagtagccaacattcacagtagctggggatggctacactgtcctaggaaaggggatctagcttggggaccagcagtgctcattattaacatggaacttgcctggtatgtgggtagcatttgagaaataatagactttgagcagaataaatgatatcagagattgaagatcaacttactgaaataaggtgtgaagacaagattagagaaaaaagaatgaaaaggaacgaacaatgtctccaagatatatgggactctgtgaaaagaccaaacctacgtttgattggtgtacctgaaagtgacaggaagaacagaaccaagttggaaaacacacttcaggatattattcaggagaacgtccccaacttagcaagacaggccaatattcaaatttaggaaatacagagaacaccattaagacactcctcaagaagagcaaccccaagacacataatcgtcaggttctccaagattgaaatgaaggaaaaaatgttaagggcagtgaaacagaaaggtcaggttacctacaaagggaagcccatcagactaacagcggatctctctgcagataccctacaagccagaagatagtgagggccaatattcgacattcataaagaaaagaatttttgacacagaatttcacatccagccaaactacgcttcataagtgagggagaaataaaatcctttacacagaagtaaatgctgagggattttgtctccaccaggcctgccttgcaagagcttctggaggaagcactaaatacggaaaggaaaaactggtaccaaccactgcaaaaacacaccaaaatataaagaccaatgacactatgaagaaactgcatcaactaatgtgcaaaataaccacctagcatcatgatgacaggatcaaattcacacataacaatattaaccttaagtgtaaatgggctaaatgccccaagtaagagtcacagactggcaaattggatagagtcaagacccatcggtgtgctgtattcagcagacccatctcatgtgcaaagacacacataggctcaaaataaagggatgaaggaatatttaccaaacaaatggaaatattttttaaaaagcaggggttgcaatcctagtttctgataaaacagactttaaaccaacaaagatcaaaaaagacaaagaagggcattacataatggtaaagggatcaatgcaacaagaagagcgaagtatcctaaatatatatgcaaccaatacaggagtacccagattcataaagcaagttcttagagacctacaaagagacttagactcccacacaataatagtggcagactttaacaccccactgtcaatattagacagaccaagaagacagaaaattaacaagtatattagggacttgaactcagctctagaccaagtggacctaatagacatttacagaactctccaccccacatcaacattcttctcagcaccacatagcatgtattctaaaatcaaccacataatgggaagtaaaccactcctcagcaagtgcaaaagaacagaaatcataacaaacagtctttcaggccacagtgcaatcaaattagaactcaggattaagaaactcactcaaaaccacacaactacatggaaattgaacaacctgctcctgaatgactactgggtaaataacaaaattaaggcaaaaataaataagttctttgaaactaatgagaacaaggagacaatataccagaatctctgggacacagctaaaacagtggtgagagggaaatttatagcagtaaatgcccacatcaggaagtgggaaagatctaaaatcgacactctaacatcgcaattaagataactagagaagcaagagcaaacaaattcaaaagctagcagaagacaagaaataactaagatcagagcagaaatgaagtagatagggacccaaaaaacccttcaaaaaatcaatgaatccaggagctgtttttttttgtaaagatcaacaaaataggtggatgactagccagactaataaagaagaaaagagagaagaatcaaatagacataacatgaaatgataaaggggatatcaccactgatcccacagaaatacaaactaccatcagagaatactatgaacacttctacacacaaaacaataggaaatctagaagaaatggataaatgtgtggacacatataccctccgaagactaaaccaggaagaagtagaccaataacacattctgaaattgaggcagtaattaatagcctactaaccaaaaaaagcctatgaccacatggattcacagccaaattctaccagaggtacaaagaagagctggtaccattccttctgaaagtattccaaacaatagaaaaagagggaatactcccaaactcattttatgaggccagcatcattctgatatcaaaacctgacagagacacaacaaaaaaagaaattttcaggccaatatccctgatgaacatccatgcaaacatcttcaataaaatattggcaaactgaatccaacggcccatcaaaaagcttatccactacgatcaagttggctttatccctgggatgcaaggctggttcaacatacacaaatcaataaacgtaatccatcacataaacagaaccaatgacaaaaaccacatgattatctcaatagatgcagaaaagacctttgataaaattcaacatcccttcatgctaaaaactctcaataagctaggtattaatggaacatatctcaaaataataagagctatttatagcaaacccatagccaatatcatactgaatgggtgaaacctggaagcattccctttgaaaaccggcacaagacaaggatggcctctcttaccactcctattcaatatagtattggaagttctggccagagcaatcaggaaagagaaagaaatagagagtattcaaataggaagagaggaagtcaaattgtctctatttgcagatgacatgattgtatatttagaaaaccccatagtctcagtcccaaaactccttgagctgataagcaacttcagcaaagtctcaggatacaaaatcaatgtgcaaaaatcacaagcattcctgtatactaacaatagacaagcagagagccaaagcatgagtgaactcccattcacaattgctacaaagggaataaaatatctaggaatacaacttacaagggatgtgaaggatctcttcaaggagaactacaaaccactgctcaaggaaataagagagggcacacacacacaaaaagaaaaaaactccatgttcatggataggaagaatcaatatcattaaaatggccatagtgtccaaagtaatttatagattcaatgctattccatgaagttaccagtgactttctttactgaattagaaaaaactactttaaatttcatacagaaccaaaaaagagcccgtatagtcaagacaatcctaagcaaaatgaatgaagctggaggcatcatgctacttgacttcaaactatgctacaagtctacagtaaccaaaacagcacggtactggtaccaaaacagatatatagaccaatagaacagaacagagacctcagaaagaacaccacacatctacaaccatctggtttttgacaaagctgacaaaaacaagcaatatgaaaaggggaaagaattacctatttaataaatcgtgttgggaaaactagctagccatatgcagaaaacagaaaccggatcccttccttataccttatacaaaaattaactcaagatggattaaagactaaaatgtaaaaccccaaaccataaaacctctagcagaatacttaggcaataccattcaggacataggcattggcaaagtcttcatgactaaaacactaaaagcaattgcaacaaaagccaaaatagacaaatgggatctaataaaactaaaaagcttctgcacagcaaaagaaactatcatcagaatcaacaggcaacctacagaatgggagaaaatttctgcaatctatccatctgtcaaaggtttaatatccagaatctacaaggaacttaaacaaatttacaagaaaaaaaaccaaacaaccccatcaaaaagtgggagaaagatatggacacttctcaaaagaagacatgtatgtgaccaaaaaacatatgaaaaaaagctcgtcatcactggtcattagagaaaggcaaatcaaaaccacagcgagataccatctcatgccagttagaatggcgattattaaaaagccaggaaacaacagacgccggtgaggatgtagagaaataggaacacttttacactgttggtgggagtgtaaattagttcaaccattgtggaagacagtgtggtgattcctcaaggatctagaaccagaaataccatttgatccagcgaacccattactggatatatactcaaaggattataaatcattctactataaagacacatgcacacgtatgtttattgaagcactatttataatagcaatagcctaccgtagtaaatagcaatagcctaccctagtaaagtttaatattttgaatgaaatatattatgttgtcttacatatgaaaagaaaatctacaggcagaatcaaggaataggtcagaagtgcaagggagaactgatttcccactggcatgagtcaacagagtacacagaaaggaaggagtttgttttgacctttgaaaagaattcttgttagccggttcttatttcacctgagtttttttctttatttgattttttcaattttaggatccaatgatctctatgctaaaataagttgggtgaggaagtcttttcattcaagaatttcatcttcttaggccatagagttgactgctctggttcaatgcatcctgtctcccacccacaggggactgcttcttgcctagctctgttgagtatcactgtcaacctatcctaagtcttctatacctcccattttcttggtcatctcatttcttgtctgctggttgcactcctcccagctttactgagttcacgtaggcttacttttctttctgtatctttaattcttcccataattacttatttatatgttatattttattaccttcattattctgctcaaatttctccataaatgggcttctgttgatgttctttttaaggcgagataccataatttggcataatgtatcagtctattctgagcgttgataattcaaatgggacttttctctaagttttttctcctagccttacaaacatcaaacttgatttgaaaccaagaagtctttttcacaatttctgcttcacaaagaaaattattacctattagtttgcattgactaattagctaatgacacgtgatccaggctgattttaagtatgagtctctagtcatttttttttcctttagcacctaataaaagagaaatctcttccatccactctaatgctcatgtgaatccactagcacagtgccacacgaagcttagctaagcctgaggcaattgatcttctcccctctccttgatgagtgcctctaaaaaataacatagagcatcttaatggtattccaaaatctggaatattgccttctgtgactaatttctcagtgaagtaaattacttttctagttttacataactccaatttcttgtctattttttgaggggaaaaacatttttattttctaatttttaaattttatttctttcaactgttattttagaatcaggagtacatgtgcaggtttgtaacagaggcatattgcatgatgctgaagtttggactatgaatgcattgtcgctcaggttgtgagcatagttcctaatagttttcagtccttttctccttccctctcttcccactctagtagtacccagtgtctattgtgactatctttatgttcatgtgtagctagtgtttagcccccacctataagtgagaacatgcagtatttagttttctgcttctgcattaattcctttcagataatggcctctagctgcatacttgttgctgcaaaggacaggatttcatttttctatggttgcatagaagtccatggtgtatatgtgccacattttcttcatccaatccaccaccgattggcacctgagttgattccatttctttgctattgtgaataatgctgtgatgaatgtatgggtgaatgtgtctttttggtagaaaattttatttgcctttgggtatatacccagtaatgggattgctgggttgaatgttagctctgttttaagttctttgagaaatctcaaaactaatctccacagtagctggactaatttatatttccaccaacagtatgtaagtgttcccttttctacacagcctagccaacatctattattctttgactttttaaaaaaagccattctgattggtgtgagatggtatctcattgtggttttgatttacatttctctgatgttaagtgatgatgagcattttttcatgtttgttggctgtatgtatgtcttcttttaagaagtctctgttcatgtcctttgcctacattttaatgcggttgctttttgcttgtcgatttgttgaagttacttttgtttctttctttttttggaaagacagggtctcactctgttgcccagactggagtgcagtagcatgatcctagctcactctatccttaactccagggctcaagggatcctcctgctttagctgggactacaggcacatgccactatggccagctgatgtttttcttttccttccttccttcctcccttccttccttccttccttcttccctccctccctcccttccttcctctctttctctcctcctctttctctttccttccttccttctttccttccttccttccttccttccttccttccttccttccttccttccttccttccttccttccttccttcctttcttccttctttccttctttccttctttctctcactttttttttttgagtcagattcttgctatgctgcccgggctggtcttgaacccctggcttcaagcaatcttccagcttcagccacacaaagtgtggggattacaggtatgagccgtcgcacccagcctgttacttatagattctggatataagacttttgtcagatacatagtttgcaaataatttcacccattctgtaggttgtctgtttactatattgatagtttattttcctgtgcacaaactacgtaggtcacacttttcaagttttgttttggttgcaattgctttccaggacttaaccataaattctttgccaatgccgatggcaaaagggtatttttctgtttttttccccctaagatttttatagttttgggtattacaattaagtctttaatccatctggaattaatttttgtgtatagtgatgggttggggtccagcttcattcacatacactggtatgtggctagccagttatccccagcaccatttattgactagagagtttttcccaatttcttatttttgttgactttgtcaaagatcagatggttgtaggtgtgttactttatttcagaatttgctattctgttccattggtttatgtgcccatttttataccagtactatgctgttttggttactgtagacttgtagtgtagcttgaagttgggtagtgtgatgcctccggctttgtgcttgttgcttagattgctttcactatttaggctcttttggttccatatgaattttagaatagttttttcctaattctgtgaaaaatggcattagtagtttgataggaatagcgttgaatctgtaaattgctttgagtagtatggacattttaaagatatggattctcctaatccagggtatgcaatgtttttccttttttgtgtgccatctctgatttctctcagcagtgttttgtagttctctttgtagagatctttcacatccttggttagctgtattcctaggtatctattctttttgtgtctattgcaaatgcaattttgttctttagtctttaggaccctgctcaaggtcctgcagcattgccactgctgagccatgctcctgctgctcggcccagcactccagtgtcccagctgtcagcttgaacagacagctcgaacattattggtgtatagcaatgctactgatttttgcaaatttgttttgcatcctgaaacttcactgaaatcttttatcaagtctaggagcctttcggcagaaccttgagggtttttctagatatcaaatcatactgtcagcaaagacggataatttgactgcttctttccctgtttgggtacactttatttttttctctttcttgagtgctctggctaggacttccaatactatactgaataggagtactgagagtatacattattttcttgttccagttctcaaggggaatggttccagctttttcccattgagtatgatgttggctgtttgtcataggtggctcttattattttgtggtatattccttccatgcttagtttgttgagggtttttatcataaagtgatgttggactttattgaaagctgactgcatctattgacatgatcatatggttttgcttttaattctgtttctgtggtgaatcacatttattgattcatctatgttgaacaaaccttgcaccccaggaatgaagcctacttgaccttgaattaactttttgatgtactgctggattcagtttgctagtatttttgttgaggatttttacgtttaagtttgtcagggatattgactgatattttcttttttcattgtgtctctgctggattttactatcagaatgatgcagactacattgaatgagttaggaaggaacccttctcctcaatgttttgggaatagcttcagtaggattggtaccagttcttctttgtacaactggctgaattctgttgtgaatccatccagtccaggggttatttttggttggcaggttttaaaaaattattattactaactcatttccagaactcattattagtctgttcaggttttcaatttcttcttggttgaatatatagaggttattttcttccaggaatttattcgttttctccaggttttctaatttttatgaatagtggtgttcctagtattctcttagggtcttttgtatttctatgggatcaattgtaacgtctcctttgtcatttctgattgtgcttatttggaacttctctcttattttcttcattaacctacttagtggtgtatcaatcttgtttattcttcctgaaagacaacttttggttttattgatcctctgtatggattttcaagtctcaattttgttcagttcttttctgattttgtttatttattttcttctgctagcttttggctttgtttgttcttctttttctagtccttctaattgtgatgctagaatgttcacttgagatctttctaatttcttgatataagtatttagcagtataaactttcctattaacacctttagctgcaaaccaaagactctggaattttgtctttctgttttcattaatttttgctctactttgttgtttacccaaaagtcattgaggagcaagttgtttaatttccgtgtaactgtgtggttttgagagatctccttggtaatgatttccatttttattacactgtggtccaagattatgcttggtatgatttcggtatttttgaatttattgcaatttgctttatggcttcaatttctcaataattttgagattaatatcatgtactatacagaaggtaacatcatcacagattcaggaggaaagaaacgctttctgttgaagttttgatatcatgtctgaaatgagaaggaaacagcttgctcccttggatccgtggttccgcctgttgcctctagagggcgatgttgcatcaagtaggcatctgttttcatcgcagaccatcctcatccattgagcctcctccctgtagctggctgatgtagctcgttgatatctgtgtggatagggagctgtgacgagagcaagaggtcagaacacatccaggctccttaagggaaagcctctttctgtttctgaaacttttcaaagccagggacttgtccaatccaacctcctcacagttcctagctcctgaggctcagcgcccttggcttctgtccgcccagctcaaggtcctgcagcattgccactgctcagccatgctcctgctgctcgtcccagcgttccaggtgatttttaccctgggtgagtaacattccattctttttccttccacagaagtgactgtgttgtaactgaatctaaattgagacacattttttactcaaacagcattgatgttgcaggaggaaccagagcccagtctgtgacccagcttgacagccaagtccctgtctttgaagaagcccctgtggagctgaggtgcaactactcatcgtctgtttcagtgtatctcttctggtatgtgcaataccccaaccaaggactccagcttctcctgaagtatttatcaggatccaccctggttaaaggcatcaacggttttgaggctgaatttaacaagagtcaaacttccttccacttgaggaaaccctcagtccatataagcgacacggctgagtacttctgtgctgtgagtgacacagtgcctgagactgcaggagagctgaacacaaacctcctgagatgctgagactttctgtgactcaagaactcaacctgtggagctttcaagagggtcccttttttctgtgcccgttttgaaggcacatagggcagggtgggctgagcccttggtagggtttgtctccggaataattgctccaatgtcaatgtcatgccacattcagatatgctttgtcccacatggaggtttcctgatgaatttcttcagtggggacctcctccacactctgaagaaagcacatcataaggtgtcagagctccgaaataaaaggcaacaacatttttatacaaaattatttctagcaaccattatgattagtattgcctcaggtgttaacttgtgaataaccgatgtaattgattagaatgttagctaaaagctgtgcaggatggattctcaattagggtaacccatacagcacagattctcaatcagtgtgctgtagattctcaacctagatttgaagcttaacttctagcacatacataatatcccactgtgtggtattgacatatttaaagtaaattagacataatatcaagatttttaatcttgtgagcattatgcaaaacaggaaattaaacataaatcttaatacaatattgaaaaactaagctgtcaagttgtgatcttttttaaaacagctattccagtgatttccaagttacaaacttgagggataaaaatgtaaccaatataaagatatcaaataccctagattcaactactttaaaaactactttaaaactccgaggcattttattttaagagattacacagatttattatataaaattacacaacaaaaaattccagttgcattatcagagagtatatgaattctaatgggcatatccaagaccagggtaccctattacttactctgaaataattatatcgaaaaaccaacatgtttaagatattttatgtacatgattattactccaaatttttatttgtagtttgatcacatggtagaattaaaaaatgcctctcaaagtattataaaatgttcacacatacagaagttgtcttccttaattcaacattttgtaatttttgatgacaaaaattatgaaaggaatcatctcacttcttaaaaatatttacaattgcctaaatctcctcttttaaaatgagatgaagttgtattcttcccttattataaaacatgtgtttaaagtagtttaaaaatattcctatgaattgagctaaaagagggtagagggtttataataaaaaatatttagacttggcttcttctcttgcaccaaagactcaggttcttgcttatggtttctttggctgctgacattctttagttacttcttagcgtgccacctcttccagttttactttcgtcctcatttcattttcgtttgtagtttttcttacagatttgtcttttcattgtgccttttatggcctgttattttgattatgttcaaattttacaggccaagaacacttaacatgatgtctattttaacaaatttttgaagtgtacaactcagttaactattggcccaatgttgaatagcagatctctagtaattcttcatcttatctgatagaaactttgtaccccttcatcaacacctccccacttcttcttcccccagccccaagaatggtaaccaccattctactctctacttctattagtttgacagttttaggtatctcatgcaggccttctatgactggcttatttcacttagcataatgtccttagggttcatccatgtttttgcatgtggcagaatctccttttttaaaagttgaagaatattccattttatgcatatatcacattttcttcattcatccatcagtagatatttaggttgttcccatatcttggctaatgtgaataatgcggcagtgaccatgggagagaaaatgtttcttcaatatcctgaatttaatttttttgataaataaccagtagtgggattgctgaatcatatggtacatttttaattccagggggaaactctttactgtttttcataattgctgcaccattttgcagcaagggttccaacttctccacattcttatcaacattgttgttgttgttttataatagccaacctaaaaggtgagaggtaataactcattgcgatatctaatttctctggtgattaatgatgttgagcagattttcatataacttcagccatttgtatgtcttctctggagaaatatctactcaaatcctttgccaatgttttaatcaagttattaaaacattgatagttataggagttccctatatattttgaagattagccccttatcagacatatagtttgcaaatatttctttcactctacatgttggctttttttcctattgattattttctttgatgggcagaatcttttaaattttataaagtcctgcttatctacgtttggttttgttgccattgcctgtggtgtcacatacaagaattggctgttgcttagaccacatgtcatggagagtttcccatatatttttccaatagttttacagttttgggttttacgtttttaattaatattgagttgatttatatgtattatgttagctagaagtccaatttcattctcttgcaagtggatattcagtttccacagcacaatttgttgaagaactactctttccccattatgtatccttgatgcccttgtcaaccatcagctgagtgcgtatgtgtgggtctatttttcagctctctattctgttccattggttcgtatgtttgtctttatgatagaactatgatgttttaattactgtagctttgtaatatattctgaaaccaagaagtggggtgcttttagcattgtttttctttctcaggattgtttgagctattctgggccttttgtgtttccagagaaattttagaattaaaattttagttttttctatttccataaaaatttcattgggattttgatagggatagcattgtagattgctttgggttgtataaacaccttaacaatattaaatcttccaattcatgaacatagactatctttcatttatttgtgccttctttaatttttcttatgaatgttttgttgttttctgtgtacaagcctttagactaattagttaagtttacttctaaacattttaatcttttgtagctataataaatggattgttttctggattttttttcagatagtttattgttaatgtgtagaaatggcactgatgggcctggtgtggtggcttatgcctgtaatcccagcactttgggaggccaaggcaggcgaatcaggagatcaggagttggagaccagcctggccaacatggtgaaaccctgtcactactaaaatgtaaaaaattagctgggcatggtggcaggaacctataatcccagctactcgggaggctgaggcaggagaatcacttaaactcgggaagcggaggttgcagtgagccgagattgcgccactgctctccagcccaggcgacagtgtgagactctgtctcaaaaaaaaaaaaaaaagaaacggcactaatttttatgtgttgatttttataccctacaactttactggattcatttattatttctaataggcttttttggtagcgtcttcagggtttttaatgaatttatgtcatctacgaacagaaataattttacttcttttctgatttgagtacttttaatttctttttcctgtctatttactctggctaggatttctagtattatcctgaatggaagtggtgagggtggttacccttatcttgttctgatcttagaggaaaagcttttttgtgtttcacacaccactgagtgtgatgttagctgtgggctttttatatatggcctttattatgttgggggtaatttcccaatttgttgaatatttttatcataaaatgtgaagcaggttcactgtgtactggttaccaagttgtctgagtccagtgagacagaatacacatgcatacaacaaggtacatgaaacaggtttattaattacagataagcaagggacaacagaagcttaggtttcattgcaaacaggtcccccagggctcaggaaagctgtctagggtggatagggtgtcatctgcatgtggcccagttgtaccacacctgagggaccccagaaattagcatgccctaggttttagacccctgggtaatatgataccctgggccaaaaagtactgaaggacactgtttctagggggtatctgaaatacagccagcctgttccagccatttcattcctgtctgaagatgttacattcccagtacattctatagttattcttatttatttatttatttatttttgagacagagtctcgctctgtcgtccaggctggagtgcagtggcgcgatctcggctcactgcaagctccgcctcccgggttcacaccattctcctgcctcagcctccccagtagctgggactacaggcgcccgccaccacacccggctaattttttttgtattttctagtggagacgggacttcaccgtgttagccaggatggtctggatctcctgacctcgtgatccacccgcctcggcctcccaaagtgctggaattacaggcatgagccaccgcgcccagcccattctacagttattcttgagaaccacaaacaagaaagtggagagaactgggttggtccaagaccacccagagaaccatcctgcatgaaaggatgttgaatgttgtcagattctttttctgcatctattgagatgatcatgtaatttttatccctcattgtgttatgtagtgtgtcacattcattcatttttatatgttaaaacatccttgcatcccagggataacttccacttggttattgtatgtgatcctattagtgagctattgaatttggtttgctagtatttcactgaggatttttgcatctatgttcatcgggaatattggtctgtataccttcttgtagtgtctttgtctggctttgatatcagggtaataatggcttcataaaataagtttagaggtattcccctttgaattttttggaagaatttaagaaggattagagttaattcttctttaaatggttgatagaactctctaatgaagctgtcaggtcttttgtcttctttgttaggaggttttggattactgaatcaatttccttaccagttataaatctgtttagatttttttatttcttcatgattcagtcttggtaggttatatgtttgtataaatttatgcatttcttctaggttttccaatttgttggtgtataattgtttgtaatagtctcttaagattcttcttatttctgtggcatccattgtaatgtcttctcttacatttttggtttatttgaatcttctctcttctttttcagtctaattaaaagattgtcaatttagcttatgttttcaaaacttagttttgcttatttttatgttattttctactctatgttttatttatttctgctctaatatttattatttccttctttctactaaatttggacttcacttgttctttttttctagttctttgagatgtaaagttatgttttttgtttgagatctttcttttgaattcaggtatttattgctataaacttccctattagtactgcttttgctccctctataaattttgatatgttgtgtttttgtgtttgtatctcaaaacattttctaatgtgccttttgatttctttgaccaatttgttgctcaagaatatgatgtttaatttccatatattttggaattttctagttttgcatctgctatttatttctagtgttattccattctcattagaaaaaatacgtggtatgatttcactttcttaaatttgttgagacttgttttgcggctgggcatggtggctcccacctgtaatctcagcactttaggaggctgaggtgggaatgcttgaggccaagagtttgagaccagtctgggtaacagtgagactccttctacacaaaaaatagaaatattgacctagtggggtagtgtgcagatacctgtagtctcagctactcaggaggctgagatgggatgatcacttgagtccaggagtttgaggctgcagtgagtcatgatgctgtcattgcactccagcttggacaacacagtgacatcctgcctcaaaaaatgaaacaacgaaaactgccctctttgttttcagtgaccctatgcatcaggaatacactgggtcctatcagtgctccttgacaggtgtgatggaagccagtctctcaggcagcctgtggcaaagctagaatgttggatgtaatgtccaagtctttccctccccagggagaggctgaaactggggctttcctcttatttatgggacacagtactgggggtaggaaaatgtcagaaaccctcctgtcatctttgatgtggttggttgcttgctcattcaaggtactggagactctgaactagttactggatttttcacaagtgaattgatttatttattgctattgaattggtgtgtccattggggaaaagagggtccagggatttcttttctgccatctttctgatgttacacctttcacggacagaattcttcctgttctcatgggcttctttatttgcccttcaccagaactgacctcctcttgggcatctagttgaatgtggttttcactgtgggcatggtggtcctgcctgagtgccagcaggccaccctgcaatgagagctccatcatacactttaaactttccttgatatttcttttagctgtgcctcttaagcagtagaaggctggatatgaaaaccattcagataatttctatatcttaatagaaaaatttagccttttaaacttatatatgcatgcatttatggctacaactaatatttttgacttatcttacatggcatagtgacatttgacattgtagaacacttccttcctggaatgctttctttattggtttttagaaatcccactcttttttccctctgcttcagtattgtcagttgttccttctcagtcttttttgctgttttttccccacatttaactaatctttaaacattggcaagcctcagaaatttatccttgaaaatctttttcctctataaatactttattcacagctggttttattcagtctcttggctttaaatcccatttaaatatccaaacttataactgaatcccagataactcatctggattctggattcgagtatcaaataatctatttgacatcttctttttgacatcctccacttaatatatctgaaaatagtctgctgaatttgacctctatactcactaagccttccttacatcccactcgcttcttgtgaacatttcttcattttggtaaaagacaactccatttaccaaatcttctaatccccttagccaaaaactttgaaatcatcattgtcttatcacttttctcacatccccacttgatccactaggaattcctatcagccatttcttcaaaatatccccataatcaatcagttctcatgacctttactgctaccactctgatccaagccacagtaatctcttgcctagttgattgaaagaaacctaactgaacttctttcttttgccattgttcctcttctgtctgttctccatgcagcaggagaagcaatctctttaaaacataattcagataatttcatttctgtgctcacaactatgaaatgtcttaccatctcactcaaaggaaaaccaaatgctttactataatatacaagtccatttagctccctgccatatctttgacatttgacatcagctaccaccttcctacttactcccactctccagcctcaatgcacttattgttgctctaacataccaattattttcctgcctcaaggtctttgcagctgctcatttctctgccttgtgtactagtactccaggtaaccacatggcttatttctacactttattccaccaaatagccatgcacaaaatatttactgcagattatttttgtaatagtgaaaattaaaacacaagatgtttctcagagaatggctacagaaactgtaataaatctttactatggaatattaggaagcaaacatgttaacatcaataggttatcaggacatataattgggtaccaaacacattgcaaactgctgtgtgcttgaaagttatagtcagacaaaaatttaaactgtatatatattgagtatgtattcatccatgtgttctgcaataattttaaattaataataaaaaataggctccaatttctttctacatctttgtagaaaaaggctccaactccaatttctttctacatctttgtccatttgctcttctttcattttcatttagtaagggcctctattcaactcacaagcttatttagcttcttgattgcattctgttttatcttttctaggaacagacaacaatgatcatattcttaaatctttgtctaaccatcctttgttttaagaaatggctccttatttctgggttcattttgtactttttgaggtgttacttgatatatatgaaaacacacacatgtgcatgtttgtctttcccactaaactgcaatgtcttgtgagtagagaaaatgtcttactaattttttaatttcgtaagacctagcacaagatctagcttacagtagacctcaataaattactaaagacttactttgaaataaattggagaaatcacattaaaccttgaggaagcaatttgataaaatattttaatatggtaatctcttgtacatggaatttggaggaagaaaccagtttcctttttttaaaaaaaaaaaatcaccataagcctgacagtttttttgctcttgacaatctgggtggttcctcaggaaagaattgggatgaaggctctgggactccacagatgagttagtgggcctgatggtttcagaccactaggaggctctctaggctttactctaaatgaggaaattttccctcaagttctgagatagctgactcagcgaaaaactgagagttagcatcagttagcaaagcatctgaactagtcatatatgaaacggacagggggagtctccatttattcatctgcaaagatgttctgtggctgtgatgggtgtcacagagacggtctcccaagaagactgatcttagaaatcaacaagggaaatgataaagctggaagccttacagctttaatttttatgactaaaacttctaaaatatgagtctccattctgactttgaaattatttcaataatttccaccttcttttatacctcctttgaaactagaaaaacaagaaaaaggaaatgagaagaaatgagaaaaaaataatgaaaatattcagagagaggataaaagagagtaaaagaaataagaggttgggggaaaaaaagatgacacatttaactgaatttcaaaatgtggtctatgcctcatatagtttctgtgttgcaaggttaaaaagttctagagatctgatgcacgacaatgtgaagatacttaccactactgaattgtacatgttaaaatagtcaagatggtaaatttaatgttatgtgtttttttaccacaataaaaaatgtgacctctacctcttgttcacagagcagaattgaccaggtggggctgcaaagtgaatggagaagtgttggatagaagaagagagatggaaataagctggggtggccatcatatacacgtgctatttctctatcaaccaaagtctcactggagacattttatatgttcatgatgactatatgtcctatgttaacagaattctcttaatttaattgtattgtatttactcctttaagggtgattaaataaacgatgcattcgatgagatattctttctttgtgagagctttcttataaataaaatcacaatcacttttcaaatcacatgtcctgattttttggctaaggaaattgggccactgaccctgataattttttcaggctgtacttgatccagatgaggctcccatttgtctctgagatatcttttccctttcttcactcccctcctgacttgtccgattactgggtactttaagtggaggcaatcctgagagcataaaaacctagacatttctgtgtctctagtcagcagtgcggcactcagcagggtactgacgtcagcaattacgcccgtacactgcaggaaaactagaggaaaatctctttgctccctgatctcattgtattccacctcatttaagtaacagcatatctcttacttttttctcagctatttggaggccagaggagagactttctcaagagaattagttttcttttttagaaaaaaatatatctgccggagacgctatctccatgacccatagttttctgctcttaatcccggagcttctgtctacttgaccccagatttatatctgaccccaaaatgggacacctcacttgagctctctcaacacagcttgactgggagctggagaaaatctttggttaaggaccagggattggggactctttcaatctaccatttttctagaatttccgtctttctgagccaaatgattgttcctttttttatggccttcttttcttttcttttttcttttttttttttaaagtgtatagaactaaaatcccaaagggccatttcctgtgtggggaaggtcagaatcaatgatggtggacggaaaataaaataacttgatctggcaatgtttaaacatttcactaaaatatctgtgtagaaatttaaatttctatgaagtgtaatcgatcaatattttttcttatgttttttgactgttatgcttagaaaatccatcaccattctaaatttattttaaaaattttttattttacttaaaatattaaatgttacgtcctttgaactttatttgataacaggtattaaggtaggcatcctaacttatctgttaacttccaaatgattgttaggattgcacattttcccccattttaactaagtttccaaatgtatttgtatatttgaactttgtattctacttcattaagccctatatgtggattttaaaaataacattctattgcaattagtatagcatcacacttttactgaggaggaaattctcattctctgaatttgaaggcttcctgaagcctgagttagctgcagtattgtatttggcctctagagagagatgttacacaaattgaatttgatagccaaaaacaacctgatctttttgaagaatagcttttggctatacatgccgggtaaactcatccacctctctgtcagagtgtctatgtggctgaatcgtttccagaaaagacctccagaaaatagcttcctgtttctccacaggtcagacatgaagcccaccctcatctcagtgcttgtgataatatttatactcagtaagtaaagcctctttttgttctatttttctatggtattctgatttagaataactttaatgaatattatccccagtctgtaagacttttcctgatccagaattggtgttataggaggaacaagagcccagagagtgactcagcccgagaagctcctctctgtctttaaaggggccccagtggagctgaagtgcaactattcctattctgggagtcctgaactcttctggtatgtccagtactccagacaacgcctccagttactcttgagacacatctctagagagagcatcaaaggcttcactgctgaccttaacaaaggcgagacatctttccacctgaagaaaccatttgctcaagaggaagactcagccatgtattactgtgctctaagtggcacagtagctggttttgcaaggaagcagaacacaaaccctttaaatacaggaaatatttctttgcaaactctctgtatggccacagcagggcattctttctccagaaattaatattgagtttatctcgtagatattatatcatcagtcatcagttagctatagattaacctcataattttgtccaaaaaattctcattatttaccctgcttaaattaaatttaaaaatagtaaatgtatttattttgtctagtagtactggaaacatactttcgaaataaaaactatattgcactgcataaaaagtattcttttctttgttcagaggtactgtccaggcttccatggtgcagtcctacctcttcaactcctctgctgccccacgtgatccccacatgtggttgtcaccacatacctgagcatagttcctcaaagtgctctgctgtttcatggcttatgattgttcatctttctatatctattacccttctttccatgagtttcatagactcctcctatctcaattggtgtccagccaggaaaaaagaagcccagtgaagtttaatataaagatttattaaataataataagtaattaactactaatgggtaaaaaaacctctaaggaatataggaatgcacatgtaagcagaagttcctgtctctaggactaaggtagaatcccaggaaaggaacagattggcataagcatgacccctcctgccaaggctatgattcagatctcattgagagtgtgtagctggagcttgctgcatagtggagtagtttgctgaggtgccagagaaaaatactgacaagcagaaaaatacctaccaggattacaacacaattcatgggaagcccgcaaacgagtgctgctgaacttgcttgtggtggctgtgaaacttgccaagaaaccacctgtcgggcttgctggaggggagtgccactggtgtcctacaggccaacgaagcatagtggacaagaagtgtggaaaacataccagaaccaggaagagaagcgtcatccttctgcggggtccttccagccccctctactgacaaagcttaatatcaaatatttagagggtccagatccagttcacaaatagggtaattagggtggatttggagctgagaggtaatacattgataactgtcacaccctatcccttgggctactgatctttcatatgcattcctttttttctttcttctttctttttttgagacggagtctcattctgtcacccaggctggagtgcagtggcgcaatctccgctcactgcaatctctacctcccaggttcaagtgatttttctgcctcagcctctcgagtagctaggactacaggtgcctgccaccatgcctggctaatttttatatttttagtggagacggagtttcaccattttggccaggctggccttgaactcctgacctcaggtgatccacccgcttcagcctcccgaagtgctggtattacaggcatgagccactgcacctggtccatatgcattcctatatgcacatttcaacttccaaacaatagtgaaatgacactatgttgctacctaataagctgaagctgtccttgaacaagtggagttttcattcttatctcccaaatgagatgatccatagtcccaacaaccactgtatgaatccctgactgtatcagccacatctcaagttcagaggaagttctactgaatatgctgttatatacagactaaattataaagctaatctccaataatttacatataaaataattatgataagaaagagagaataaaatggcagcatatacaaagaaacacttacatataatgagcaaagataaaatacagaaagctaccacattccttgattccagacttggtcctgggcttcaattgacatagacagcttccttctcttgttacgtattttatattcttctgccctcatccacgtcatcggtggattggagttatttacctggtggaatgacaaaaatcttcattctcgaagagtctgagttctcaatagtcatggcttttaatttgttgctgcaggtttcccttaacttttactattgggcacgaaagtgccattaggctcctcaaaaaaatcccccgggttttagatgtagctctctctacatgtgttgtatggcttctggagctactcgcccccttcctaacaactttgcaacatgttctggtaaccatcacggtatattaaaactttatcgtatctcctcttcctgttgagctgaatgttccagagaagggccgttatgttctctctggctttaatctaaccttctaacacagtatggagcacacaatatgtacacagtgaaggaatgttaaataaattcatttaaacaaatagaaaaatcagcaatcctctcctgtgagcatgtgagtcaacctccactaatgtgatttcactggtttcttcagggaaccgtgtcaaaccaattaatacaggcaaacaatatgttcatctgggcaaacagatgcctaatcaggttaagagttttcttaattggaaaaatagcttgcttatgaagacaatagttttatcaataaaactcacctcaagaccttcggcacatcattgtaccaatcctaaactcgtatatcatgaactagagaaaatagctgagaactagagctagatagtgagttcttggacatgcacacaaaaagtgcagtctataaaagaaaaaaacgataaattagccttaaataaaattaaaacctttggcattgtagaaagaccttgttaatagaataaaaggcaacctatagacagagagaaaatgtttataaatcacacatcagacagaagtcttatatctacgatgaataaagagcacgcaaatctcaatgtaaaaaagaaacaaataaataatccaattagaaatagaatagatatttcaccaaagtagaaatatgggtgaaaaataagcaaataaaaagatattcaatatcattcttcactagcaaaatgaaaataaaaatcacaatgagatatcactataaacatattagaacagctaaaatacaaaacagtaataatactaaatgttggtgagtatgtagagaaatggacacttttatacattgctggtgggattgtaaaatagtacagccattctggaaaataatctggcagtttttttataaaactaagcatgcacttatcatatgatcacaccattgtgcattggacatctatcccagtaacattcacataaagtcttatacaacattcatagtagctttattcataattgccaaaaactggaatcaacctagatatttttcaacgggtaaatggttaaataaactatcatagttcataccatggaataatatgaaaaaaaaagaacaaactgttgatacatggaacaacctgtatgggtcaattcccaaaggttacatacagtttgattccatatatataacattctcaaaataacagaactataagagatggttgctaggggacagagattgggcatgggagggtgtttgtgcatatagagggttaggatgagagaattctatgttgatggaacagtctgaatcttgattatgttggtggttatatgagataaaatcaagaaccacacacaagtatgcatgcacacacgtggagaaaagcaagaaaatagtgacaattgaatactacctgtagtctagttagtggtatttgaacaatgtcaatttcctggtatttatattgaatttcagttatatacgatgtcaccactggaagaggctatgtgaagagtacatagggttctataaactattttggcaacttgccatggatttataataatttcaaaacaaatacagtactatagtttcaaaaattgcattctttactctcaccaccaattttatcagtaaaaccgctaagagttgggaaggtgtgaagccgatggtagtggatgcaaattttccaaaattctaattttcacttggaagctcaaatattatcatgggtgacaaccactattagttgttttcctcaaaatggcaggctcacattttatcattttcaagaacataccttccaactacccaaatctgctgttctgtcactcatgccttcaagtaaaaaaaaaaaaaaaaaaaaaagttctatgagaaacagctagtttagctcacaactcaaacaatactccagtgtctttctctcttgaggcaccactgtgttagtacaccacagatgaactttatgcatacgtcctatgtcatcacacagaatatttaaacggtgtactctcaagggtcaagatttaatttaaaaaattttgcttctacatctaggacattgttgagtaaaatctttttctcttgccagtgtggtggtaatgattatgtacaatgactactagaatattttgggttcatttattttacctgtgttaaaacatcagcaattgcatttgcttcatcagtgtaaatgtcaacacagtgaaagactcaagtaatatcagcactattataaaaatagttttattctacctcacagttttaactctatctcacagttttcccaagaggtcagcaatatttctggttactttttgcagatacagctaaatacatacaaatattaaaagtactatattcttgacctcctcattgtgagacattagacacatcatttaatttctttgaaccagggtacatcttttaactactattctaaatttgctcacagactgtttcaaaattatctggaagagagcagacagattaaaatttcagtttgttaaataacactggttctttgctcaaaaagctttcatatgtctttatttcgcactgaaaaacataaagatttattttggcagtcatctgacccagacccttcctctagacttatgtcttggaaccctccaatctacatattgctctagccagcaatctcttcttctcatttctttttttcctttctctgttctcctgtcttctcatctttcccatctctctctctgttttacacacaaaataccttaaaatcaatttttgggaacatttataaaatactctagaagattcttgctattctttttgactgctctgcatcaggacccattttcttataacaataataatttttcagtcactaatgaatgtcaggcactgtgctaaatgacattttatgatctcatcgttaaccttcaacagctctgaaaaggtagtattattatttactcatgatccatgttctacagccaagataatgtaggcacagaagacagaaacagctactgaactgatagatgtaaacctgacttcgatggcctgactataaaacttcctctcttcctggacccgcctgcctcctgccatagaaactaaaacttctaggtattcactgctatgggctgaactgtgtttccacaaaatgtggacgtagaagcgctaacccccagtacctcagaacatgactctatttggagacagaacttttaaaggtaaagttaaaaggtggtcttgagggtaaccactaatttaataagactggcatccttaagaggagattgggacagatagcacaggcaaagggatgaccatgtgaagacacaacaagaaggcaaccatttatgagtcatggagaaaggcctcaaaagaaactaaacctgccagcactttgaccttgaaattgtagtccctaaaatcatgagaaaataaatgtttgttgtttaagccatgcagtctgtgatactttgttatgggagccctggtaaactaatacagcctactggttaggcttgatgtgggcacatggcttgggctccaacaattagatgaattgttccctaactttcactcaggagttacttttgcaaaaaaacaaaaacaaaaaacaaacaaaaaatgagtaagagtttcctttttgagagtggtggtaattgcaacaaggtggacatgagagtttacaggctacaaggcagtggaattgtagctgcatacattgtcctgcgtgaacagtcttgcataaactacgggcagtatctggagctcaggaaaggagccagtgggatactcagaggagtgcttctccagagtgattttctgtactgctgctgacttcatagcttttgagttcagttctctgaccctactggagattctgaggtaaatccagtattcattaatttattccttttctacttaatttaggcagagtccatttctgttgcccatcagtaaaaaccttgacttgtatataatctcattccagggaaaattttttaaaaggaagctcgtaggtacatgatcagaggtcatagtaactacagggaatttaacagtgcttctcagaggtagtctgaaaatattgagcaccaactgtctttcgtagttgagttcttacctgaattgaaatgtatctgttcctattctaagttagaattagatttcaataaaggcagagactggaatagctttgtaatttcttctgagtcagctctgaacacacgtcctgatggcagcaggatgatgttacgatcacaagagggcagtgcctccctctcctcagactaacttggctttaaatcagcctatctgcattgaaaggaaaggactgagcttgcctgtgactggctagggaggaacctgagactaggggacagaaagactagggattcacccagtaaagagagctcatctgtgactgaggagccttgctccatttcaggtcttctgtgatttcaataaggaagaagaatggaaactctcctgggagtgtctttggtgattctatggcttcaactggctagtgagttggggattttggtgatgggaatggcaagaccaaattttagagcccacagggctgaggggtgaagtgttcttattaatttggaaatgtaatttgaaaatgtaatgactgactcctggtcccggacctgtgtttctgcctaggggtgaacagtcaacagggagaagaggatcctcaggccttgagcatccaggagggtgaaaatgccaccatgaactgcagttacaaaactagtataaacaatttacagtggtatagacaaaattcaggtagaggccttgtccacctaattttaatacgttcaaatgaaagagagaaacacagtggaagattaagagtcacgcttgacacttccaagaaaagcagttccttgttgatcacggcttcccgggcagcagacactgcttcttacttctgtgctacggacgcacagtgttccccaggaacctgcagcctctacgcaaaccctgccaaagcagcttcttagaagccctaatagtgggtagaattagtggttatgtctttcagtcaagaagagtctacaaacagctggcaaagtaaaaggggaactctttcaaattcgtgattttttaaaaagcatcttggactaggggaaaaggcatgaaatttggaacaggaaatggaaatgccaggctcagttctgctaatcctggctacatagggacattgtcagtgtagcagccttcaatttcctcacttgaaataaaggatatggatcaatgagcccaaaatattacttaatccctaattttattagggaaaaaaatcactgggcacttgtggaagaggaggaaggctgcacagttttagaaggtctcatttgtcctatgtgcagccctcccaagacatcagtgggtctttaaggtgcatgaggtggctcttaggttcctctaattcttgtataagaagcagtagattcattaagcattagaattggaagaggtcctaggactctcaaccaagcttttcattttagagctgaggagtaaaaccattgcataataagacagacaattttctgaatctttggagtgatagtgacaaatatctggatctgatttcaccatttattagttgtatgattcccaagcttcaatgtctctattaggcaaaatgggaatttataagaaagtaacaacttttccccatccaaaggagagataggtgtttgacactaccaggtcctaaaacgctgtgttttgaaagcaggcatttttagtaccaaatacataacagtttttcagctatttattcttgctcctactgagaaataaatactgactatagttttcttgacacagtttagatactactgaaaatgtgtttgtggagaaaattagagcatttgtatttaggttcatgctttggtgagaaaagtgggggagggcagggaaaggttgtgtcagaccttgacccattaatattagctgtaccagaatcactagagtatctttaaagatctggactattaagctcaattctggcttactcaatcaggctctgataaagtgatgaatttcaattgtaatgaatatcttctatatatgtaagagattggctcaggttcacatttaaaaaacccaaacaataatgtttgtaacaagattgacgagtttttttccacataaaggagctctgtaatattcagggctggtgctgtagcttcatcatgttacaaaggaactagggtctttctagcttactgtttttcactcttaatgtgtcactcttttttttacactttcaagagactgatagagatccttccactttatacaccttccagactgaaagaaggagaaagtcaagggcacatgtacatgctggctgagtcagtcttttccagaagctccgcccaatggcttctgcttacactcatttgctagagtggtattcgatgtttccacctcctcctatctgcaagggaggctagaatatcaggattattatctaagtatatttctattcacagcaaaatttgggttctattagtaaaaaaaataggtgatgatggacattttacagacaattagaagtttctgccagaccctcagtttaggacatattaggactcataatatttttggttcatagttatttttgaattaccatatccaatgtattttcaagttctattgagtgtaccacctactaagttttccagaagacattacaacctctataacctaattcacctccacacccaaatttaaaattctccctaatcgcttactcctctgcccccagcaagcttgacagaccccatcacttctcagtatagtgctttgtacacagtgagggtgaccttttcagagtgcaaatttgaccatgtcaaccacctgggtcctcactggttcttagagtagaaaaaaaattgcttcatgtgatttacaaaaccctccatgatttagactcttaatacctctccagtatctttccacaataagctcctaatttatctttttcttcaatactggtcctatctacgtttcttgaatgcactttgtttatcttatataaccccctcaaagcaattttaggatacattcttactctttttaaaaaattattttctcttcccttgagagtagagcccagtaaatgcctacttgttctcatacgtctgttcaagagtcagtaatagaagaaagctcaatacgctttcttagaattgtggaccactgcctttttaaatgggcagtttctccttttatttctttatttaattaataattgtctctattattactctatgtgctccttaagggcagggaccattatctgtgctgctcagccttgaatctgtaacaccaaagtaacttaagcactaagataatcaatttttcctcttctttcttcctattaatttatttaatataatatctttattttaagcctcctctaagagttaaaataatgttgtagtaaaagaacacacaagaggtcgggcgcaatggctcacgcctgtaatcccagcactttgggaggccgaggagggcggatcacgaggtcaggagatcgagaccaccctggctaacattgtgaaaccccgtctctactaaaaataaaaaaaaattggcagggcatggtggcgggcacctgtagtcccagctattcgggaggctgagtcaggagaatggcgtgaacccgggaggcagagcttgcagtgagccgagatcgcgccactgcactccagcctgggtgacagagcgagactccgtctcaaaaaaaaaaaaaaaaaaagaaagaacacacaagaaaatagggctgagtttttcaaactatagtccatgggtatttggaattgtatgaataaattgttggtgtataatgggggtcagaaaactatggcctagtgttcaaaacaacctgccacctatttttgtaaagttttattgcaaaatagccatgctcatctatttacacattgcttatgatggcttccatgctataacagcagagtttagtacttgcaacagagagtgtatgatttcaaatatatactatttgtccttttatagagaaaagtttaccaatccctgaggtatagaaattaaatgagaattattagatctgtgtgcttaggacaatgtaaaataatgaaggtacatttctaataatctagatgactaatagaataatccccttgaatttgatttttttgtcacttttaccaaattaagggtaaatgggataataatactctacaaatgaagacattgcagctgtttaaatggtgaaaagtttttggaaaattttggttatgatatagaacatagcacatagcactacagatgtatcacatagtactacagatagggcacactcccaagagcctgcatctttccattgaaagaggatgtgttgcaaaccttcattgtttgtatgcatcaacgtgcaattcaatagacataaaagtagcagtaaattaaaaacatttttttcagtgctgaattcttgggtgtttcattaaataataaaattgtataatggtgactgacatgagtatttctaaataggaaaagtgaagaaaaaatcctagtaatcactaatcacaataactcagacaatagcacatcaagctccaaataactttaatcaaatcagttattcaactgtacacatccatagctttcttttaataagtctacactaaccgttgagtttcagtggaaaatcatttcttacactaatgttttaatttgaattttatcgattttatattttgtttgaagtttttgtctgatttggtaattgtataaaacctgtgagcctaaaaagttgatacccaattttattgttgggtatatgaaacaccgtaatattaaaaaaaatggttagtatgagagtggctccttataagaagacctgcaccttactcaattttgaagaacacggaatgcacctgctaccaggccctggatctactcctaaatgaagccagtcacaccaggggcctaagacactagacacatcttcccacagactgtccttcatcaaagataattttgcccaccagatacagccattcattcattttttccaccaatttttaggggttttttttgagcatttcctatgagctaaggttctaggaaaagggctgctgatagtaataggattcaacttctgatgcaggagcactaagtgcagcttgagaaacaggacagaaatgattctaatatgatgtgataggacagaaaatatggtgggaaaaaggagagcactaactcagctcgagagatggcagaatgttttcacatggaggtgatgcactggttttcaaagaatgaacaggagtcatccaagtgaaagggagtggggagaaggaagggcattctaagcagaagtgctcaccccccggttttgggggaccagtgggaaatatgtcgagaaaaaaatctcacattttctttttttttatattctcaggatatcctgagatgcctaaaactaaattaacacttgttgtgaacacattagatgcagggaatggggagattcaagggaatcatattgctctgcgccttgaagaaggcgacaggaatcacccacacgatgaagtcagcagagtgtttgatgctccttccttgagtcccacccttcacctcggacaccgttttctttctgagtctgcaggttaagccgcaccccagggtgaaaatgaacatcattctgagactcagagcaggcgtcagggacagagaggagcctcaagagggcgctgctgccttcagcttgtggtttgacacaaatttcatctttccttccttcgcacgtctctttgttccagcctgtggcctgatcttgtagggcagtttactctgcttaacacgtgagtcaagattttgtagaagattccgccaaagactcaacaacataaagaaatatatatacctttcggtttggatatctctcaacaaaaccttctactgcttctcagccagccatgctgtctgcttcctgctcaggacttgtgatcttgttgatattcagtgagtaatgtttactcaaaacttctgagatgttctattccttagctttaggatgacctttaaccccttccaaactggagaccatgcctcttctattgccactataataaagtctttcccttttttaggaaggaccagtggagactcggttacccagacagaaggcccagttaccctccctgagagggcagctctgacattaaactgcacttatcagtccagctattcaacttttctattctggtatgtccagtatctaaacaaagagcctgagctcctcctgaaaagttcagaaaaccaggagacggacagcagaggttttcaggccagtcctatcaagagtgacagttccttccacctggagaagccctcggtgcagctgtcggactctgccgtgtactactgcgctctgagagacagagtgggagggactgcagcgagagcccagcacaaaccctggggaacgcaggtggggcctgggtgtgagccgctttgggagatgaatgaatatggactcttgttcgctgggaccccaaatggagaaaataatctcatatttctctgcatcaaagagcacaaaacagaaatgtgggcccctcacacatgggatgtagctcaccacgagaaacttttcctaatattctggagttctgtgagccttgtttgtcctttgtctctcctgcatgattctgtgagttttacacataaaaatgcaggttttgcagggcctgatgcttctttgatttctggggctctctttaagaaaaagaaaattaaattataaatttaagtttctaggttatgcggtagaaaggggccttaaaatcaaagccgaatatacttcatagtaaatctgcatttgaggttacatagagatgatcttctttaagactgaaatattataatagtcttagtttgtcctgatactgggaggttccctaactccaagtcctctttcccacggcagcactagaatcactttagctatcattaatatgagtattttcacttctatctttaaagaaataacagctttattgagatataatttgcataccttaaacttcattcttttaagtctacaattcagtggttttagtatattcacagttatccaatcattattgtgatctaattccagaacattttcaccacctcataaggaaactctgtgcctactagcactcacccccattcttttcttaccctagccataaatcaaataaaaatattgatttatgaggaataataacacaaaattttgatgtacccagtcttattgtaaatacaggacctcttatgaacctgtatctagagggatgaaacataagtcccaacatttaagactgcaaagagtttaatgactgtgatgcaggggacaaaagccagtggagattgaactctgctggtattttaacaggatttctcttgtttttggtaatgctttggttacaaattatatatttttgggtgtttcccatcctaatctccaccataattaatatgcatggattggaatagcaaggggattttcaagaacacacatattgagttataacagaaactcctgtctttgagcagtgagtagaatttctggaatttatttttgtttacacacacacacaaaatatgtgtgcaaataaacatgtaggtatttttctctggtgttactcgacatggcaaacactgaacagatttggtgactcaggaggtatgttgtgaaatcatttattaacaataaaactatttctttttttattatagtttaagttttacggtacatgtgcacaacgtgcaggtttgttacatatgtatacatgtgccatgttggtgtgctgcacccattaactcatcacttaacattaggtatacctcctaatgctacccctcccccctcctcccacccacaacaggccctggtgtgtgatgttccccttcctgtgtccatgtgttctcattgttcaattcctgcctatgagttagaacatgcggtgtttggttttttgtccttgtgatagtttgctgagaatgatggtttctagcttcatccatgtccctgcaaaggatatgaactcatcattttttatggctgcatagtattccatggtgtatatgtgccacattttcttaatccagtctaccattgttggacatttgggttggttccaagtgtttgctattgtgaatagtgccgcaataaacatatgtgtgcatatgtcctcatagcagcatgttttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgatcgccattctaactggtgtgagatggtatctcactgtggttttgatttgcatttctctgatggccagtgatgatgagcattttttcatgtcttttggctgcataaatgtcttgttttgagaagtgtctgttcatatactttgcccactttttgatggggttttttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatctcatttgtcaattttgtcttttgttgccattgcttttggtgttttagacatgaagtccttgcccatgcctatgtcctgaatggtattgcctaggttttcttctagggagtttatggttttaggtctaacatgtaagtctttaatccatctggaattaattttcgtataaggtgtaaggaagggatccagtttcagctttctacatatggctatccagttttcccagcaccatttattaaatagggaatcctttccccatttcttgtttttgtcaggtttgtcaaagatcagatagttgtagatgtgtggcattatttctgagggctctgttctgttccattgatctatatctctgttttggtaccagtaccatgctgttttggttactgtagccttgtagtatagtttgaagtcaagtaccatgatgcctccagctttattcttttggcttaggattgacttggcaatgcaggctcttttttggtttcatatgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtatcctctttgatttcattgagcagtggtttgtagttctccttgaagaggtccttcacgtcccttgtaagttgggttcctaggtattttattctctttgaagctgttgtgaatgggagttcgctcacaatttggctctctgtctgttattggtgtataagaatgcttgtgatttttgcacactgattttgtatcctgagactttgctgaaattgcctatcagcttaaggagattttgggctgagacgatggggttttctagatgtacaatcatgtcatctgcaaacagggacaatttgacttgcgtaataagagctatctatgacaaacccacagccagtatcatactgaatgggcaaaaactggaagcattccctttgaaaactggcacaagacagggataccctctctcaccacccctattcaacatagtgttggaagttctggccacggcaatcaggcaggagaaggaaataaaccacgactggcaaagtagtaacaaagattgagactaaaagttttgccttcctgctagaaagtgaaaactccgtatggttagtttgtaccttgattctatctggagaaaaagacatatgtaagaccaaaaggtgcataactgtatcatcccatgtattcactatagctcataataaattgtaagtctcacattttccaccaaagatgaattaactaaccgtgattcaattttaccactgtatatttacagtccagtaagttatattgagacaaaattggtacttaggacagtctagcatcttccatctctacaggaagtatgtgacatgacacagtcaaactcatcatatatctgttaactatacttcctgtaaaaggcagaagcctcacacagcccagtaactttgctagtacctcttgagtgcaaggtggagaattaagatctggatttgagacggagcacggaacatttcactcaggggaagagctatgaacatgctgactgccagcctgttgagggcagtcatagcctccatctgtgttggtaagcgtgaccactagcacaggacttaggctcctgttagttcagaaggatgtggagagaggcagatctttttagtctaatgaggcttagaaagaaggggtaaagggcaatgaaatcagagcactaggtctgaagccacttaatctattttatccccagagttacaaataagggatcagtctattttttcctctttttcacagtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtgaggccacagtgagatgggtgcctgtgggagccctacaaaaacctcaacaagaggcagggctcctggggagagactctgtcacagacaggaagaagcaaggagggtctgtgtcagcacaggtggtttggcaaggaaacctgagttcaattcatgtacaatgtctagatataacatttattagaagcatgtgtatcttctattctttagaatagattaagacagaatgtatagcacatatttttatatcacatatagaattatgcaacaaaaagtgcaataacaaaatatattaatcttgtgttggttttattgagggtgggaaactatccaattatcttcagaccaaatggatgattccattcataagctgttaagtttttagaatcacttatacatttatgcattaattactatgtagaatgctttaatccaagagtaatagaaatgcctttcatcgatttttcttaagaatggtatcagtactcaatgaggtaaaaaaattaaatttaaacttctttccataatcatgccagcaacctcttgtatatcagaatagatgcgaaatgtttctcaaatttcctttctctggctcctctgtttttgtgacatgattatgatattttaaaagtatctaaatattttgctgtcatttagaggctgcctactaagagagatgtctaaggtggaaatttgtcctaacggattgaatatcttgctttcaccctttcccctttgagttctggccagtttgaagctgagaagtggttagggccagaattacagctgccatggcaaccagaacccacatggtgtgtccagtgtctacttcctgtctaaacacatatttctccttggatgttacaacaggtgctcaggaacaaggatttttatttcttttgctccacacaagtttttagaaacctgagtttttaacattaaaagaaaacagacatcacattaaaaaccagatttctagcttacctataaacatgggaagagctgggaaacactacactccctggggtagaagtcaaaagttctgtttggacacataatggttttgatgtatatgtattttatttttaaaatttatgcaaatttaccattcatttcacagtatgaattaatttaaaagtaaaaatttaaattattagttacaagacaagctaatctgcaagacaaacaaatctgaattaccatttcatgaaactatacctggttttccccccatgatttcatgtatcatgggtgtgtcccagcttgagaaccttaagtatagtttattcttaattcaggagacatttgtagctatagtaagcattggagaaacattagttaataagacagacatggctcctgcctttatggaggtcatgttctagggggctatatccactatagaatggtaggcagagggaactaaagttttacacaaacaacctatgtgaccttaagaaagttataactcccctgaacatgttctctcatttgtaaaatgtagagatttaattaggcagttgctattgaataatattttccaaaattttactagcctcacaagagcacatagtccactgcctttttgagttcctaacacttactagctgcccttcttttttgggaaaggacaattagttgttatagacatattcatactgttccacatgttgcatgataatgtaacagtaataacaagaagccaaaggaagcaggcagagaggagagtggcttgggaggtcatctgctttccatacacagaagctactgttctatgtagccgggcagcagaggaagagggagaggaagaaggcgagagggagggagaggagaaaagaaagaaggatgaggaggagaaggaggaaggggacaggaggaaggcagaatgagggatagagaagagatgaagggaggaagaaagaaggaggaaagcacagaacaggtactaattcgaaagtaaatatgtttatttgaattcgaagtttttgtttctttcacaaggcattagacacactttctttcctcagcatgagagaatgagaaaaattagaagattcctatttgacaagcatgaggtcacactgaacttggactagctggctgaaactccagaggacacagctcctccagttaagctctaaggcaggttgagagacagattttctagtaattctggttgtcccttgtaaaattaatataattcatctgttcctaaaggaactaagaacattgtaactgggaaaggttccttcaatattagagttctctctagagctaagtagcaaatgcaaatgctcataggtgcctagagtagaatgaaatgagtgtggttgtccaagtgtttaaaaaggtacaggcctgataatgtgtcactaggcactgggccttggcatcagatgataaacaaaaatgatgcagtaaaccctcccattcttctcctaagcagagtgggtgtcctgaaaggttatccagagattgaagctgcgttgtttgttcctgagtcctgtcaaagtcaggctacaagctgttagatgtagacaggccattgcacaagagcttttatacaggaagcttctggatgaggggctggggagatgaagccatcacagtctgcaaggcagctgaggcttattccagcctctgtgaataaagtcaatgataatgaccattaggctccagcccctgctatttcctaatgatccttatcagggaacctcttcaggtgttccctgaaattagtcaccctcataccccacatctcagagcctatgatcttgcatacgatggatgtcttcactgcagaattgttccagtatccctgggctaaagtttgactgagttcaaataaagcatatcacacacagagagagctggttaagctaatgagctgtccagggttatgtaatcacttggcttacataacttctggacatgatccattgtcataagcatttttttttaaaagaatgaaagcatatattaggcacatattatgtgtgatacaaagaatctctgaaccttacttcttatccctctttattacatgtagtagttgccttctccatgacccctagtacaacctgcttaccatctacatcctttgtgtgtttgccctcatttccatcttctacgacacaataagacacaagttcaacagctcagtgctgttccaaccccagatggtagcattaggagcctttccacctgatttcataattaaagtttccttttctttggaaaagaggaaatttccccatcagaattggacacccttgggagtgaacagtaaattgtcaaatatgtactctcccagaagtagagtggaattcttgatgtttcccaccatcgttattacacaacctccagtctctttcagaatttccaaacagagggaaaaattaggtggacttgaaatagtaactcaatccaacagatttcccacattagtgaaaaatagctttgttttctgttcactgtattaaacaaaatactgccctctagacccaatcgccaatttatagtaagtacaaaggacagcagaacatattaaacccatcacaaatatacagtaagcaaaatctatagtgtgaaaaactctgcaagacaaacaccctgggtctttttttcttcccacaataaactacaaagaatgagtaaggggatctatggattagaagagcctttaaaaaacatatcgccagaactttggctttcccagtgccccatgcttgcaccatgtagaagtgcaagcagacgaaacctcagcatgccaacttggaggaggaccagggtgagcagcaactgaatccagagttcgcagatgcagcctgaatggcgccagtggtgggggcccggggtgctccaatggatcaccaagggaatgatgatgaagcgaatgaggacaaagccacgtggtaaaatggcttcatcaggaggagatggacacctgtgagaaatactgtgcagagttctttagcgtctctgagttcttgaaacataagaaaaattgcactgaaaatccccctgtcctctccaggaatgacagtgagaggccatgacagctctctggagccagactgagccataccagccacccagtccaagtaataaagatggccacaaggagaacagtggcagctcaggggacatgaaagagaagctgggtgtggagtctgtggtgcacttacagacagagatggccctgccacccacacctaaggacataggctatttacccacacgcaaagtagccaacgctaatgtgcccatgcaggctctctggggcaccaaggtggcagtgaatcagtggagtgcaggtgcactgccagcctgtgcccagtgcccacagcatcccatgggtcctcgagcagatcttgtatctgcaacagcagctacagcagatccagctcaccaagcagatctacattgagatgaacgtgtgggcctcccacatcctccactgtggcagggcaggggctgacaccctgaagactttgggcagccacatgtccctgcaggtttctgcagctgtggttttgcttagccagaaggctggaagccaaggtccgtctctggatgccttgaaacaagccaagatactgcacaccaacatcccttctaccttcagcactctgccccaggactgatgccttttgttctgaagccagatgggaaaagggtactctcttccctttccctgtttgggaaaacatcatgtgtcccatactgagtgctttgctccctcaggctctgggcttggtgctcttccagggtactttctccactatggcattagacccgtccaagaaagggaaaggaaggctatggaacatctccaagcacaagtgtaagtgctctagcaaggtttttgggactgatagcttctcatggatccacctctgctcccacactggagagagacccttcgtgtgctatgtctgtagtcatcacttcaccaccaagggaaacctcagggtacagtttcacaaacatctccaagagaaggtgaacccccagttgtttgctgagttccaggaaaaaatggcaacaggcaatggcaacccatatgcactctgtacctgcccccatcaatgaatcgagcctctctttaaacaacaaacttgtccttgtaacttcctctctaaggctacctcagaatctctcttcagagactaacccgaagaacctcatggatggcctgttgcccaattacctgtagcccagtccttctgcagaaagtgagggcaggcctacactccttgaggtaaggacaaacaataattcaccaagtattggtggcttctaagtgagtgggacccccggccaggaccagagaccctaaaattgctgtagctgtttgagaacatccacaatgcctccactggcttcattttctactgattcctaagctatctcaaaatgtattactgcacatgcacccacacaccagggagagactattccagtataagatttgtggctgagctttttctaccaaaggcaacttgcagactcaccttggggttcactgaaccaacacacccataaagaggcagcattcatgcctcatctgccagagttaccaatgccgtgatattgcaacagcatattcagatgcacacgggcagtcagattcccaatattcccttgccagaggatccctgtgaccttatgatcctgatccaatgatggtcagtgaggatggcagtacaagtgccatctgctatgatgatgtccccaaaagcaccgatgtagaagtcagctcccaggagggcccaagcagctcctcaaagatccccgtatctccttccatgacggcttccttagatgccccaggtagggggagtgggtcctatcccttttggcctgcagtgccagagcagccaaaaaatggttcagtggagagcaatggcttgaccaaccactcatcctcactgaaatgagactaggagtgtgagagccaaagtccagacaccatggaaactaggtccttccaggtactctctggccaatagtgaggcacaaatcatcaagtcaatgtctcctgatgctgggggcaaatcagagagctttgagaacagatgcagggatggaaggtcggagcaggctcccttcaacgtttatctgagcccagccaacctatgtcaaacttgaagttccaggtatatttgtaggaccctcaatcttgtctccagggatgacccctttgttagaggcccagctacactgacaggtcaagcaacacggctgcacccagtgtgggaagaacttcctgtccactagtcttttcagattcacagacagactcacactggagagaagccttttgtatgcaacatttgtgggacagcttttaccaccaaaggcaacttgagggtctactatatgacacatggggtgaacaataactcagcacaccatgggaggaagctggtcctggagaacaccatgtctctgttaggtacaaaaggaaaaagagtctcagaaatgtttcctaaggaaatcccagcccctttagtgaatgtggacactgttgtaaggaatcagtatacccccacacttgactgtggtctggcagtgaaaaccagtgagctctctctgatccagtgtagctgtattcctaccctcctggtttccttggaggctgtctccatcatgaataacaccaccatctccaagatgatggctaccaatcaggtgtcattgcggatgtggaaaaaccaggtgctattgacagcattcccaaacatcagttcctttacttcctggaagaaaacaaggttgcagtcttctttttttttcttttctttttctttttcttttttttttccagcttagcttaacttgcatggaaggataaatgcagacagagttaaatctctagaatctgctttttttttttttttgtaaaggcccatctcctcctgttttctttcttttttatttttatttttttcgagatggagtcttgctctggaggctggagtgcagtggcgtgatctcagctcactgcaatctccacctcccaggttcaagcaattcttctgcttcagcctcctgagtagctgggactacaggcatgtgccactgcatgcagctaatttttgtatttttagtagagacagggtttcatcatgttggccaggctgatctcgaattcctgaccttgtgatccacccacctcggcctcccaaagtgctggagttacaggtatgagccacccgcgctcggccttctttttcttactggtatgcaaatgacgtttatgaaggttgtgaccatcacctcaagcacaattgaaatgaaaatgaaaaaaatgaataaaaaattataccaaaacaaatatacactggatttttttttttaagcagcaggtgttgcaaagtagccttgttacttgtgacaaactatatacataggactttcgtaaaacctatggtgactttttctaagaccattatctacttcaaggtggaatcattggaacttattgaaccacagtggaagagacaactacttagcctaattggggtgaagggtattggtaaccgtatgcaggtaaacggacaagatctgtcatctatttagggaactgttttatattcccccaatcctgttaacatctttctttttctttctaaaaatatacttttaaaagaacaaaaaactaaggttgtacaattataaaattgcttcaaccttagaaccttaagtaggatgccctcagatggacttatgttagtgcttagggattcattgtgtgtgttgctgtttattcaaatgcagttcagtcagaaccgcaagagtgccaatgtcctcctcatacttcccaaatgcctttttcttcctgaacctgaggtggacacctgaatggggaatctcaggtgacttaatttagtttgtcggtgcctaccctattgaaaaaccgggttttcattcttgagaagaaactcatggaagggtgtgtttcctgccataggttcacacactatttttttgttttgtttaatttatttggtgcaacttaggaagattattttttcttgaggattttatgaaggctgtgaagttggaacaggtgagtcctgggtaggaaagcttttatttatctcccttatttatttatttatttgttttttagccatagtctctattttcctattttaagactactgaagtattcccaggttctgtcttaaacctaaaagtcagtgtattggtggaaagagttggatgttcaaggtgttttgtgattcctttatttgtaatctccttttgtatatgtaataatattgagcaaaggaaacatctctctaatggtttaacaagaaaggagaaagaaaaaccctaacttctgggagaagtctatcccttctatgtggaaggccctgaatgaaatgtagatcaagactgttagctaatgttttgcctcttggttattgcacctgattttaggcctttttatttttttgccatttgtgcctttccttctggaattgtaagtgaacacaataatggtatctgcttatactgtgaagtgtgtattgttacagagaccacaccagtggctttttcactgttgagctaataatgccttgtgaatgtatgatctttggagaaactcctgtagctgtgctgctaatgctgtctgtctgttggaaaataaattttgaatgttttctctttggaaaacatgtccacaaatcacaatatgtgactcttaggtgaattctgaatcagataagctgtaaaataattgaaaatgtaaacacatttaccaatttggttgtgttttaaaaaagtcaaaatttagtgatagtactaaaataagcaaaagcaaaataatatgatattttacaaatatatgaatggctttaaaaaaataaatgaatgagtaaatgtagttggggcataaataaaacaagattgaccaagaatcaatatttgatgaacatgggtgatgggtacatggggtttcattgttccatactgtatacttttctatatgtttgagaaattttctttaaaaaaattaaaaatagaaattggctagattcaaatcctgtcatctccattgcagcatgacttttgattctttaacctgttgatgtctcagtttcctcatccattaaatggtgataatagaatttacctcgcgaagtcgagttgagaattaaaattatacatatttacatacacctatatgtttaaattaaactatacatgattttatacagacagttttcgcacggtacatagcatggcatgtcgacgcagtagagactcaatctgtgacagccaatgttaatggaaagggtggaatttgttcagggcctaaatcagattttcaatcatgtgctagtttcataacaccacactgctccttgacacgtttttcaaaggaaagagccaaaactcattgataaggaaaggacatcttggcactgcttgaaaatcaccccaacaggtccctaaatccccatttgcagctccagtaaatatccccatttgcagctgctcccccaccagtacctaccctgctgctaaggcccaggccctgtcagagaagcagcacatgacggatgtttaacataaaagtgttttcagggggcaggcagggctgctttaattcccctaactaggtaatttaaggtatattttctcatatttgccaacagaccaaagaagaaatgctctaagatgtaatcaatattcacatcagccttcaaaccaatttgatttcagtctttcacactgttgaaataaacaaccctgtgaagtcccacacatcaagataaaagccaacaaagaaatggcatttttcccttgagcaactatacacctaaaagatgacttgtgaagcaataaatataggttatggagattttcccctcttactctaagagtacataaacactttaaaatgtatttgagatattattgattgctgaattaatatattttgtaagatgaggtaattattgacaaagaagatattctcatcctgtattcagtttaaatgcaagctgtcatacaaaaaagagatttaagaggagatttataacctgctccaggaagctaggagaaggtttcatccacccccaaagcgcagacacctcctcactcttctgcttgttcacagtaatatggatgccactgtgtctggtcacagatctatgtctctgcttaaattgtccccattgcacaaaatgtcctttctccatctccacagactaaacttctgtctcaacctcctatgactgtacttttggaaaggaaagtggggaacacagtaggtgagaaaagacatctgttttgctggttgataatctagaagatgtggtctagacattgaattattctcgtttcataatttataagaacaactattaaaatgcccagtggtcctggataatgtatagtcaccattcttatcttacaagacatagctgtcctgatgtaaagatacaacgtgtgtaatctttccttctctaaacttctcaatcactctttaatctttgttgctacttaccacttgatatgttgcattttgtttctgaaaattcatgtctataactataccatgatcagaatggctaaagtgaaaaagactacactaaatattgacaagaacatggagcaacagaaattcacatattcggctggaaggaatgtcaactggtacaatttcaaaaacatttggcaatatttactatagctgaacatgtgcattccctgtgatgcagaaattcaatttctacctatatgcccaataagaagttacatatattcatttgtaaaacatgtacaagaataagaacatgtattacatcagtgattataatatcctaaaactggaaagcaactcagatgcacatagcagtttcaaagataaataaagtacgataatgaaatactacccagcaatgagaatgaataaacttgccatatgctcaaggcagattgaatcacacaaatattactgagtgaaaaatgaaagcaaaagaaattcaagaaaaggcaagactaagctatgaagttgtaagtcaggagagtgaagataggggctatctttacaaggagatagtgactcagaaagagtacaagggaggcttctggatgttggcaatgctgtttctcaatttgggtgctggttacataggcgatttcactgcctatgtatgaaaattcaccaagctctacatttaagttttgtgcactattctgaatctatattatactttaaaagtttttaaaagaaaccttatccatcccattgactaaattttgagaacatacttcttattcaatccatcttcatagccccactgcccttcacattagccttcatttaaaacatgcttcataattgttttctcaataaaggactgagctacatgtttaaaaagatgctccggtcccaggtcctaggatctagtatgttatcagatggacttgaacttccctgtgtagcttgctaattactgctttgagtttagacctttggtattgatgtggtttttctctgtctccactcaaatctaatgctgaattgtaattcctagtgttggaggagaggtctggtgggaggtgattggatcatggaggtggcttctaatggtttagcaccatccacctagtgctctctcgtgatagagttctcaagagatctggttgtttgaaggtgtgtggcacctccccctttgctctctctctctctctctcctgctgggcatgtgaaagtgtacttgcttctccttcaccttctgccatgaatttcttagtttcctgaggcctcccagccatgcctccagtatagcctacagaactgtgagtctattaaacatcttttcttcataatacccaatctcaaatagttctttatagcaatgtgagaatggtctaatacaagtatgttacacatggttttctgtaacaggcttttaactggcctccctccttccagcatttcctccccataatccactcccataccctacaaatgacttattcttttaagaaacacagcatcaatcacatcagtcctctgtttaacaaccttcaatgaccatccttttcctgtaggagtaaggttaattaaaactcatggtgtagctctcgatggcctctacagtagtcatgaactttctgcttcatcagattaagtctaacttgtgaatgaggctgggaaacatttactgtcctccattaacagctctgctcatagtcctttgctcccatgattacacctgtctgaatgcttaccatcattctttctcctgatcctagagactatctcagaccattattaccttgtgaagaattttctggtcaccccagctcacagtgatctcttccttctgataaattaccccaaatttttaaaaaatatatttcaaaaaatctttttttcaaaaaatatttttgaaatgtatttttatatattttatgtatgtttttaaaatatagttcacttaattttacagtgcacttttataagcattatctcattcactgtttataataacattgtgaacaaggcaaggtacaaagaattaatctcattttgtagcttaaaaactgagattcagagaagtgaaggggcctaagccagtgtgctcagccaagggtaaagctcactcttctcacccgagctctctataccaaattaccttattatgagtatatacgttatctcctcccaaatatacatttttttctaaatgttcttacacgtttgtatgtctcataatactggacaagacatttacggggctatgtagagctgagtgattttatttcaatattgttcccagcaagctcaaggactgacaaagctgtaccacctctgctctatgggactactgtagcaaaaactgaattgtagaaaaaaacaatcactgcatctccaaaaaatctgcttttggaagtaagaaagagacaagaaaaataatcttttaaaggtcagggcagccttaattttacctttatatcctaggctccaatattgaaaagtttcaaagaaggctatcagaggtaatgacaatgggcttcaagaactacaaatgaatcacaatgaaataagtttcaaattgatcaaattccagaaaccactcctcagataatttaactagtaagcaaaatggagaactttttgattttgaagcccagtttaacagaatttaaactatattaatacaaaacttaattttctttattccaaaggctatattatactaaatctttctggaagctaaccacaggactaatgtgatgaaattgaaagaatggggaacaaactaggtggatgtctggacaccccaaactgaaggtaaatgctaccttctaccctaacattcttgacttccacaaactcaggtgttagacacctgagcactggaagttaaacaggtagatatgaagactaagaaaagaagagggagatagagggaccaaaataaatctgaatattgtaaagaaggtattcacacagtctttatttgcctagtgctaaatacatccagtgtctacttctagtctgacccttcattccaaatgcctgtgtctgggctaacgggagcatagacagcgaatagaatttgctttactgtctgatcttcactcaagtgaaagcaatttgaggcaggaatcatgttttgttttggtttatgtgtttttttgcagagctttacatgtcatgtaagtcggaatttctggaatgagtacttaagcttagggattcctgagcatgcataaacatttaagagcggctaggtgatctgtctagccagagaatcttgtcagcatgtaactgtactcaagaccacaattttactaagagttgaagtgtgtaggtaattttaactggtgagaaaattcatttaggataaatatttattatttgaagattatttttatgttcactttatttttgccatagctattgttactatactgacagcacttccaataagaacctgtgtaaaaaaaacaatatagtggtcctcagtaaaaaagtcccaatgctttaaaatggtttatgtaggcagagaactatgctttaacttcttactataatacaaccataacttgcataaagtaaatccaatcctagagcaattatgagctatgaattctgctggtcttatttcattagcacaaataattttaaaagggctagacaaacaggccaacagatgtcgagcaaacagaaactttaactgagattcctgaaatccctaataaaacaaataaacaggagacagccataataaaataaatgcctctgtaatgaagagaagtgtgtaatagtaagcatctaaacctggcattataaaagaaacaaaaagtaaaaagatggtgtttcgaaaaccaagttactaaagtaaggttacctatttatcataaggctaaaggtgtaaggctgctgtcatccaagtatgatccagggaaccctagacagaccttttagggagtctggcattccaaaactatttttataatgataataagacattatttgccttttttactttcaaagtctcgcaggtgtatatgcaaggtttccagtctacatggtatgtgataaggtcatcactctgatggttaatggaatatatctctacctctatctctatgccacataaacacaacctctttagagtcttcttggaatctctcagtgaaactataaagggatcctgagaccaacaagtttgagaactgatggtttacaggctacaaattcaatttatcacaatatgactttgaataatattttaccacttcacacacagtgtaataaatttacagcatttcacctccattctttgtgctattgttgtcaacacatttttattctacataagttaaaagccccacaatgcagttttatggtttttcctttaaaaaattatcttttaaagttttttttttagcacttcaaagtttggttctgacatacattgtttctgatgaaaagctggctgttattcttagctttgactccccatacctaaagtgtctttcctcatttttctatcctgtcaccccaactgctgttaaaattttcctttttattactggttctcagaaatttgattacaatgagccttggggtaattttctctatatttcttctctgtatctacgaaaaactttcagccattatttctttaagtatctttctttctctccctctcttcttctgaggcctcaggtacacctattttagattatttgattttgtagagttcaggagcactatttctttttttaaaatcttttttctttgcttcagtttagatcatttctactgctttttcttcaagttctctaagctttttttcctgtgatttctaatctgctgttaatcttgtccaacttatttttcattttatttaattgttttttatttctacaagttccacttggatctttttacgccttccatttttctcctccttatgtttctatatttttttacatccttgaattcatttttattgtatgtatgtagtttatatgcactgttttaaagtccttttataataatcacataatctgtgtcattttaaattctgtttctgtttatctttctcccggttatagactttattttcctggttcttcaccagcttgataattttgattgggtgctagatattatgtattttacattgttggatgcacaatttttttatattactttaaacaccattggacattgtactgattattaaataatttgcttatcattttgattttttgagacttcttttaatttttatctgaacagcctctattctgggactaattaaagtcactactaatttatcacctttctgaggattctagtgcctgccctgtgcattacaatgtctcttgaatcctggatgctagtaatacaaactatgcccagcactatgtgaactctggaaattatttggcctgttgcttctctttgcctgagtttcctctcatgtatgtacagatcagccaaagacaaagagtgacccctccagagccagagttctcttctgaatctctctctccccctctttctctttgtctctctctctttttctctctccccaaatccctcctctctggtacacttattcatacattctagatgctttaggatccccaatctcctattctattcctcaacacaacgaggcagctgtgctgtgttgtggttaatcctccctgtgctgttgcctagaaactgcctccaggaaataagtggaagaaatgttaggactcacttcatttattttcattatctctgtattatctgtagtccaaggtctgaaaatttcctttattttgtccagctttttaatttgaagatcaatttctgtagcagtgtacatttatcaaggaaacaaaagtcaaagtaatttatttgtgttgtattttacagttgtagtggtccatgataaattggtgaaaacactgattctttatcatagattatttgaaaagagccacattagataatgtttctaacatgcattatcatgtttataagatgacatgctgattgtgtcttggggacttaatagaactgattcagataaaggaataaaggagagtagagaggactttctaggcagatgttctctgtcccatgagaaccataaagacatgtgcaaggaggaggcctcagatttttctacttaaaagttgtgcctggaattatttgggattattatctgtacccaaggagaaaatgatgcgagtaataattgaacattgccccaattattgctgtgaatctataaaaaatgaatgtttagtgctttcttcttagagtcctattccattcttcttaggtatctaccttcccttcaagctattttattaaaaacagggtcaaggttctttttggtttttattttctccaagatggtggattggaggcatcgtcaacatgcttctcccacttgggaagacaaaatagtgtgtagagactcacactgtgaactttcttccaagaagcaacacaggaacttaacaagaaaatggaaagaaaccacataccctttgaatgaagcagcaagttggctgggcacagcggctcacgcctgtaatcccagcactttgggaggccgaggtgggcggatcatgagatcaagagatcgagaccatcctggccaacatggtgaaaccccatctctactaaaaatacacaaattagctgggcgttgtggtgcgtgcttgtagtcccagctactagggaggctgaggcaggagaattgcttgaacgcgggaggtggaggttgcagtgagctgagattgcgccactgcactccagcctggtgacagagcaagactccatctcaaacaaacaaacaacaacaaaaagcagcagcaggttgcagcctgcactgtgagctagttggaacactctaagtccccagagtgtgagagggttagaaactgcttctgggatatacatgcccactggggaacctggcaatccaggctacggggaaagacttaatcctaccaagccctagagctgatttagtgagccgcacggggtacatgagaaggagcagcattgggatgtgctttgcatgcattcccagtctccagtggggacagagagaagccatttctgatcctcacaggggacctcgcagacatctgccagctagctcaggtggtggttgagagaagctcccaactgagatttgcaatataatctcgagtggggataaactcctttagcccaaactcagggacaagcagaaagtgtactataaccatgagcacaggagctaaatgcccctgccttgcaggtggatcaggaggggcatggcctgaaaaccacagtttctgtctctatggggaagccttgtggcctggagaagctttgagttctgagggcagactgcttggaatctagctagctgctgatagtgaaacactgcaggtgtgagacctgccttgccaagtgtgtaggggctgagggaggcttactgctgcctgctactccccactccctatgtggaagagtccacatggggaagtgccttctgtgcaatagaggcagctgtactcctctgcttatgccagcttgtgcctccacttgtgccagcacgcagaacacggacttccctgacccagccccacctagctttgcccctccaccagctccggttgcttaacacaaaggtctgagtcttttaggagctatatcgcccttcccattgcctgagacaccaaagtacctctcccagtaacataaggcaagcacaaatcccaccattattaccacagttggtagtcctttgcaagcactatctcctggctagaggccaaccaacacagtccttcacagcatttgtagacagaataaaacagcaccaagaaagaggaaacttgagtgtgatctcaactatcaccattgcctgcagcaccctggctaaccaggaggtcctcagcatgtccacatgatcagttcgtttactagtataactggcatttgaggaagccaacacactaaagctattcataactaagcaatctctcagagtctaagtcactctcctgccactcccatcagagctagtgctggtagccacttccgggagacttgagaacaggtcacatcactagatcccttgcagacattctgcagcaacagcctggaggtatcagtcccactgggtggccagatccagaggagtagcagcattcacagcagtctggctctcagggactcctacttctaggggtaaagggggtgcactatatcaagggagcaccctgtgggacaaaagaacccagatggccggtcttgagtcccagaattttctgctttggggaagtttctttcaacagagtcacaggtgcagtgctgagctcagcagggaaagcttgtggctctaactaaacagtcagtcagccctggtgctagtgaagggtcttgaaaagtagaattctttttccccctcatccaccactgcagacacagctggaacttctcccacggaagctcagtgtgggtgcatctgtagacaacctttccagaacacttcaaggtaattgcatccccacaggaaaaatgccttccaggtttagtcttacacaagggggagagtcacaatccctgtctacatggaacatcagcactcatgcaggtgagaagaggtgcctatacgatctgtatagctggaacactgggccagcagtatgactgggaggtggatcactttcctgctggactggcagggtagctgaggaggctctctccttccccttgaagaggactcagtgcatttcactgagagttcccccagctgcttctgtcaaggctgggacctctgcccacctctaaatattgcatttacccatctgctttagccacagttgtttttttgttccccttggacatctcttactggtctgaagcctgaactgttccacccagtgaataaaatactggggaaaaaaagtaaataaataaaagggtgcacaccactggagaatgagacaagcgtcaagacgcctctgccattcaagccccacaggagacaatgaacctgctcacatactgggaacattgctactacaaccagcatccaagaaagctgtcatacaacggctttctataaccaaggagctcatacagaattcatctctgaaagcacccagagccaaaccagattataataaactataatcaaagtcacatcctcaagggggcaaaaaagaaattaaaaaacccacaagtgagtaaaaaataagttaaaaaataattagaagaaatggtctatccaaatacaagaagtgcaaagaaccactgggagattcaaccatacacacaaaaatgtgacccatggtcgaaagagaaaactgttaataaacccaaaaagagatgacccaggtgttggatttattggatgtactttaagataaatataataaaatacaaatggatctaatagaaattgtagacaatatgcatgctgagatatgtaagtttcggagagagaagaacaaacatatgtatagggaataggttaaccagtatatttaaaaatatgtatacaaaatatgctaaccaaaaagaaagattgacaaataggacacgaatacaattttaaaatggtgctcatccaacgacagtattaagaaagtcaattagcaacctaaattctgaaaaaatattcaagaagatacagctgaaaaaatattacttccagaatatatttaaaacctcccataaattaacaattaaaaattacacaataataaaatacataaatggtgtaacgagtgagtactgctatagactgaatgtttgtgtccccccaaattcatatgttgaaatctgttgtgattttaatttatgtctttttttttttgacggagtcttgctctgctgccatgctagagtgcggtgacacaatctcagctcactgcatcctctccctcccgggttcaagcaattcccctacctcagcctccaagtagttgggactacaggtgtgcgccaccatgcccagctaattttttgtattttagtagagacggtttcatcatgttggccaggatgatctcgatctcctgacctcgtggtccacctgcctcagccttccaaagtgctgggattacaggtttgagccacctcacgtggccaatttgttatgtcttcttaatttggacttgaagtctctctcctgagaatgaccataagccaagataaccactgcctaggacagccttgactaggggaaaaattaggtttaggtgtgtgggtcaggtaaaatggaatggatctttaaaacttcatgttgagcaatagaaaccaggccctcctcccaacatgctatataaggacgtgaagcgaaaaggcataaaatagaaggaatttatttctcccaggtcccagagaggttataggtgccagtgggaggctgatgggaagttcagaggcagcagggagctcaaccagtaggtgaagagagagagaaacagagggagagagaggcctgtgggattatacgtttattaaggttcatgggtattatcccttaggcttatccatgggtactgaggactgtctagttcaaagaaaacacataaaaaggggagaaattatgtacacgactctggcgttggccattagatttatcatggttagcagctgtggaaagtgttggattttgggtcagtgagatgaagaacaaccataaagggagtggaagttctaactaggccaagggagatgaagtatgacttatgtcaggcctgaaaatggacgccaagggagcaaccacattaaacaaacttatgacagaactgaattaccagtgtggtcgtatttggaggtgcggcctttaagaggtgattaggtaatgagaataatgtccatataaaagaggtcacagagagcttccttgcttttttggcaatgtgaggacaccgcaaagatgactaccaacccgaaaacacgccctcactaggcactgaatcttctgggagcttgatcttggactatacttcctccagaactttgagtttctgtttttataagccacctatctatgatattttgttacagtggcccaaatagactaagacaaatccataaaatatgttaaacatcataagtcattagggggatgcaaataaaatctacattccggtgccattcatccccactagaagcactaaaaacaagccatctgacaaccccaatattggcaaatatgtggaacaactagacagttcatgcagtgctggcgagaatgtaaaatggcaccgcacaatcactttggggtcttgcaatggcccagcaagaacactcacagatatttagcaaagataagtgaaaacataggcccataaatgatccatacaaaaaattttgtatgcacctcatttatatttgttgtaactggaaacaatttaaacgtccatcaacaggagataaaaaagaactacggactgatacacacaacaatattaacggatctctaaagccttgtgttgagcaatggaaaccaggcccttccctcaaaatactgcatgataccttttatataaaatacaagaacaaaaactaaactatggtgatacaagtaaaaatgtggtttcctctgggaaggagagtttgactaaaaaggggcacaaagggatttttctgcgatcatggaaatgctctacatattgttttaggtgatagttacacaggtgtataaaattctcaaactcattgaaatgaatacattgtatctgtgcattttattatgtcaatcatacttcaatacaaaagaaaccaaaataaaataaaataacctatatagaaagaaatgtgcccctgcacaattgtagggctaggtaagttttcacaatttggaaaagcccatgtaaccagcacccatatcaagaaaaagggcattacccacatggcaggccactcttgtacctgcttcctgtctctaccagcccaagtaaccattatcccgacatctaactgcacagactagttttgcactttaattaaatgggatcatttagtatgtactctggtttctagctaattttacacaatcataactttatgagatgtatttgtattattatgtgtagccataaatcttcattctcagaactttggggcattttattgtctttggtcatttcatttgtgtatatttagcttcccagggcaaattaatgaccagctagtctttgttgattccaagtctcagacagctatcagagtagactataatcacgacagaccacagctgctctagcaattggaaaagtatagacaaattcctgcaaaaactgtagaaagctaaaaatattaatttttctctgtgtatatattattttattttggttcttttttatgaggtataattttttctacaatgaaatgcacttacatgtttagtttaatgtgttttgagaaccatatacacccatgtaacaagataatatatagaacattccctacatccctgaagtctcctttccagtctaatttttcctcctacagacaaccactttctgataattttatcactagttaaatcatcctggacttaaaaaaaattaattttctcataagagggactttaggtcattatattatattcaattatattcactcaaagaagagagcataaacagacaattaaaagctgcagtcaactgaatcacactcacatatctgcacattgacaccacacaaatcagtcaccaactttcatgctgctgaaaggtaaaactatagagttgcccccagtgaaaaaagtctttcagccacatctgccgcagcagtgggctgacagagggatttgcaatgttccaattgctttatttatgatataagagaataagaatgcatgctctgatgagtttggctgcactcatttagactatcgggtgcaatgtttgaaagccagatttttcctagcacagacttactattgattgctattgggcacatgcaacgggacaaattttgtcaatcaagaaacttgctgtaatgccattaagcaaacaagaaactttatctaatataaattttcccagaatccaatggcttggtgcacaggaagaaagagttataatgattgagagtgaaaagttttatctccctgtctggaagaaaaatctgggaatatatttcactgtagatttcagccagagaccaaaaagcatacaccatgcaaaaagatggatgataacttgttctcagtagtcatcataacccataataaattgttatttcttatgaaacttatgagtctatctctgatgcattggctgaatgtagcaaatggttgaatcattaaaaccttcaatttaatttaactcatgtacatgtacagatataatttctgtctattaaattaaaataagaccaaataggcaggttagaatctccaactgtgtcaaaaagctatggcttaacacaggcaaactgatatcagcagatcacattttctcttctggcagaggagcaccttacagctcggcactcagaagaacttgcaacattctgctcccctgcctactgaggatagtcatagcctctttctgacaaaggatggtaaagatggccacaaatgcaggactccggcttttctcagctttaaaatctgggggcagcagcaggttgttattttctcctaaacctgatggggtttaggggaaagaggtaatggacagggagtcacagccccgtcctacattatttccttacaacctcatgggtacccccaggagaatcagcataattctctctcccttccccctctctcatctcttttctctctctttttcaggatctagctagttccagagggtaactcaagccctgaccgaaatttatttttatgctttaagttctgggttacatgtgcagaacttgcagttttgttacataggtatacacgtgccctggttgtttgctgcacccatcaacctgtcactcttctaatgttatccctcccctacccacccaaccccaacaggccccagtgtgtgatgttcccctccctgtgtccatgtgttcttatagttcaactcccacctatgagtgaggaacatgcagtgtttggttttctgatcttgtgatagtttgctgagaatgatggtttccagcttcatccatgtccctgcaaaggacattaactcatccttttttatggctgcatagcattccatggtgtataagtgccacattttttgaattcagtctatcattgatggacatttgggttggttccaagtctttgctattgtgaatagtgccacaataaacatacgtgtgcatgtgtctttatagtagcatgatttataatcctctgggtatatgcccagtaatgggattactgggccaaatggtatttctagttctagatccttgaggaatcgccacactgtcttccacaatggttgaactattttatagtcccaccaacagtgtaaaagcattcctacttttccacaacctctccagcatctgttgtttcctgactttttaatgatcaccattccaactggtgtgagatagtatctcattgtggttttgatttgcatttctctaatgaccagtgatgatgagcattttttcatatgtctgttggctgcataaatgtcttctttggagaagtgtctgttcatatcctttgcctaattatttgatggggttgtttgcttttttcttgtaaatttgtttaagttctttgtagattctggatattagccctttgtcagatggatagattgcaaaaattttctcccattccgtaggttgcctgtttactctgatgatagtttcttttgctgtgcagaagctttttagtttaattaaatcccatttgtcagttttggcttttgttgccattgcttttggtgttttagtcatgaaatctttgcccatgcctatgtcctgaatggtattgctcaggttttcttctaggatttttacggtcctaggtcttaggtttaagtctttgagccatcttgagctgatttttgtataaggtgtacggaaagggtccagtttcagttttctgcctatggctagccagttttcccaacaccatttgttaaatagggaatcgtttccccattgcttgtgtgtcttgatgggaatttctatactaccaggagaatcactataattttctcactcttcttctcctctcctctctcctctcctctcatctcctctcctctcttttctctctttttcaagatctagccaatcccagaaggtaactcaaacccaggctgcaatttctatgctgcagaaggaggctgtgaccttggattgtgtataagaagctaaaacttaattattatttactctggtacagacatccaccaagtgggagaattattttccttatagatcaggagtcttttaatgagcagaatggaacaaagggttggtattctctgaacttgcagaaaccagccagttccatcagctgtattttcacagcctcacagcttgaggttttggcaatgttctttcatcccctgagtgaaactacagtgaaatattcacctgaggggggcctaaaaaattcatatctcaatgtcccccgatataaacacctgggcaagagtcacagtgtgaacaggaagaggcagggaggcactgtcaatggagatggagatttaggagaaacttcactctaaggaaaatgttctctctggctcagagaacatatcttaaattgtcattaatcaaaagcgtgtttatcttcagttctttatcttgaagtagattattcggcaaaagatatatatatatgtgtgtgtgtgtgtgtgtgtgtgtgtatatatatatatatatatttttttttttttttttttccaagatggagtttcactcttgtcgcccaggctggagtgcaatggcactatctcggctcactgcaacctccacctcccgggttcaagcaattctcctgcttcagcctcccaagtagctgggatacaggtgcacaccaccatgcccggctaatttttgtatttttttgttaagtagaggtggggtttcaccatgttggccaggctggtctcgaactcctgacctcaggtgatctgccagcctcagcctcccaaagttctgggattacaagcgtgagccaccgtgcccagccaacaaaagattttttttagaaatttgtggtgactacattaaagtgtgaaactgactcttaaaaagttaagaaacacttggccaaatccatatgcgaattgttagatgatttgtctgtatattgccatgacttgctcttcttctttttatatttttttctttcccgttgagtgacctacttgatttacttaatttctgggtggatattccttccattacaagtcctagcctaagacttaaggaaaatgagcttgcttttctactttcctgactctggttccaaaggccgaattatttccattggaataaaaacttcttgattcttaacccttaaggagacttttagaaagtattatcctcaattgtaatattggtcttttcaaaattcacccatgagagcaaaatcaggaccctgttctgggaagaagcatgactacgtcccagggagccaggccatttggccatgaaactgtgattgtgaaaagacgtagatgaaagcatatgactttcacaaaaagtaatgacaagaagagggatttcttattcttgggacaatttggagagaattagtcttttcttcaggaaacatgtgcctaaatatcagaaaagaagtcatagaagaagaaagaaaatctcgttttcatttcattttgatgacttaaagatggatgggcaattttcctggggaatattaaggtttaaaagaacataaattttaggaaaagtttccagttattctcaataataagacagatataaaactattttccaaatctataatacaaaattgccctgtgataaatgacaggaaatttccgaaggtgatgggttgaaaacggtgtgatgtggtccctatatttctaaattaaattttcaggtagaataatcatagtgagataaaaaggaaatttttcagcctcaaaatataaaaggttttaaagtcatctattaaaagtctttgatatacattttggttattcaaagcagaataaccactgtacaattccatttatataacattcatgaaataacaaaattgtagggattaataacagattagtgattgttaggggttatgactggggagaaggaatagctgtggctattaagataaaaataatgaactattcctcctatccaaaaaatctatttataaataaacatcataaaaaataaactcaaagtgaatcatgaaattaaatgtaaaatgtaaaactgtgaaacttttggaaaaaataaagaaaatcttcaagatgcagagccaagcgaagagttcttaggtttgacaccaaaagcacaatacacacacacatatacacacacaaattggatttcatcaaaatttaaaacttttgctctgtaaaagatcctgttaagaagatcaaatgataaactacagactgggagtaaatatttaaaaaccaggtatctgacacagagttgtagctagaatatataaagaattcccaaaatgaaacagtaaaaaaaaaaaaagttagaaaatgagcaaaaagcattaaacagatttcactttgaggatatacatattgcaaataagcatatgagaagatgatcaacattatcagctatcagtgaaatgcaaattaaaaccacgatgagatattattatatacctatcagaatggctgaaataaaaaataaagataacatcaaatgctgttgaaaatttagggaaactggatcactagtatgttgttggtagggatataaaatgatacaggcactccggaaaatagtttagcaatttcttataaaattatgcatgccttaccccatgacccagcaattacactctttgggacttatcctagagaaacaaaagcttatattcacaccaaaacctgtacatgaatattaatagcagctttattcatcacagcccaaatctggaaacaacccagatgtcttccagtgggtgaatggttaagcaaacagtggcacattcataacatagtctattatatagcaatacagaggaacaaaagcatttatacacataataacttgcatagatatcatgcttttatccctcatgcagagtgagaaaagccaattttaaaaggttactactgtacaattccatttatatgacattattgcaataacaaaatagtaggagtaagtaacagattagtgattgtcagggattaatgatgtggggaggggatgggtgtggctgtgtgaaggagtagcatgaggaaagctgtgattgtgaaaccattgtgagtcttgattgtggcaatggttacatgaatctatacatacgataaaattgcatagaaccatacacatacaaattagtgcatgtacaacttcagaaacctaaataagctctacagattataccaatgtgaatgtcttggtttagaaactgttctatagctacacaagttgttatcattggggatgctaagtgaagaatacgtgagacctctatatacattttttgaaattataatactataattatttcaaataaaaaataaaaatatttttaaaaattaaacaaaactttgcataaaactcacaattctaaatcaccttctgtggctctgttacccatctatcacacattcagcctaggttctcttagttcctgcactaataaatataaatataaattgtccctgcattataaataaccctgccccaatcttgcgtttatctttcgtctttttcgccttttttcttaggtacatatattcagaaacagagaaaaactgcctattgaaaatgatttgtaagagtcagagtttgctaatgtgggtaaaataaatcaaatcagtcaatgataaattatatgcaagctagtgtaatgatttgtagataactgagaaattatcttattctcaaaaaaagtcaatgaacaacgtgtttatactgttagtacagtatatgctcggtaacttttttttctgctgaatggaagaagggttggaggagcatcaaagttaatggggactaggagcagactcctattggcacaaatccaaagagaattcgtataagtgatagataattcaacgagatgagcacatatttaatggcaaaatttacctacaaaattattggcatatgataaacacatctcaattataaagtccagtggtgtgtcatagaatcaaactaattaggcaatactagttttgccatgatatcttagcctagtattgctaatttcaatgttcttggaaaaacagtttaggagttatgtcagaatattattgaggttaattttcattaggtacctactcttttaattcagcaactcttatttttatagtagtgggtattgtctaaattatgattaccttgaaatttttatacatttatttgaaactagacatgctcactcaaaaatttcaatgaagactaaacatgtagaaaacgagaaacagtcttaaaacagaagggcaatagggtggagacaagttcgatcatacattaaataatattattaagctgaaataattaaaaatagttggcaatagtgaaagtataactagatagattgatagaagacagaaacaaattacatagagaaaattactgtactgcaaagatattactaatcagggagaaaataatagatttttgagcacataatgttgagtcaattgtctagccacttgaaaaaaattaaccccttaccttattccttagatcaaaataactccaaatgataggcttaaaagattaaatataaaacataccagaaattttcaggatttaaaaaagtaagcttagagtgggtcaggttttctaagcaagaccaaaatttcaggagacattataaagatgaatgcatttgaatataccataaggaagagatatatgaaagcaaatatttctacgtggcaaaaatacaataaaacagcaaaaactaaacgccaaaatggaataaaaagcttcaaaatataaagtcacataaaacgtgactttaatatataaagagctttagtaaaccaacaaaaaattaactctccaaaagaaaattgtgctaatactataatagctaatgttacttatttgttatgtggtagccactattttaatttttatctaggtagtgtgtaatctacctatctacctatgtatctatcattatcaatcaatatatatctgtgggtttcaatacatatttcaagtgattctcacagtaattctttaaggtttgtactgttctttctccaccatccaatgataaaactaagctcaaagataaaactaagtcacagaaaatctctgagcaattttttcatagaaaataaatcatagagctagagtttgatcactggtattctgtctccaaaatgaacacttaaacataattttcaatagactattcaaagagagacatacaaatggattttaaaattattttttcaacccaggcttcagtaataatagagaaaattttgaaatggtattctgaattagcatttttcacctattaacttcagaaagataaaaatgtttaataatacattgtgttggcaaggaagtgaagcaatatttattaaatgaaaaatgcatgggttctctgttatcatttacatatttccaataatttttataaatatatttgtccatgttggcaaacatctttttatggggataaccatttcagcataatctttggtagtaaaagactggaaatgaaaatacaaaaatgcaaaactgtttaaatataatatagtacagccaaacaatggaatactacgtggccattttgcatggacaaaaaacaaggcacagaatgatatgtatgtttgtctgaaaataatgagtatgtacgtgtatgagagtgtttgaaagaacagatgcatagatgcctctataatgagaactgtgatactgaaggacagatgaggaggaaagacttacttttgctgtgtattatttatattgtgtaaaatatttataatttgcatggaataatctccctcgccacacacacacacacacacacacacacacacacacacacacacacacagtgactttcaggtctctctgaggtccagaaatggagacctcttttttctctctgctatgctttttcaaaacttccttccttctaatatctaccaattttgtgaccctgaattttggtcacagttggtctcaatcctgtagtcacacagaaaattatttgaagacatggatttcttaatttatgttccaaattctctgcacattgcatcagagaggtttctagacacatccacaagctatttgatcccctcaactccatcttttattttcagagctctagtctttttaaggtttcacctgctgaggttttgaggttttaaggttttaaggtttcacctgctgaggttcttgtgcattctagtgaaaaatatattttagtgagaaatataattacagctaccagtcggattcaactcctttgtaacttctggttgcagcttagctttaaaaaccattcaaaaaacaatctagagaattaagagtccaagtaaaataaggcttttctcattgccactttaaacctcatatgcactatgcccaccaaatatgaagaatatttttctttgtaggtggcataaagtgggtactgtgggacagtactgtggccacgaggtggcagtggttcaatttactctcattctacaactgcctttaatttcaaaagcatgaaaattactagaggacttgcatttgattggttgagcagccaacagaaaggctctttcctgcattacagaatatgaactaagatacagaagtggcgcctctgagaaaagaaggttggaattatcgtaatttgtttctaggctgagataccagcatggagaaaatgttggagtgtgcattcatagtcttgtggcttcagcttggctgtaagttggaggttaagaaatgagaaccattcgtgcaaagctgaggaagagagatgaagatttaatctcagctcattcagttttcctgttggaatttttcaaagctgctaaactaaaagctttgtataatttctgattttgttttcctgaacagggttgagtggagaagaccaggtgacgcagagtcccgaggccctgagactccaggagggagagagtagcagtcttaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcaggcacagcgttccccaggcacctgcaacttgtatcaaaaccctgcagctgaggatctgaaatgatggcagaggtatctctgctgttcttcctcttgaaggagtatttatttaatgcccaggacctttttccaaatggtcctttggagaatgaagtcatgagacaaagccagagggcagggactactgttcattctgtccaggcatcctagacagtcccttgtgcatgttcatgggtcagtctactcttaataacatcccagaacttccctcacataaattcagaagggccagatgtaatatgaagagtcctggtttccagttgcggactacttggaaaaagactgcacaggtgcatacactccctgccgaaaaaaaaaaaatgtgtgtatgtgtctgtgttgtctcacaataatctggtcacgttaatataagtaaatctttttcattttaatatagtcttcttgaaacccacatctccaccagccacatctctatatttctcatcccttcatcatcaaattacttgaaagaattgtctggactcattctcttaatttccattcttcagtctcattcaaacctggcccctgttagcattactccaagggaagttctcactttaacaccagtggttttggtattgataaggctatcagatatttttcagtactcatcttgtctaagatttgcagcagtctttcctcccttctcattaaaataaatgttactttaatcaaaataatactcacatatatttacaaaactcaacagcactgtctcacaccccagtcatgtctctccattctcaggtgatggtactcacatttatctgaacatttaaagatgctgtttcttcgctttcttctctttctttttgaaattgaggtacaacacataataaggtgaataaaactttagcttacagctcaatagaattttacacttctttgtatctgggtaacaccatccagacctacatattgaaattttccattactccagaagatttccacatgccccttccaattcaacggcccttccccaactctccacctggagtaaccatgattctgcctttcatcacttggtcttacactttgtgtgactggaattatattgtgcagcctatattctactgtctcaatttcttctctcaatatcatatctttgaaattcattaatgtttctgtatgcatgttattttaaaatttatatgtaaaattcccctgtataaatatgtaataatttatttttccattcttcttgaaatagacttttgggttttttagactgtttacagttttgtgccattatggaaaaggttgctataaacatttacttaaattttatttggtggacatataaactcactattcttgggtaattccactggaatggacttgaatggacttaactaggccataaaataggcatgtatttagctttagtggttattatcaaatgtatttcgaaaggctaccaagttgtatgctcttatgaacaatgtatgggagttttagttattccatgtcttcaccaaaaaatggtatcaggtttctttttgtttgttttttaatttaagccattatggtgacatgcagtggtatctcataaaattgtggttttaatttgcttttcctgaagaataatgatcctgagcaccttttcatatgctcattgtccatctggatattcctttctgtctagtacctgttcaagtcgtttgcttatttgtttattgttcatatgtaggcattcttcatagattctggctataagcccctgtcaaaaccatctattgtgaattctccactaatccattacttgactcttcactttcataatgattttctttgagatacagaaattcctagttttggtaaagtccaaataactatttatttttctttattggttagtagtttttgtgccctattgagaaatctttgcctacctcaagtaacagacacactttttttcatgtaggtccatttgccacctcaaatcaattttcgtgatgctatgcaaaaggtgtccaggttcctattgccccatgaccatttaatgaaaagatcttcctttcccccactgaattgcagtggtgtttgggtcacaaatcaggtgatcctacgtgtatagctctatttctgcactctattttgtttcttctgttagttcagcctcccagctatctcataatgtgcttattaatatagctttagaatagaatttgaaactcatcagtgtttttcttcatctgtgttcttccccttattattttatccattctatgtcctttctgaatccatacaaattttagaactagtttctaaattctaaatcattttcacatctacaaaattgcccttgcagttttgattggtattgcattaagcttatagataactttgaggagaattgctacctcaaaaatattgagtcattgtgtcaaaaatatagactatctacctgctaaggtcatctaatgtcttaagcaatgattttagttctcaatgtagtgatttgcacatcctgtatcagatttacttccatgtatagacatttcatgcagatttaaaaattttattttctaattgttgctagtgtatagaaatacaattgggtttttacatattgaccttatattcattgaacttgctacacttactaattttaatcatttggtcatacattattttggattttctaagtccacaatcatgccatctgcaaatgaagaaaaatttgtttcttgcattataatctttgtatcttatttattttcctttccttccttattggccagacttagtggaagagttggccactctatttagatctgcttatcatcccagggaggcagggacttaaaaatgtaaaagatataaagtgagcgagtggtttatggagttctagctattgagtcaaagtaatgactaatgccctacttataaatagactctaaacaacagcatcggctctttccacctccgctttgtgtagaagaaatgcagggggcctagaaaaaagggagcagaagtagaagcttcctgatttaggaagagaggcacaagtgttattttacccacgtcatctggttttgttgtatttaaccctttgggtttacagccttacagtttgcccaatgtgttcaggtgaagcgatacaaaaatcaccgaaggattcctgctttacctggtaccaattttgtcattctcatcatcatctttatcgtcacaaaaactatgaagtaatattaacccatttctcagattgggaaactgaggcttacataagttttgagatgaaagcatttctgagataaagtaaatgctgcaggtaccataaaataagatgaagaaaaacatataaaacttcagagttaaccaactagacagcacttctctaattttactgtacatttaagaatcacatgaagagtttattttaaaaatgctttatttccatagattctgattctataggtctgatacggggtcaggagtctgctttttttagtgagttgtctaatgattttgatcattagatctggagatcttactttgaaaaacactgcaactgggagagtactgcatttcaggaggatggatgatatagacatgcaggagattttgtgttaacttagataacagggcttagggaaccaggaaacacacctgggaatgccttaatgtgggttatgcctattctgattaaactatatcctatcataattagtagaagatactttgttttgatgataaagaagggaatgatttttgtttcaacaacagaaatttatttatgatttgaaaagcagcagagagattaggggatagacaaggccttttagttggcagactttccaagaagaaaataggctaaaacaatatatgagattctccactatgaattaaactttttcattctttattgtcaattaaaaaataaaacttctatatattttaaaggccataaaccaattatcttagtgtttccttcaatgttctaaaatttagacaggttttatctaattattttatttactctttttactctgcctggattctttacaacattttaactttctattaaagaaagttggttccaatactgttaaggctctgtttattacataatatagcacaatagtgctctaaactccacctttaacatgctcatataattccagtatagaccatgctaatactcataattgtttaatgaccatggttaatcttctgctgcatcctcatagccaggctttccttttcctgaatccatgatgagtttggttggtgtgaagactgtaattgactttggtccccaaagctcacctaatattatattcctaatattattggaatacaaatatgtctatttacatttatatatttataatctatatgttacacattacacatttatatttatttatatgttatatgacaactaattattggaatatatttttattttgtcttttggagaatttgttatggaatcaaacagacttatttttcccatgagatcaataggatatattgtgggacattttctgttacgaatttggcaaataggacccaaagctaggaaccaagattcattaggcatccaccatttttcattaagaatggctcacattttaagcacagctgcacttctcaaaaaatttttttaaataaaaaaattaaaaaaagaatggcccacagttggacattctctgtagaggtaagaagcagcaactgaacaggctctgcaacctccaattctcacctcttagctggtgtgaggaggtagcgagggatgggaggagtcaagaagagaatatcatcagagtattccccctttcccacaagccacttgaggggtcagtactccaaaataattacttccaaagacagagatctgctgcataaaaaggaacattgtgtgacattttcatctttgttctgaagcagattttaatctatgtttacatctacttaagaagaagacgaggaaactggagagagatggtggagtggagagggggcagccatggcctgcctgggtttctgcactgggcatggtgaggaggcacgtgtattctgtgggcaggtgctgcctctgaggtgccagggctgagctgtcccgccagagcttcacccggaggagaaagtaaggggctgtggagggttctcctgagggaggggctgacaggaaggggagacacctcccttgaggagcccctgaggtcccctgggtgctctctcatagggacactcaccatacacagccatcagtggtcggccagggaagcaacaacactagaggtgcacagtggttaagtaagaacagttttgttgtttcttccccttaatctttttctttcaccttaatcccgggaagttaaaatcaaagaaaaaggaggaaagaagagaacaaagtaggccatgtccacctcactgtagctcgggatcaggcctgaagtttggagagcagaggaaaggtgaagactggagtgttaaacagaactgccctgaggtttatttaaccactgaaagtgcccagaggtttggagctttctttcctagacctcttcaagggcataaggaccagggcccctctgaaggacccaaccatgcttaagcctctttgatgctcttttctttggcatcctttcctctccctatcgctccacccagaaaatgtttatatagactctggtaggcagacttgcattatatctttgtatcatttcctataagtcagtttatgctggattccttaatttgcctataaagctgaaagttttgaaataagatggtaggaaagacttctttatttttggtttccagctatgcctcctttcctgaaagtgataagcagaaaatcacccaactgcctcaatggaggaaaaattatgaggttaattaaaaataataatataaaaaggcaaccactgttaatattgaaaaatggcttgtcacacatggtgatcattctgaaaccacaaatgaccaaaactggtgaagtcctttctgtaacatcacaggcacgtctaagtgattcttttccatatctgtaaagtaactttacgaaagcaggtgaagacctgcccaggacctgaatgaaagcattcatgtatttagtcacaagagggggctgctgtgtctgtcaataagatgcctgttcagttggggaaagagtgtttggctcacagtcagtagtgaagccatgcagaaactgtgacaaatgatacgctttattctctttgttctaagcagagtagtctgtgcatagcttccaacattcaataactcctggccttgcctcaatccattatgaaaagttttgtttctactcaaaataggacaatatagaaagacagagacaggaagtagttatacagctttcaagttgaattgatcttttttttgtcgtttttgaaatagagaaaagtagatatttttggtggggaagatacttttttttctcaatctatttcatttctcttaaacttgagaagataatgagaaaaagtcttctaggttgctcccttccttcttacagtcccctcctttcttctgtctttcctcttctctgcatttcaattcttagtgtgtgtcaccactaggcacacacatggagaatggggaaaggtgggtcagggatagggtttctggggtgtaaggatgtgtgtgaccccaagtctcttgtttcctttgtaccaagatatgcagtctgtaaatgctctcctagagatagatgatatctagaggcatttcaggcatctggagacatggcttcctgatcaggttctgattatacttttctggtcactttggacacattactgtctgcgtctgagcctcatttcctctttattgttatttagatgggctttctccatcttcttatgatggtataagccttggtagggttttcctgaatataaagaaacttgtgacagagtggactgtactcctgggtaagagtttcaggcctaagaaaagatggtgttctaaaccaagaaatcagaagaggaacctgctgcctgcactgtcttactctccttcacccaagatgctaagggcaaccaatcaaataacagctgttaactttttgaggaggtcacatcctcagtgtgaggggctacatcatacccagtatattagtttgtgccataggctggggacttaaaaatcagaaatttattgtctcatggtctggaggcaatgtctgaagtcaagatgccaacagaatccaggaaaggaggatctgtttcaggcttctctcttcggcttatagatggccatcatatccctgtgtcttcatatcatcttccgtctgtgtatatctgtgtccaaatttctccttttatattgcattagatcccacctcattttacttagatacctctataatcaagaaataatcttgaacccaactccaaataaggtcacattctgaagtacttggcgctaggagttcaacatataaattttagagggacaaattttagcctataaccctcagtgaaagctcacagaagagttttctttgctgtagaatttcctgttttattgagcccaagggaaaatgacagacagatccagggagtcctgcctcttaactagtgagtctacatgaccccagccgtatttggctctttctaggggaagggagtcatacataaaattacttatcagtactataccaggggtcttcaacaagttcatgaaaaatgcatattacaaaaaaattatgcataatttttaaatttttgcatcaaaataaactcctactaacttgtaatgacattgtacacagtatctaatttgaggcactaagaaggatgaaagacaaaacagtgtgaaaagagctcctatcagagcaacgtgaattctgccaatattgaagcaaaaacaagcatcaaatttaaggtaaagcttgggtggaagaatggtgaaatcattgacaagtttatgggggcaattccccaaagaaattagcagtttacaaatgaataactcattttaagaagagacaagatgatgttgaaaatgaagcatgcagcagcagagcatacacattgattgagaggaaaaaattcatcttattcatgccctgattgaagaggactaatgattagcagcagaaaaaatagccaacaccatagacacctcaactggttcagcttacataattctgacttgaaaattaaagttgagcaaacctcccactcagtgggtgccaaaattgttgcacccatatcagctgcagagaaaagcagacatttcaatggaattttaaacaagtgggatcaagatcctaaagcattttttcaaaggattttaacagaaaatgaacacagattcaccagtacaatactgaatacaaagtactgtcaaagcaatgactgccaagaggtggaagtggtccagtcaaagcaaaagtggactggtcaagagcaaaggctgtagcaacaggtttttttgtttgtttgtttgttttttgttttgctcaaggcttgttgcttgttgactttctggagagctgaagaatgacaacatctacttattactagagtgttttgagaaagttagccaaggctttagcagaaaaatgcccagaaaaagctcaccagagagttcttcaccacgacaatgttcctgctcattctttgtgagagtttcaatgggaaatcattaggcctccatctcacaatactgactttctttcttctgacttatttttgtttcctaatcttaaaaaaaatctttaatgggcacttactttttcttcaattaatatataaacaaacctgcattgacatggttaaattcctggactctcagttcttagggatggactaaatggctgatatcatcacttaaaaaagtgtcttgaatttgttggagcttatgttgagaaataaagtttatattttttaattgttaccttttaattccatatttctataaactttttgaaacccccttataccttgatctgaaaaatctgccttgatttgagggtctggggataatctcgtttttctcctcagggattatgtgtaatgttaaagccacaaaagtagggcagtgctgaaacaagaagtgaatataccctgttcccactctaccactggaggaaatgaggacacaatctggtatcaacagtttgataaccatggctcacagtatctgattggaggtttaaagaacgaggtgaccagtcaaatggcttcactgcctgtattagtctgttctttcattgctataaagaaatacttgagactgggtaatttgcaaaggaaagaggtttcattggctgttcaggttccgaaggttgtacaggaagcgtgttgttggtatctgtttggcttctggggaggcctcaggaaactctcaatcatggcagaaggtgaaggcagagccagcacttcacatggttggagtaggaggaagagagagaggacggggaaagtgccacacacttttaaatgaccagatctcaaaagaatgcactcaccatcacaagaacagcaccaaagggaaaatttacccccatgatccaaacacctcccaccaggtctgacctccaacattggggattacaatttgaaatgagatttgggtggggacacagatccaaaccatatcactgcccattcctgtggacaataaggctagtaccctggtcctgcaccagataaccctcaaaggcaccaccatgtgttactacactgtgggcagattggaccacatctgtctcccaggtgaagaggggagataaaatccatttaaagagggcattgcccaagaaaatgtgagattaatggaagaaggtagaaaatgaaatgagaagaaggaaaggggaaaaataaggaaaggtacatgaaatcaagaactgcaccagtaaagaaaaaacaaggagagagaagatcctggatattgctctttctccaatctaacattttcattcttggtaaaggtccggtgtcaagttcataaattgagcattatttttctgagaaatatctgggctctctcgattttttcaactatagcacatgcattgaaaagtaaatgaattttgaaaatttgctaacatgaaatcattatatcaatatttttatttcaacatttccctagttttctatgtacctgtattccatttttatgactaatcactttgtaaattaatgtgtaattgtttaagtatctacgcaatatagaataaaaagtgatacttcattgattttcttctgacaagttcctaatcactgttgggtttcatcacacttccactgtttctatacatttaaatacaaactcacagtaaacatacttttaaaaatcgtaaataggatcacactatatataaaatgctgtggttcaattgaataagagacagaagcttttgcaactcagaaagtttaacccaccttatacttttttgcaagtgtagtaagtaactcacaatacagagctaccataatgtattgactatctatattgaaagaatatttaaatttttttccacttttttaaccattgcatgcaatgtacagtgctgtaagtgtatttataagagtatttcttaagaaaaattcctggccaaatggaaattttgcattcagtaatatgtaaataacatatgtagacatttattaattatatttcagctatcagaatatcagagtatccatttcctgacattatcaacaaaactgaatattaatagtatgattctgaactccttttgcaatatgacaagtaagagatgatagaaagggccttttcacaaaaatgcaagttacgggaaaccagtccttaagcactgaagtggcaagaagagacagcagtcagaggaatctggagaaagttgctgtaacagtatggaaaacatttatatattttttcttttctaacataagcatttaagaatatatatttctctctatgcactgatttggctgcattctacaaatctcatattcaaacatttttgtttctttaggagaaggaggaggaggtgaaagtggaggagaaagaagcatttctctagcagtactgtgcttggttctgaagtggcagtgttttcatttctttcattccatttccacctcccacattttgcagatctgtgtgtgtgtgtgagagagagagagagagaggagagagagaggagagagagagagagagagagagagagagagagagagagagagagagagagagacttgtctcagattggctgggccaactctgtgtttcctgtagaaatgtttgaacatatgagagagcaaagcagagtgtttatcttgtgagccattctccatatttcagatataagatttcagttctcagtgagtctaagtgacagaaggaatggagaccctcttgggcctgcttatcctttggctgcagctgcaatgtgagttagagggaaatggaaatgagcaaagagcaggctgactccaggacgtttctcccaggaaagagggagaaagaaagggagttgttatgcctgtatggtttactgggaatttctgtggaaattgaaaaaataaatttaaaggtaatttctaaggaatcattagccactaaccagtctattgctctttttctgaacaggggtgagcagcaaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgaggcacagtgcacaacaggcacctgcaaccaatacccaaactctatagctggggctctaactgcatgttttatcttgagactgagcaatgtttttgcattaagaggacttctaaattgacactgtctccacacagaagcaatcaaatacacaaaacttgatgtaataatctgaaattaaactatgaattctctgatctttagatttttatcaattttaatataaataatagttttatttcaattaatttacatgccatgaagttcagtcttttaaagtgaacaattaagtgttatttagtgtattcacaatgttgtgcagcttttatctctgtgtagtttcaaaaactttttaacatctcaaaaggaaaccacatgtccattaagcagttaccttgcccaccctcctcccagcctctggcagccaccaacctgttttcagtctctatggattttcctattctgtacatttcatataaatggaataatatagtaggtagtggcctttgtgtatggcttctctcacatggcataattttctgaggtttattcaatgtaggaaggaccagagaaagctaaatatgcacatctaaccaatgacatgcttatatcttccccatgcaagagcctccaaccagggcatacctgaagctttgttagttttcttccactctaaagcttccctactcctctgcctatctttaagtctctgccaaacacaagggacggtagctgattcctttggtataccaagctctgaataaattgcctttgcttttttcatttaggtggtcttcacttatatccacagaactattgtaaagacactgagtttttcttccctgccaagttctcacttcaccataagagtcactttgcacatgaaaaattaatgaatcaccataagaaatgttaaagctggagggcagcttgtcctccattcagataggtcattgaagcctacatcaatcagatagtacttcttagataagtcagagagatgcattgatgtaaagcccagttctcaatatttatgtgtcaaactctgtcctcaataaaagctcgaaactccaaacagatatcttggccttcctggaagattttcttatcaacaagtccttgttctcatttatttcttttactaaatattcaggctccatattgtgtgatgaggagtttgcattcacaacctctgccatatctgggctacaaagctgctttctttcttgacattacaaaccaactcgtgggtaagtaatacattcagatatatgagctataaaggagcttaaatagtgggggacttcaccaccccactgactatgttaggaagatcatcagggcagaaaactaacaaagaaattctggacttagggccgagcgtggtggctcaagcctgtaatctcagcactttgggaggccaaggcgggcggatcatgagatcaggagattgagaccatccttgcaaacatggtgaaaccctgtctctactaaaatacaaaaaaattagccaggcgtggtggtgtgtgcccgtagtcccagctacctgggaggctgaggcaggggaatcacttgaacttgggagacagagattgcagtgagcggagattgcagtgagccgagattgcgccactgcactccatcttggtgacagagttagactccatctcaaaaaaaaaaaaagaaaaaaagaaattctgcacttaaacttgaccaattggatctgacagaattttatagaatacttcagtcatcaaccacaggatatatattcttctcattggccataaagcaagcctcaataaatttttttaaaaattgaaattataccaaccatactcttagacaacagtgaaataaaaatggaaatcaatactaaggagatctctcaaaatcacataattacatggaaattaaaccacttgctcatggatgattttagataaaccatgaaattaaagcagacatcaaaaaattatttaaaataaatgaaaacagagacaccacatacaaaaatctctgggatgcagcaaaatcagtgataagaggaaagtttatagtgctaaatgccaacgtcagaaaataagaacgatcttaaattaataatctaacatcatatgtagagaaacaaggaaaaggacaaactaactccaaagctagtaaaagaaaagaaataactaaaatcagagcagaactaaatcaagacacaaaaatccatacaaagcataaataaaaccaaaagttggttctttgaaaaaaaataataaacaagatgtatagactgctagctaaattaactttgaaaaaaataataaacaagatgtatagactgctagctaaattaacaaagaaaaaaagagaagttccagataagcacaatgaaaaatgacaaaggcagcattacaaatgataccacagaaataaaaagatcctcagaaactattataaacacttctatgcacataaactagaaaatctagagaaagtggttgaattcctggaagcacacaatcttccaagattcaatcaaggaaaaaaattaaatcagtcattaagaatctagcaaccaaaaaaacctcctgggccagaaggattcacggccaaattgtaccacatggacaaagaagagcttgtaccaatcctgctgaaattattccaaaatattgaggaggacggacaccttcctaactcatgctataaagccagcctcaccctgaaacaaaaacatggtaaagacacaaagaaaaaagaaaactacaggccaatattcctcatgaatctagatgtgaaaattctcaacaaaatactagcaaaccgaaaccagtactacttcaaaaagttaattcaccagaatcaaataggtttcattcttgggatgcaagttttgttcaatatatgcaaatcaataatatgattcaccacataaacataattaaaaacaaaagccataagatcatctcaatagacatggaaaaaacttttgataaaatccaacatcccttcataataaaaacctttaacaaattaggcactgaagaaacatacctcaaattaataacagccatctatgacaaacccacaggcaacatcatattgaacaggtaaaaactgaaaacattcctcttgagaactggaacaggaaaacagtgaccctcttaccactcctagtcaacatagtattggaagtcctagccacagcattcaggcaagagaaaaaataaaagactttgaagtaagaaaaaaggaagtaaaagtatctctctttactgacaatatgattctatgcctagaaaatcctaaagactctgccaaaaactctgccagaagacccctggaactgatcaatctttcacttccttggttagatggattcctgggtatttaatttttttgtggctatggtaaatggtatgagagtgaaagatctctacaaggataactacaaaacactgctgaaagaaatcagagtcaacacaaataaatgaaaagccattccatgctcatgaattgaaagaatcaatattgttaaaatggcaatactgccaaaagcagtctagagattcaaaactatccctatcaaactcccatcattatttttcacatgattagacaaaactattctaaaattcatatggaaccaaaaaagagcccaaattaccaaagcaaaaagaacaaagacagaggcatcacattactcaacttcaaattacactataatgctacagtaaccaaaatgataatggtagcagtacaaaaacagacagatagaccaacggaacagactagagaactgagaaagaaagccatacacctacaatcatctaatcctccacaaagccaaggaaaacaagcaatggggaaaggattccctattcaataaataaacagaattaaaaacaaaagatttacagtaagacctcaaactatcaaaatttcagaataaaacctaggaaatacccttcttgatatcagtcttggcaaaggatttttggcttaagttcccaaaagcaattgcaacaaaaataaaaattgacaagagggatctaaataaggagcttttgcctagcagaagaaactatcaacagagtaaacagacaacctacagaatgtgagataatatttgcacactacacatccaacaaaggtcttatatccagaatctataaggaacttaaacaagtcaataagaacaacacaaataactgcattaaaatatggacaaaggacaagaacagacacttctcaaaagaagatacagccaagtggccgacaaatgtatgaaaacaattctcatcatcgctaatcatcagaggaatgcaaatcaaaaccacgatgagataccatctcataccagtcagaatggctattattaaaaagtcaaaaaataacagatgctggctaggctatgggaaaaaaggaacacatactctgttgatggggatgtaaattagttcagccactgtgaacagtttgcagagcagtttggaaatttctcaaaaaacttaacttaaaatagatctaccactcaacccagcaatcccattactaggtatatatccaaagaaaaataaatcattataccaaaaagacacatgtactcgcatgttcattgcagtgctattcacaattgcaaggacatggaatcaacctaggtacctgtcaaatgtggattgaataaagaaaatatggcacatatacaccatggaatactatgcagcgacataaaagaatgagctcgtggcatttgcagcaacatggatgcacctagaggccaaatttctaagtgaattagtgcagaaacaggaaaaccaaataccacgttttctcacttgtaagtgggagctaagcattgggtacacaaggacacaaaactggggaacaatagatactggggtttcctgacaagggtaggactgaaaaactacctattggatactatgctcactacctgagtgacaggatcattcataccccatacctcagtgtcacgcaatatacccatgtaacagacttgcacataaaccctcaaacctaaaataaaagttgaaattgtaaaaaaattaaaaataaaattggatatagttatgaaaaagggggcttgactagtgctactttaatagctattatattccataatataaatgaacttctattgttaatgacaattaatgaactacattgcaagaataaatgtgagagttcacatttgaaagaagttgaaagaagttactttctcctgcacatggggtaacagcatcttaggtaggcaaacactttgctgttggcaatatggcagtgaacagttacaatttaacagggaagatgtatacacacaacaaagcaattcaaacaaatatataatttcaatgcatgataaggacaataaattttaaaaatggatatgaaagatgataaaattgtgtttactttggcacggtggggattatgctgctggtggtcagagaaggcctctctgagaaaatagttacattgagatatgtaggaaagattgcaatagcaaagttaaggttcctgctaaaaagagctgcaggcagagagaaccacttgtacgatacagtgaacttaatcaataaatcttttgtgtgtgttctgacttctccaccaagtgaccgtttgcccctctctttctctctctgcaggcctttctatcccctaagacataacaatattgaaaattggctaacagtgacttctaactgttcaagggaaaggaagagtcgcatatttctcacattatttatttttctttttgtggagatggggtctcactatgttgcccaggctggtctcaaactcctgggctcaagcaattctcctgcctttgcctcccaaacagctgggattataggtatgaaccaccacgatgggactctcattttaagtcaaaagctagaaatgattaagcttagtgagaaaagcatgtcaaaagcccaatcaataagctgacagatagacctcttgaactaaacagccaagttgtgaatgcaaaggaaaatttattgaagaaaattaaaagtgctactccagttaaacacataaatgataagaaagtaaaacagccttactgctgatatggcgaaagttttagtgttctggataaaatatcaaaccagttacaatattcccttaagccaaagcctaacgcacagcaaggccctaactctcttcaattctgtgaagcctgatagaggtgaggaagctgccaaaggaaagtttgaagctacaagaggttgtttcctgaggtttaagaaatgaagtcatcatcatgacataaaagtgcaaggcgaagcaggaagtgctgatgtagaagctgcagcgagtttccagaagatctaactaagaccactgatgaaggtggctacactaaacaacagattttcattgtagacaaaacagctttctattggaagaagatgccacgtaggactttcatagctagagagaggaagtcaatgcctgacttcaaaacttcaaaggacaggctgattctcttgttaggtgctaatgcagctgatgactttaagttaaagccaatgctcatttaccattctgaaaattctagggcccttaagaattatgctaagtgtactctgcctgtgctctataaatggaacaacaaaacctggatgacagcacatctgtttatagcatgttttactgaatattttaagcccaatgttgagatctactgctcaggaaaaaaaaggttcctttcaaaatagtactgctgattaacaatgcacttggtcacccaagagttctgatggagatgtacaaggggattaatgttttcttgcctgtgaatgtaacatccattctgcagcccatggatcaaggaataattttggctttcaagtcttactatttaagaaatacattttacaaggccataactgccatagatagtaattcctctgatggtctcagcaaagtaaattgaaaatcttctacatgataccattaagaacatttgtaactcatggaagtaggtcaaaatatcaagattaacaagattttggaagaaagtgattccaacactcgatgactttgaaaggttcaagacttcagtggagtaagtaactgcaggagtaaatactttagtggaataagtaactgagataattttgaaatgatattgatggttcttgtatattttaactatctaggacactgctgtagaaagcttttaagaatgggagggaaatcatgggtttggcatggttaagttgttttctttcctggaggcagtaaacgagttgaaaggctcttgaggtgccctctggagctcagaatttttaaatgccagttttaaaaagatccaaatgattatcaaaatatagtggtagatagcaggagaactagaattagaagtggaacctgaagatgtgattgaattgcttcaatctcatgataaaactaacaaataaggagtttctttttatgggtgagcaaacaaagtagtttcttgagatggaatctattcctggtgaagatgctgtgagcatcgttaagataacaacaaaggatttagaatattttataaacttagttgataaacccatagcagggttttagaggcttgacacagattttgaaagaagttctactatgggtaaaatgccatcaaacagtattgcaggttacagagaaatctttcatgaaaggaagtattaattgacgcagcaaactgcattgttgtcctattttaagaaattgctatagtcaccccaaccttcagcaatcacatcctgatcagtcagcatccatcaacatcaaggcaagaccctccaccaacaaaaagattatgacttgctgaagaatcagatgaccgttagcattttttagtaataaagtacattttaattaatgtatgtacattgtttttcacagtgctattattgtccacttaatagactacggtgtagtgtaaacatagtttttataagcactgagaaaccaaaaagtttgcatgactcaccttattatggtggtctataatcagcaatatttcagaggtatgactgtatttgactttgccatcaactcaatgacttacactccagaaattgttattagcagaagcataccaaaggtcaggcaatgggagtggtttgtcccagttgcaggtaataacagggtgctttatagagagctttttaaaaacaatataaaaatgattaatagccaatctgatttttattaccatatgccaggaattctaaacaatgtcaatgataaaaaatattttttgacctaagttctaaacaaatgcagaggttactatttattttaataataaatgtatgcttcaaattatcacatttttatttcttatcatgtaataaacagttttctacatggaagttattttggagaattctcagttttgcagctgtcttcaacacacatggattgtaatacagcgattttccatgtaccttttatccagtttcctctaataatatattatctttgatatgttgtatatatatcaaaacaatgatataattacagccagaatatggatgtcgatatagtcaagatacagaacatttccatctctacaagcatcctcatgtttcccttttattagcaatagcaacttccattatgccaccatctactatttaacccctggcaaccactaatttgttctccatttccataattttatcaagaatgctatataaatggaatcattcaggatatttatgaacatgaatatttttcactctgcataattatctggagattcatacaggtcgttgtatatattaatgtttcattccttttcattgctgagtagaatttcatagcatggatatgccagtttgtgtaaacattcacttaatgaaggacatttgggttgtttccagttttgagctattatgattaaagcttctataagtgttcatgttcaggtttttgtatgaaggtgagtcttcgtactctggaatatataccaagtagtacaattactgagacatggagtaagtgtatgtttagttttataagaaatcgccaaagtattttctaggttgctgtactgtcttgcattcccaccagcagtgtttgagtaatctaatttctccacatttctgctagcattttgtgttgtcattggttaatacttcagcaactctaagaggtatggagaaatcattgtagttttactttgcatatttctaatagccagtgatgttaaacatttttggtttttctttcttttttaaattaactaaagcccacactttattcctatttcctttgtttttgccaaatgtcctttttatgtctgcagggtctgtaataacactccctgtttcattcctaatattagtaatttgccttttttttctttgttttactacaagtttgtcagttttacccatctttttaaaaacggctgtttaatttttgtttctgttttcagttctattgatttctgcttttatcttgattaattccttccttaaatttgctttggattaattttttccttctttttcttggttcttgaggtgggaacttagatttttgtttggatacttttttcatttttaatatttgcatttagggatatacattttctctcaatgctgctttgactatgtcctacaaattttggcatgttgtattttcatttccactcggttcagtgtatgattgatttcccttgagcttctttgatccttggattattaggatgtatgttgtttaattttcaaatatttggagatttttctgctctctttctgatatttacttatagttgtattctattgtggttataaaacatagtctttattgtttcaattcttttacatttaattttttgaggtttgtcttgtggcctaagatatggcatacttggtatacgttctacaggcatttgaaaagattgtttattctgccattggtaggtgccatgttctagaaatggctattagatcctgttggctagcagagttgttgagttcgtctatgtccttgctaattttctggcaagctcttctattagttattgagagtggggtgttgaagtttccaactataattctagaatcatcggtttcttctttcattactatgagtttttcttccatgtatttttcagctcttttggttggtgtatacacatttagcattgctattccttcttgaaagactgaccctttcaacaatatataatgttcctttctgtctcttctgtctctggtactttgctttgctcagaagtctactttacctgatatcgatataattattttgactttcctttgattaatgtttgcacgatatatattttactttctttctttctttctttttttttttttttttttgagacggagtcttgctcagtcgcccaggctggagtgcagtggcgcaatcttggctcactgcaggctccgcctcccgggttcacgccattttcctgcctcagcctcccaagtagctgggactacaggcgtccgcgaccacgcccggctaattttttgtatttttagtagagacggggtttcaccgtgttagctaggatggtctcaatctcctaacctcatgatccaccagccttggcctcccaaagtgatgggattacaggcgtgagccaccgcacctggcctatattttactttcaacatgcctatgtcattaagttagaaatgaggtcttcgtagacagctgtagttggatcatatttccactcttttcactttctctgtattttaactctcttttcattgctgtttgtagaccaatctctgtatcttaattggtatatgtacatcatttgcatttaatgtaatgtatattttagtgattaatcttccatttaattttgtttgttctgttttttgtttccctgtgttttatctcctaacttcttgtgaattatttgacattttctaaaattccattcaatttacctataatgccttggatgtgtatttttgtgtagctttcttcagtgtttgctctaatggctattataaatagataacacagttgtctattggtgatgtcattccaccaatttaaatgaagtataaaaacattgtctccctttacattcagttgtcctcaccaattcatgatacagttttctttatgttttccccaatatatatttagaacctcatcagacagtgttattatttttgcttgatccatcaaccataactgtgaattaaaaaaattgatcaaacatgtttggagtaaagacttcattatcttattttctctatataggaaatattacaaatttattgtcatatgaagtcaattaagaagtatggaaccaaaaaatataaaaacaaaaaatcttaattctggcaaggacgtggagaaaagggaactcttgtacactgttagtaggagtgtaaattagtataaccactatggagaacagtatggagtttcctcaaaaaactaaaacctgagctaccataagatccagcaattccactgctgggtatatatccagaagaaaggaaatcagtatattgaagaggtatccgcactcctgtttgttgcagcactgtttacaacagctaagatttggaagcaatctaagtgtccatcaatacatgaatgaataaataaaatgtggtacatatacacaatggagtattattcagccataaaaaacaatgagatcctgtcatttgcaagaacatagacagaattggagctcattatgttaagtgacataagccaggcacagaaagacaaacattgcatgttctcatttatttgtgggatctgaaaatcaaaacaattgaactcatggacatagagagtagaaggatggttaccagaggctgggaagagtagtgagggaatgaggggggaggtggggatggttaatgagtacaaaaatatagaaagaatgagtaagacctactatttgatagcacaacagggtgactatagtcaaaagtaatttaattgtgaattttgaaataatgtacagttaaactaagagtgtaattggattgtttgtaacacaaaggacaagtgcttaaggagatgaataccccattctccatgatgtgattatttcacattgcatgcctgtatcaaaacgactcgtgtacccctaaaatatatacaactactatgtacccacaaaaattgaaaatttaaaaataaagtattatagaagtgtgtcagataaacaaggaaatatgtaaatttctgaattctgtatttatggtattcgtgttttaaaatttatagtttgttgtgattttctgacctaaaattatttttgtacccagttttattcttatttttatgttattctttttaaaatcctccatcttgtaagtttcaggcttacaaacataaatcctcctttgtacattatcataaatctttgaaattcaacactagaagggcaggaaggatgtggaggaagttcacaaaaattgtgaatttctcttagccctctatttggcccctggagggtgttgttgcctaaattggaaatggcttttctttaaaagattagaataagctccttccttctctacaggttaaagaggtgtcctttctgactgagcattcttttagacagcgatgtataaagaatctcagacaccagaggcaggcaagtttgtcaagagagcatctcttactagcagtttctacaagatccctaagaagaagaaatctaaatccctgccatttctccttagtttcaacctggattcaagttaccccgtggtcagattgtgtctgtggggaatctcctggaaaggtgcatgctgctccctcagtgcttggctagatctcattgtgtgtcttgacgcttggggtactcctgttcccaagtgggtatcattccattttactctcttgtccacaaatggagcattgtctatttgactctgaatacggactttttgtgttagctgagttcactgacatagcattggcattgtaggaaaaaccactgcccattctgtgactcagcctgacgttcatgtcgctgtctctgaaggagcccctctggagctgaggtgtaactattattgatcttctgttccaacatatattttctgatatgtgcaatacctcagccaaggactccagcttctcctgaagtacctatcaggatatagggttctttcaggaattaacggttttgaggctgaatttaagaagaatgaaaactgcttcctcctgaggaaaccctcagcctattggaacgacacgctgagtacttctgtgctgagtcccgcattgcccaggactgtagtgggggctacataaaaactacctgagacacatagcttaaacaactaaggatctcagcctcagttattttcaggaagttgacgtgttctgtgaaagcaaacagtacaaagaaagtagaatcctgtctagcatttagttcctatggacatcttagatttctttaatttattttcttatttgccattttgcaaaggaaagagcttgtacctgattctagaagaaattagactataggatttgtaacaagcaggaggaggtgatttgcaccaaggtatttcagatagtgatggactgggatgacttaaggttggccatgtggattggtataaggcaaatcaatttgcttttagttattaatctcatctctcaaacaatcagaaacccagaatgagtgtttatttcaagctgcattatctacagattattttacccagtatcctgacttcagtgagctacagtcctttgaggaaagaagcctcttcaaaggacttcagctcactgatgaaagtatttgagactgggagacttaattaaagctgacatttaaggatgtgtgcaaggcaatctttccaaagacaatataaaagggaaaaaaaaggctttatttttttaatctggtggtccccagcgaaaggcagtctaaattaaacacaacatcatggcagagttccatgtggaatcttggggttggttgttctatggatgacctaccctttatcagttctacccagattacctctctctgtttttctccctttcaattcaatttccctaatacttgctgagtgtccaataactattgttgattccttaaccatatttaattatttctctacaccattcctcatagtgccaatagtaactatttgcaacgttcttgagcagttaatccaatgttgtgcctgcagaacttttatttctacttcagtaaaaatataggtgttcttatttttcaccccctttacctccaaatccatttccagattattattatttatggagtctggggcaaaagcaaaaacaaattattttcataacttttaaaaacagctaattttcttttaaaccattagaataatctagtaaacctaaaaagcaaaatataaataataattaacaatgaatagctttaataaaatatatttaaataaaattagaatttatttgtttttaagtttaattcgatcacagtatttaaaataaatgctagtttcaacattcatctagtatataaagaagctaatcagtgtcactctttatgcagattcaatctaggataaaatatatgcaatttaaaactaatgttgttgaatattacaaagtgttccagccatcatgagcaactatagtgaatactatgctgattcatgagtaccctgaagaaccacaaatgagtacataagagatgcaagaaaatagatcctcagcaccctcgggaaacagtatttctttttgtaagaatctattgcctccgtgctgagaggaaagatggggctagctaattaattttttccttcccttccttgaaacccctccacccttggccccaattccaaatcagagtcatatgaagtcaattaagaagtatggaaccaaaaaatataaaaacaaaaagtgttaatgctggcaaggacatggacaaaagggaacccttgtacactgttggtaggagtgtaaattagtatagccactatgaagaacagtatggaggttcttccaaaacctaaaacctgagctactataagatcatatttacttatttttctacaccattcctcacagtgccaatagtaactatttggaacgttcttgagcagttaatccaatgttgtgcctgcagaactttaatttctacttcagtgaaaatataggtgttctcatttttcatcccctttacctccaaatccatctacagataattattattattgatggagtctgggggaaaagcacaaacaaattattttcgtataaacagagtctgcctcctatggcagcagtggcacaacccacaaatatttctaatatttgaaaaggacaaaggtcaaggtatgtgaagaagtatttttctcaaatctgaaaaattgtgttagtggttttttaggttacagattgtgcccggtcctgagtgacagagacagtccgtgttcttcagtacatttgcgtgtgtgtgtgtgtctgtgtgattgagtggccctgtaaaatatgaggctctgggcagggctcttgcctgagtctaagggtcatactgtccacaaccttgctcatcttctgtccttcttgtatttaaaacaaagggtcacttttcaaagtttgccatctttgcttttgttactctccagtctcgtcacctccacagaaggcatgtagcatcacatcccccatcaagtcacatcctgtaatagaagtttgacataattgttactgtcttggtgctcatgtggtgtttaaggatgctttttaaaaatgatatcctgtaaacctttattacattcagagagatgtttgtctcctcactatatcacaagctctctgaaggaaaaaccgtatccaattcatttttttttttaatttccaaggtctcaaacactcttaaatatattgacttaactataactgaatcaaattggtgagctcatattttttcagttcatacgtatgaattaaatggatgttctaattacataaaattacatttaaagtatttatcttcataaaagccaccgtggggtctcatggccctatttatggtactctccattctgtggacacttctgttgtttcatgtcaacccacaggtacagccctaggaaaagacagctgggctgagctgtccatatatgctgaggaagatgtagtctttctcaaggtttagcacgtcaggaggcatataggcttctcttaaattgagggacggctctgaaggatctagtagtgaatagttgttgaaagatttgagaaatatattgagtataaggatgagggccagtaagagtaaagagggaagaataattatgtgcaaggacaaactaaatcattatcagcacataagaaacatatttttgctgagtattcttttcaattgtagctctgtcctctaaaacaagataaatgacatatgaatattcaagttctaggttatatttgaaatgcatatatatatacctatatttaaatttttgtctttatattattatctttatctgtatctatcagaaaatcctggatcaaacagaatcatatacagcaaaagggaaagtggagaattccaaagaagggaattcggattttaaaaaatttttatttcctaagatttcctaagaaaaaaatatgaacttttatttcacaggtccaaaattatttctaaactgttgaaagccatcttttctttagtattctcctgtccctttcatgtaactagaaccccctaccctcaaccaaaaataaataaataaatagataaataaataagtaaataaataaaagagagagagagaaaaggaagaacatggaaacagaaggtaatgataggagaaagtggaaggaaaaaaggaagacagaaaaaaaagaaaaaagatttactggactgtaagataagctataaaggaagtttgtataaaataagaattagaaaaataaaacatattgcccatccagggtaatacgtagaaaaaaatttgatttgatcttattttttctctcacaatttacagtcttactagggtcatttcttataacaatatttaccacaattcttgattatttcagaggagtcctaatccacacttttcatatattctaataataaaaattattacatatataatacataacatgtatgtccttattactttacatgactggaatgactttcacctaaattggctaataaagaccttcttgtcagaacacattcttgttttgggggtttaaaatgtggacactcattctgtgatcctctccaggctcgaattagtattacagttgaggcacgttgtcctcccgaggaggcccctccctttccttctcacaggatctttcacattctttactatatccagaactattagaaaacatccctcaggttacggaataatgacctttctttttcccttccactccacccctttccaccccggctctcagccaggtttaagtcggcgggtggggcttcctgtcacagaacgctgtttaaaaactcagtagcatctgggcgtgagcaggctttgtcgggtggagctgattggttgcaggagcagcaacagttccagagccaagtcatgacaccgacctccccaaggtttagttaaatatatcttatggtgaaaatgcccggagcaagaaggcaaagcatcatgaagaggatattgggagctctgctggggctcttgagtgcccaggtttgctgtgagttggggctgtccaaggtgggaatctgaaaggatttagcagctgcagccttgttgaggggaggaagggcaaggagttaaaaagtcatgcagtctttctactcacacagcctgtgggggcattttcaggattcttcagatgttaaactgcccatcacctatgactttttctccatttctgaccaggtgtgagaggaatacaagtggagcagagtcctccagacctgattctccaggagggagccaattccacgctgcggtgcaatttttctgactctgtgaacaatttgcagtggtttcatcaaaacccttggggacagctcatcaacctgttttacattccctcagggacaaaacagaatggaagattaagcgccacgactgtcgctacggaacgctacagcttattgtacatttcctcttcccagaccacagactcaggcgtttatttctgtgctgtggagccacagtgctccccaggcacctgcggcctgtacacaaaccctcatccgggctcggttcctctaccagtaacaaccacatcacgaggccaccgcagcagcattttgcacagcttaatattccttttgtacataggtagagttttaaccgtagattctttttggctctacaggtttgagactttggtctttattttcccttttcaatacacacctcctcctaccctataaatatctaacttggaaggagtagagtagctgataagaggacagaatcaaaataaatatttaagtgacagtatgcaggactccaaaagggtaaaaagtaaaaagaataaaaagaaaagaaacaccattccaataagcatgttgttagacattagttagacagtgatccagcttagttgtgtgtctcaagcacattcaggtctacctcaccacattatgtaccaacagacaagggcaaatatttgcatactatcccactagtgcagcaaagtaaaatttctttaaatattcacatattgataaatagctgtggagaaaaaactttaaaatgttatgttcccatatgtgtttttcaggcttgttgtataacctagaatatgatctatcctggaaaatataaccatgcatgattgagaagaatgtgtaatctgatcttgggtagatagatgtctgttaggtctacctggcttttgtgttgttcaagtcttctatttccttgttggtattctacttgtcctatctattattgaaagtgaggtattgagtcttcacctgttattcttgaattttctgtttttcccttcaattctgtcagtttttgtgcatcatgtattttgggatatgtcattaggtgcatatatgtttataactgatatattcttaatggatgcccttttatcattataaaatttcccattttatctctagtaacattttttggtttaaagtatactttgtctaataataatgtagtgacaccagtcatatctttacctatcctttttactttcaacttatgtgtatctctgtatctaaagtgtgtctctgacagtgtatagatgtgtgtgtgtgtgtgtgtgtgtgtgtgtgtgtagccactctgataatctctactttttgattggattggttaatccattaacatttaatgttatcattgatatagattatatctggcattttaattttattttctttctgtcttatgtcttttttgttcctctgtaccgccttaactgctttcctttgcattaggtgaatattttatagtataatattttcattcctttaatttttttcactatgctttttcaattattttcttggtggatgttttagtacttacaatatatatacatctaaacttgtcagaattcacttcagactttatgctaacttaactccaatgggattttcagatgtcacttctatataggtctatttcttattccctttattattgttattcacattatatgtatatatgttacaaacaataggttattataatttttatataattttataattatttctttatataatcttatgttttataagcagagaaggaaaaaaggaaagcaaatatatattgaggtgtttgtggttaaccttcttacttatcatttctgggtctcttcatttgttcctgtgcacttaatcatagccaaaaggtcaagaagtgatcatttgttcctgtggattcaagttgccatctggtgtcactgtcttactccaatatagttttgcaatctgccttcctcctttattcttttattatcaaatatgttacattcctgtaagtccaataatataattatatatgtattgttttatacagtagttatttaaatcagttaatagtagaaaggggataaatatgcagtcacactatctttttagtaagtgtgtggatgcaaattactgtttgaagtcccttgctcccagcctgaagatcttcctttattattgcttgaaggtgagtctgcttgcaataaattctctcagtttgtatttatctaggaatgtctttattttaccttcatgtctgaaagatacttttgctgaatataggatcttcattgatggtatatttctttcagcactttgaatatatcttcccactgccttctagctctgttgtttttgttgagaagtcagctgttaattttattgagtttctctcataaatatttgatttcctctttctactttgaagattctatttgtcttttaacatttttgctatgatgtgtctgagtgtggatctctttgcattcattttacttagagttcactgagcttcttagatgagtagattaatgcttttttgaatctgggaattctcagccattgtttcttcaaatttttttgttccttttcttcctttcctttttctggtactctcactatgcgtatattggtgtgcttaatgatgtaccacgtttctctgagtccctgtttatttttctttattcttttttctgtctgtttttcagattgcataatctctgtagatgtatctttaagttcactgattccttgttcagggagcctgaacctactgtttgaccctccagtcaatttttttatttggttattgcactttcccaactctagaatttctattttgttcctttcataaaaaaataatttttaccactttatagatattctctggctgataagaagtcatcatcatatcttttttacttccctcagcatggttttatttctttgagcatacttaaaacagctattttgaaatttttgtctgtgaaatccaacatctaagtcatagaaaaggaagttgccattacccaatttatttctcttgtgtaagaatcacactttcctgtttggggtatatcttataattttttgttttaaactagacattttagataacatattatattagttttctatggctgctcttatgggttgaattgtgtttctcaaaattcaagatgaaatcctaactcccagtacctcagaatgtgaccttatttgaaaatagggtcattgcagatgtaattagttaagataaagtcataagaatggaccctaattgtgatggttaatgttaggtgttatgttgattggactgaaggatgcctggataactggtagagcattgtttctgggtgtgtctgtgagggtgttgccagaggagattgacatttcagtcagtgaactgggagaggaagacccacactctttgtgggtgggcaccatccaatagctgcgcagctacaacaaagcaggtgaaagaaggtgggaggcttctggctgcctactttctcccatactggaggcttccttctgcttctcttgtccttgcgttcctggaccaaactgaggtttgggctgctatttttttacagacaaataacgagatgcagatgaactggggaggaagagagtttttatttctgtagtcagttacagggacatggcccggaaattattgccagactaactcaaaattacaaagttttttcagagttttatataccttctaagttatatgtctacatgtaagtgtgcattcatttaaagacataaatgattaacttcttttaatttataactaaggtctgagtcctgaagaccttcttctagagtctcagtaagtttatttaacctaaatgggtttaggtgctggggtgattagccttatctggtcttctgccaaatcacagaggtttggggagttccttcagacctccaataaatgtgtttgtggaggcctagcgagtttcttcagaccccctataaaacttgtttaatcctaaagaggacctgttaagaattactcctttattttgtcatgcttaaaagcccaggaaagtcccaggcaaaactcttggtgggcttttgctacattccagcctttgtataagggcactggcttttaatatttatcttaaccactcagtcagtaccgaaacagttgttatggagtcctgccacacttggacatcagactccaggttctttggcctgtggactctgggacttgcaccagtggcttgcaggtggctctcatgcccttggccgtagacagaatgcttcactgctggcttctttggtttgaggctttcgagcttggactgaaccactaccagcttctcttttccccagcttgcagatggcctatcatgggacttggccttgtaactgtgtgagccaattctccataataaataaataaataaataaataaagtttattagggagaattggcacacacaattacaaggccaggttttatatatatatatgtgtgtgtgtgtgtgtgtgtgtatgtacatacatgtatacacacacatacacacacacacacacatacacatatatcctattagttctggagaaccctgaccaatacactaatctaatatgactggtgtcctcataaaaagtgaaagtttggaaacacacacacacagagggagaataccatttaaagatgaaggcagagatcagggtggtactccaacaagccaaagaatgctaaagattgccagaaaaccacgagaagctgggcaagaggaatggagtagattctcgtagccctcacagggagtctctcagacttccattctccagaaatgtgaaacagtaagttcctattgtttaagtcacctagcttgtggtactttgttatagctctagcaaactaataaagctgctataacaaattactgcaaatttggtagcttaaaaccaaacaaatttattctgttacagttctggaagcaagaatctgaaaccagttttacagggctacagtcaaagtgttggcagggctgatttcttctggaggctctcagggagaatctgcttcctggccttttccagcttctgctgtccacctgaattcatggctcatgctcttttttgaatcactccaaacttttgcttccatcatcacatctcctttctcttctggagccacatcttcccctgtttccctcttataagagcacttgtgattatatttagggtccactcaaataatccaaaatatttttcccatctcaagatccttaataatgtattcaaagacatttttgccatataaggtaccatttgcaggtaccaggcattagggcttggttatctttggggatgataatccaggctatcacatatagtgactctggatattgtgtctctaccccatccagggcttgttgttatttgcttgtttatttattgtaacaactttacttgactatttcagttaagtccattttcctgcagggtgcagcctatgatgttattcctcagaggacagtctttggtatgtgcacagacatcttgatatgacggtggtttcagcagtgttttctttaactgtctttcttcctgatttttctgttaaactacctgcatctgtttgtatcacacttagccatgagcctccacacttatccatagtctggttcaattaaattcaggcccctttgcagaggtaatctttgaggtcaatctttgaagcttcttataacctcaggaggactcttcccagctgtctttattcccggttctctctattagatttttagctagtcatctgtggtttagtttgttgctctcgtggagctaccagcctcctcttaattgcttaccacaaaaatcttcattcatttccactgtacccttaaggcttggacttcctgaagctctgttccaaatagagtcttcctagtggagagctctctgttcttataactcctcctctccctgggcacaacttctgtgcccctgctctggagcaatgtgagaagagacattgcttttctttcctcagagtgataaccctactttaggagcaaggtgcttgatgggggcagtatcccatggtcttcttgtttgcctcccccggtatgaaacctccaccttatgagcaagctggggtgagggaaataaggacccagtattcttggtctgccatgccagggtagagcttctgccctaacagtaggtgctaggaagtgaaaaggagccctaggcctttcagcttccctggcccagaataggacttctgcaatacaaaattgaggaagatgagaattgttggcagactgtccctcccaggcagatatcgtagctcaacactggaatctgagggaagaaggagccctgtattcttggttgctcccacccgaagtagagtttctattatgctgagctctgtgtggtgggggaagtagtagtcatggctcaaattccaaggattttgttcttatggtgatttagtaaattttcctgaatagataattctccatttgctatatactcaggacaatttccagagacttaagtttttaaaataatttttaccaattaatagtgttttgttactaattagggagagtaaccatgaacctcctcatattgcaattctgaaagtcacagcctcccattcatgatgttatcacatagaacaggcctaaacagaagataatcagaagttcaacttttctttgactttctccattgagaaataaaggtgaagctgccatcttgttttgatcctaaacctgccacagagataattattcaaacacgtcatgtatcaccatcataaaataagcatgtattctgagagtattaaagatgaaaaacaggaacactatattttcttaaatcatagtttttgtaggaaggatggagtgaggtagaataaacaagtctaggattgcctagtttgaataatttcggtgggctctgaggccaggactatccctagttgcctggtacctggccatgggatgcttagggcagggggaatagtggatggagtgtaggagcctagtgacagcctgataaaggaggtgcttggagtatgggctctgtatcggttggtttgcatttgaaagatgtgctcccaagtgagtctttactatctctaggaattagccagagatggttaaggcccttagatgtcaaaacatttgggtaaaaagatgtggttgatacaccaacactgttggaatatgagacttctctatgcctcactttcctttggatactcttgttcattcatattttttctttacttaaagttaggtactctgactttgcctattatgttccttttatgattaataataacttgcctaagtctagtctttactagagacaacaatcatcaacttaattcactcaactctccaaagctaatgttattacagccaatttgaaaagtgataaaagggtatggtacactaacactaccaatagtgatagtctttgtaggcaatccataggtgaaaaaagtccttacattacaaaaagtataacatatgatggtcattatttgtcaagaatgaattccatttgagttccattcaaaatggaattttcatttcatacctacagctactgggaactgttttctgtttgggaatcagtctcttcatggccaaaacagagccaaggccaatccttctgtaggtctattcattaggctattttaagggcatgacccccaacaatcctcagtggagcacattattttacaaaaatcataaagcaacgaaaatctttctgaagaaaaactcctgagggtagtgacaccatccatatcattaaacaatttgcagtggttatcaaaaagtattttctcacattagctaatacaataaatatagtagtatatccaaaatcttggaatcacagcaagccagttaaaatttcttaatccaaaggcctatgtgtagtagaatagtcacatatttttgtggggccaatcaggaagtgatctttgtcattgctaatacttcatgttgactctacattaatactgaagatgagtaaaaacacttttagcatagatagatgatagatagatagataggtagatagatagatagatagacagacagataggtagatagatacatagatgagacatagataaaaagcaacctagttgtgtaagatagactcagaaaatcatttggactttttttttttaatcaagtctgggaaatcttggatcatggttgcaaaatatcttaccctttttataatatttaatacttcagatttgttcatttgttgcatggctctgttggtattctaaatatcactgtccccacaaatggttgaacaagtaatccaaagacaaaaattcaataaaagtcatgcttttaaatatacaaactaaaaatcaaatctctacaggccaaaactctttgtcaagaaaatcgacaatagtggagaagacctggacagttcttgaacatcttttctgcagctttggctgcataaggaccaaaaggggatggggggtggggagaggggaggaaaataaaattattcccatagatttaggaaaagatagattgttacacagccataataagtagccaccagaaccagttttatacctgttcaactgattaacaactcgtctcaatgaacatgcttttgcaagccaactaatcaatgtcagctcctggcttctgaaagtcagccagtcagtgcccctgagtgccaagcaatcagcaatagcctcaccctagtgactctgtttctgcagataatgttaactcatttacacctctgaagtttgccaatccctgaattccatgcttccccaaaacccagtataaatcagctgtctgttgtgctcagcaagattgtgtctgattttcataggtctcctttgctattatttccaataaatgcacatggtctttgtatttcacagcattgagtagtgtcaaatccttcgacagctgccaaagtatattttcttgtgggacatttggacttggacaacttttcttactatttttcttcaatgctcaaaacaaacctaacataaagaatatttattcttgtttgaaatgatattcagcatcagcagaaatagttaacatgctatcagaacttataaaatcaacatttagtattataagaaaatgaatctctctgcagatcattccagccagaatagtgatgtttattgctttgtacatcattgaagtcactgattccaaaatcagctatttcaaagcagttgtggattacatttagggtgattgtgtcccacatagcatagcaacaagattcttcactgctatcaaaaatattccattaaaaaatctatactagaaatatttcttcttattttacataatatactaagtgcataaaacttttaggtaattaattatgccttcatctaaaaaccgcatatatattatggtactagaggacaaaaaaagatattgcaaatactgaaataagtccccagttcctttgggcagcacgtttatcaaaacagattttatctattttggcaagctattctcctctctaattgtaggaaccatctcccaaacaatcttccaacatcagtggatttaactttaaatatacatataggagatatgtgtatatataggggattttcaaatttttctacaaatggtcttacttattagtctcagcattgtagcacagtcagacttcctcttaatgaatgtatatatgtacatatgtatgcataatatatgtctgtgtatatatttttccttgagaaaaatgcttttcaccaagaactaacatctggcttggctgaagattatagaagagccccatcttataattattaattatgcccatatgcacatgcttatcctgaatagatctgctgatttcaagccaaatattagtagccaaaagagtttctgcagatgctgtatattttagagtaatggcataatgttctgacaatgccagcaattgacctatatctccattcaaaatgtaattgtattaatcttttatttagaaaaatgattcagatctaatttttttcactctagattagtaaagcaatctaagaatttcgttttataaattaaccttttgtttcccctctcattctttttaccttccttggcaggctgtttttctattctgttctggtttttaagatacatacatacacacacacacacacacacacacacacacacacacacacagatgtaccttggagataatgtaggtagggttccagatcaccatagtaaagtgaatatcacaataaagtaaggcatatattttttttagtttcctggcacacataaaggtttaaagtacactgcagtctgttaaatatgcaatagcattatgtataaaagtgtacatacctcgacttaaaaatgctttattgctaacaaatgctaattatcatctcaggcttcagaaagttgttacttgttttgcaaatgtagggtcttgcctcaatgttggtggctgatcagggtggtggttgctaaaagttgaaatgtctgtggcaatttcttacaataagataaaaatgaagtttgccacatcaattgactcttactttcatgaaaggtttccctgtagcacgcaacactgtttgatagcattttactcaaagtagaacttttttcaaaattggagtcaggataaaaagaaggaggttaatggttacagaaatacagttagaagaaacaaattctactatttgatagtacagtagggaaattatggttaacaataatttactgtatatttcaaaataactagaagaagagaattgtaatgttccccaaaacaaagaaaagaaaaatgtttcaaatagtggatatcccaataaccctgatttgatcattgtacattgtatacatgtatcaaaatatcacaaatgccccaaaatacatacaactataataaattgatttcaaaatctttattttttttttttgagatggagtttcgttcttgttgcccaggctggagggcaatggtacaatttcggctcacagcagcctccgcctcctgggttcagccgcctgggttcaagcgattctcctgcctcaggctcccgagtagctgagtttacaggcatgtgccaccacgcccagctaattttgtatttttagtagagacggggtttctccatgttggtcaggctgatctggaactccagacctcaggtgatccgcccacctcagcctcccaaagtgctaggattacaggcgtgagccactgcgcccagcctaatttcaaaatctttttaaaactactaagaaaatttttaaaaaaatggaagttaatcatctcaaatcctgccactgctttatcaactaagtttatgtaataatctaaatcctttgttgtcatttcaataatgtttacagcatcttcaccagaagtagattccatcttaagaaagcaatttctgtgcttatccataaaaagcaatttatcatttgttaaagttttatcatgagattgtagcaattcagtcacatcttcaggctccacttctaattctagttctcctactatttttaacacatctgcagttactttctccactaaagtcttgaacttcttgaagtcatacatttggattggaatcatcttcttccaaattctgacaacattgatattttgacctcctcttatgaatcatgaatattcttaatgtcatctagagtatgaatcctttccagaagcttttcaatttactttgcccagatccattaaaatacaagcacgttttattttattgcatctatttcttgaaaacttttttaacccattgaattgtcttgaaaattaattgcttgaaaattaattgaatatgaatttgtgaatctatttctattttgtttctttgatctacaaattttattttcacaaataccaaactgttttgattactgttctttataatgtcttgagatcaggcagggtgagtccttcaattgtgttccctttaaaaattgttttagtggccgggcgcggtggctcacgcctgtaatcccagcactttgtaaggccgaggcgggcggatcacgaggtcgggagatcgagaccatcctggctaacgcggtgaaaccccgtctctactaaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcgaaaaaaaaaaattgttttagttattcattaaggtttattttttgcatttccatataaattttagaattagttggtctatttctataaaaaggcctgctaaaattttgagtgatattgcattgcacttacagaaaattgggggtagaactgccatctggaagctattaaatcctctaattcatgaacatgacatatctgtcaatttattaaggttctttaatttttgtcagcattgtttttggacttttcagtgcagaggtcatggacatctttaagaaaacataaaggccattgacttgaagaaactatttgaaacatgtaaattattccaaagtcttgtgtacagcatatgtaaaaagctcttacaactcaataaaagagaagaaatagcccaatttaagaattaacaaaatattttcgtagagtcttcacaataaaaaaataaaaatgaccaataaacacaggaaaagatgctctacatcaggagtcaacaaaatatggcccatgagccaaattcagccatccacctattttcataaagctttatttaaacacagagatgcttgggtttttttagtgtgttatcaatggcttctttcatgctgcaacggtagaactgagtagttgccattgagactgaatcacctgcaaggcttaaaatacttactattcaaccctttatagaaaaagtctactgactcttatgtcgttaataatcagggaagtgcaagttaatactgtaataaaatatatagccactatatggagcatatatgctatataatatatatgctatatatatgttatataatatatatgctctttatatatgctatatatatgctcctatatagccactatgttggctaaaagtgaaaaaatgactactataccaagtgttgacaaagatgaagtgtaattaactaagttagatctatttaaggacatattctctttagtgcgaagacttctccccgacctgatgttgccattatgtgaggaaggagatcccatgaagtgactccatctgacggccagtttctgcctctgaaggaaccccagagcagttgcggtgtcactgtttcagtagccctgttctctcctggtacctccagcatcccaatcaattcctccagatccgcctgagacatacctgacctcagcaaggacaaaaatctcctttcatctgaagaaatcattggctcaagaggaggactgagccacttatttcagtgttctgatagatgtaggggttgctgaaccgttttaagaagctgtaggaaattgtttgatgtaaactccctatatggccacaagggggcaatgcttcttcaaagaagattaacatttgtccaaatacacatattcagcaattagccagagattatccttttaaaatagtaaattatctcctactctgtttcaattcacgtgtctgtttcattcaatgcatctatgcatttatccattcatctacctaactagtatctgtatttattctagtctaacagagtggaaaacatcactttggaagtcaacacttttttgaattatacatgttatccttcaagcccacattaacttctgtagtataactttacaaggttttcacccacatacagcccaatatccagtcacactaatctgtgcctaaaattcccttatccattctttttatggggaaatctatcatggtttgtggcccagttcaagcatctccccatccgtactcttctttgactgggtccagaaacagatttcatcaccctttccttcgtcacatcatctagacacactggtgtctttggcaggttccattggctgatacctgagtcttgggactaggttgactgaagacttggactgtgtctctttcgtgaatgaaatgaggcccaagtactgcctaatttagtaggcactttgtggacagtatatatgtattgaatatatgcatatataaattaaaagaaaagaaagcacatcaaaacttaaacaacttttaaaaagcaccttagggtactggggaagaaaaggtttggattgtagattgaggaacgtggaccattgtctcctattggactgcgatggtgttttctttgagtggatttgagatgacaccaaatataaatacaaaaaaaatcatttttgtgcttctgaaaaaaatgtgcttctcatgttattttaacttatatgacttataatacagatcatccctatttcaggggtgctttagaatttatcttcaatttctcccttgtatcttgcctgtgttaatatcaaaagttaaatttattctttatattttcatagttgatcgattttgaagtgtgaataaaatatcgaatgtttattcaaactcaggataagagccaccaaaaatgactgcattacggatggttatagatctatatcttctgcagaatttttctatcctctctttccctttaaagatcacagctcctccagaacagataattccagtatttcctattttctttttctaggtacatttaaaaaaatatttaatttacctaatgtgtaatttagaaaaaaatatggagaaaaaataaaattgacttaattgtattatatcatttctgaggatcatctaaaatatggaatgaatacatctgaaaaattgcaacaaaatttaagttctctgaggacaaagggaccatatattctctatgttctgattcatgaccttagcttgtaatggggtattatgcccattgtgtgccctcaataaactttattaatactcacaataaaaaagaaatgccactgtacatgttaatcgtgcggtttcacaagagttcctctcttctaccattgtaaaataaggccctttctattgacatatccagccatcttaaaggtctgaggaaaagttgagggggcttgacagacagaaattctaaactgatgcttatctgtgtgtaaagaaaggattactgattcccaatgaatatatcttcagcaattctaaatttggacaaagtggggaagtgcttcctttgacagagacagctttaagtgaaagcacttgtgaaagggcggggcctgctgaaagaattcagttgagggtgaatttacagagtttcagctggttgggaagactggaagaccacctgggctgtcattgagctctggtgccaggaggaatggacaagatcttaggagcatcatttttagttctgtggcttcaactatgctgtgagttatggaagagaaactccaggatatgttactaacttgggtgaatgagaaaattggggtacagacaaactcatgcaggtagacactttaagaagaaaatattattttggggcctaatgacattttgttatctctctaagcaggggtgagtggccaacagaaggagaaaagtgaccagcagcaggtgaaacaaagtcctcaatctttgatagtccagaaaggagggatttcaattataaactgtgcttatgagaacactgcgtttgactactttccatggtaccaacaattccctgggaaaggccctgcattattgatagccatacgtccagatgtgagtgaaaagaaagaaggaagattcacaatctccttcaataaaagtgccaagcagttctcattgcatatcatggattcccagcctggagactcagccacctacttctgtgcagcaagcacacagtgctccccaggcacctgaagcctgtacccaaacctgcagttgaggttccagccaaaccccacagtgggagcttacgtaggcagagatgtagcctagttttcatctgcatatgcaagtgataaataaatgtataaacactagtgtggcagtatgagaatggtaattaaagaaaagaaacttagcttaataaatgaccatctctaacaaatgttttattatagttacagtatttgaaattgttacaagcatccagccagttttggggcaactgggaattttatgccttgctgatgggatgcaaatcagtattatgacactggaaaatcatttgccagtttcttataaattgctcttaacataggaccagaaattccactcctaagtatttatctataataaatgaaaatatatcttcacacaagacttttgtttacagcagttttaaccataatagccccaagctggaaacaacccaaatgtccattagctggggaatagaaaaataaattgtggactattcctataatggaatactacagagcaataaaatgcaataagctagtgatacaggtaacacatgacggatctcagaactttatgcttcattgagtgaatggttaaatatactgtggcacatacccacataatggaatatgattcatcaataaaaaacatgaattattgatgcatgcaacaactttgatgaatctcaagggcattatgttgagtgaacaaaagtcaatctcaaaggctatataatgtgtgatttcccttatataacactatcaatatgtaaaaattacaggacagtggttgccagaagttatgggtggggagtgtgtatatagggagtttatttagggtgatggatggaatagttctgtatcctgattgtagttgttagggaaatctatacatatgataaaatgtcacagaagtatatatcaaaaaaagagtgcatataaaaatgggtgaatccaatagcaaagacttggaaccaacccaaatgtccaacaatagactggattaagaaaatgtggcacatatacaccatggaatactatgcagccataaaaaatgaagagttcatgtcctttgtaggaacatggatgaaactggaaaccatcattctcagcaaactatcgcaaggacaaaaaaccaaacaccgcatgttctcactcataggtgggaatagaacaatgagaacacatggacacaggaaggggaacatcacacaccagggcctgttgtggggtgggggatgggggagggaaaccattaggagatatacctaatgctaaatgatgagttaatgggtgcagcacaccaacatggcacatgtatacacatgtaacaaacctgcacattgtgcacgtgtaccctaaaacttaaagtataataataataataataaaagttctttaagcaaaaaaaaaagggtgaatcagaataagatctgtagtttaataaatactattgtatcaatatcaattttctggttttgatactagtacataatgataatggtacatagctatggttatgtaaaatgttatcattagagaatgctgggtgaaatgtgcaagagaactctgcgttatttttgcaacttctacgtgagtctaaaattatttcaaaataaaaagtaaggatgtagaaaaaagatttttaacaaacatttacaaatttttggaatataaaattttggaatgtggaattttagaacatggttggaacataaactgggcaaccactttggtggattttcataaaactaaatgcgtttctaccacaacccagtgactcacatctaggcatttacccaagaaaaataaaaatgtgtcaacacaaagacttgtacaagaatgttcacaacagttttattcataatagccatcaatttgagaaaacacccataaacaagatactaaatcaataaatttttgtgtcacacacattcaatggaatattaatcagcaataaaatggcctgaaccactgatacacataacagtacaaacaagcctagattatataatgcctagcaaaattgccaaatacaaaagggtatatactgtttgattcaagttatgtgaatttctaaagtagacaaattaatccacggtgaaataaagccaaacagtgattacatctgtgagtgggaattatttgggtggagcacaatgaatttttataagctaaaggaaaagaaatgttctatttcatgataggggtgtggtttacaaggctgtttgcaattttcaaaactcatctaactccatacttatgacttgtttatttcactatatcaattatacttcaattaaaaataaactacagaaattaatcaaataggaaacaaaaacaaaacaattaggggaaaatccaatgccgaataaatttgaagaaataaaagagttaaatactcgataatgttgataatgaggaaaatagaaaatagttaaacaatgcagtacgctgaattctggcccccaaagatgtccatgtcaaaaaccccagagtctatgaatatgctgcttcacatggtatattagttttctagggctgcagtaacaaagtaccgtggactgggtggcttaggacaacagaaatttactgtctcctggttctagtggccaaaagtctggaaccaaggtgttgcagagccatgctccttctggggcgctagggaagatttgtttcagacctcgttccgagtatctgatggtcacaagcatcccttagcttagagatggtcatgtcctccctgtgtctcctcccatcatctttcctctgtttgtgtctctgtctcttcacgtgacattcttttcataagggcaccagtcttattggactaagggcccgcactactccagtaggatctcatttcaacttaactaatgacattggcaatgaccctatttccaaaaaagttcacattctaagcttctagaggttagaacttcaacatatgaattttctggggatacaatttaaccgaataacatatagtgaaaggaactttacatacatgattaattcaaaaatcttgaaatgagaagatttatcctcaattatccaggcagacccagtggaatcacaaggatctctataaaagggaggcagtagacttggaatgaaagaaagcaatgtgatgagagaatgagaacagcctcgaagttggaaaaggcaaaaaaaaaaaaaaaaaagaaaaaagacagattattccccatagccaccagaaggaactcagacctgctggtaccttgactttagtccagtgaaactgattttggatttaagatctccagaattgcaaaataataaatgtgtgctgttttaagccactgattttgtggtaatttcttatagccacaataggagactaataaattcaataataggagagattaaaaaggagacatgtctggagataaagtagaaattaaaaaaaaattagcataagttaagtacaatttaagccaataaattttaaaactttaaaaagtagaaacaatttgaatgaaaaacatatactaccaaaagtaactcaagaagaaatagaaaaactaagtagatttataaccattaaattatttgataattggaaatgaaaatccctaaagatttagtaatagaagggaaatttttaacctgcatgtgcgcccactacaaaattaaaaacaagacacatgctggatgcatctgtaaataatataaccaataagattttagaaattaaggttagatggggaactcttacaaataaataagaaaacattcaaaataagaagagacaaggatataaaaggcaattcaaaaagaagaaataggaatggccactaaatatgtaaaacatcaacttccacagaactcgaggaaatcaaattaaaataaattattgtttcatttctatttgatcaacaaaatctaaaatatctggtaacattaagtattggtaggaatacatggagatgaagctgttacacttttccagatgaagaaaaacaccacacagagaatttaggataacaatttgcctaaactagttatgaatttgcacatatctaataatccagcaatacaaatttctgatatctacataaaggtagtcaaaatgtaaactaggaggcatttacaaggatgctcactgcaaccctctttaaaaataagtataatcacaagaaaaaaacaaccccatcaataagtgggcgaaggacatgaacagacacttctcaagacatttatgcagcctacagacacatgaaaaaatgctcatcatcactggccatcagagaaatgcaaatcaaaaccacaatgagataccatctcacaccagttagaatggcaatcattaaaaagtcaggaccaattttacactgttagtgggagtgtaaactagttcaaccattgtcgaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccatacaaatgaagagttcatgtcctttgtagggatgtggatgaagctggaaaccaacattctcagcaaactatcgcaaggacagaaaaccaaacaccacgtgttctgactcataggtgggaattgaacaatgagaacgcatggacacaggaaggggaacatcacacaccggggcctgttgtggggtgaggggaggggggagggatagcatttggagatatacctaatgtaaatgacgagttaatgggtgcagacaccaacatggtatatgtatacatatgtaacaaacctgcacgttgtgcacatgtatcctagaacttaaagtataatgaaaaaaatacaatacattcattaaaaaaaagtataatcaatagtggaataaaaaatagtggtttagtcatacaatggaagtattagccattacaagcaaagaagtggttctatacatattttcttagatgaatcttacaaataaaatgttggatgtaaaagcagaatgatacatactgcatggcaccattaataagaaatcttaaaatacaaaataatgcagtatattgttttgtaatacatacctgtaatggttaaattctttttttttttgagacggcatcttgctctgtcgcccaggctggagtgcagtggcacgatctcggctcactgcaagctccctctcctggattcacgccattctcctgtctcagcctccggagtagctgggactaaagggagcgccaccacgcccggctaatttttgtgtgtgtgtgtttttagtagagacggggtctcaccatgttagacaggatggtctcgatcccctgacctcgtgatctgcccacatcggcctcccaaagtgctgggattacaggcgtcagccaccgtgcccggcctgtaagggttaaattttaaaagacatgcgtggaaacttcccaagagtggttactatctttgaaagaataaaaggaacaaggactattgttctagctttgtctgaaatgtttgagaaaatctgaaatgtagagagagaaagaatatttttagaaaacatagcaaaattcatcatctgtttatgtgtttattctcattgctggatacgaaggtgcctgctatataattttctgtacttttgctcatgataattatttcataaatttaaaaaataatttttaaatggatagcgacaatcatagtttttactatcttcaccagtccacagaagagaatagcaccttcattacctacaactttgccagatgtatttctggtaggccacataaatggcaataaaacatcaattggaaaaaatctctaatttatgaataaaaggatgttcaacctgaaataaacaacccaagactctttcccctgaaccacaatgcatacattttcaatatattaaaaagaggatgtggaaaaaaaatccaattagttacctcttagcaatgggagatgtggccacaaaatgtcagcattttgtgaatattaactcccctgggctctcaaagtttattttacttccttttttagcagtttgaaaaatcgaagaagaaattggaatagtatttatgtctgattagagtggctttcattggactgaaatattcaagaataaagtagaatacagtgcctaggatgaattcgtggtcagcatgagaagagggctgttgtcaagtatatgagagagaggaagaaatgggaagagctgggagtctcaacagtgattctgtggcttcatacagatgtgagtttggggatttctacaaagaaccaggaagagtctgaggacagtttgccacagaatcactcaactattcccatttggatttctttatggggcagtccaacaaaaatacagcttttggaatttggtgctttgacataaactgctctatcagatgaagtttcagcataaagtggaaaagaatcttcattctttcaatgtccaaagagggaaatatttttattttggacatttatactattaatagttttgaatatttttactgataaagcagcattttgtgagaagccttgtcttcctgataattattaaaaattatagaattgcaccaaacagtacacatgcactcatggcaacagcatagctaaagatttgaattcagagggcccatggattctcccatcctagaacttcaaataaaattaagcatagagttatagtagaaataataggcctttgccgttactattgacagtagaacacacaactggagaaaatacagaacctgggagtcttttttttttaatctcatttgtctgagctgttgctttgccattgtgaagttccaattcccttggtttgatgggtaagtaggaaggacgggaggtgatgacttctggtttgtctcctgtgtcaaagccaaggattggtgagcagcttcacctttgactcaggttggtagcaagtgaacaatcaaaacatgaatgtatatttgtaatcaaagccatgattcataataaattggtttcagataagcccctcagatttatcacagatcaatttcctaaacttggaaattttaaatgactaatctccttttaagaattccttcaatattgtttcatgcatgtcctttaccagatataatcctttgtcatttgttaattaaattataagaaagggcaaaacgatgtttaggatagaaccaatttcccagcctagggattatcatagcacattcacacttgacccacccagaaaccacatttcagaggcagcttccatacagaactgagggaccctgcacctgtactgtcagggtacagagcagggctatttcaacaggaaggaaatcctgccatcatactgcttcccagtctactgtgagtattcatggtctccatctacttaggtacaaataattgcaaaccagagcatggctacctctcagcactcagaggtgaaacgggactaaggagtagatgtctcaaacaatgagaaactattccctgcaccactcagtgatatgctattttgacctttataaaagaactggaaatgttttagagaccttgtctgcactttctttcttagctatctcttggtccctttatattaattcgtccattaagttagtgaaactagaggctgggttcacacatataatcccagcactttgggaagccaagataaggtcacttgaggccaggagtttgagaccagtctgggcaacgtagagagactccatctctacaaagtaaaataaaaatttagccaggcctggtagctcgcaactggagtcctagccatttgggaggctgcggtgacacaattacttgagcctaggagttccaggctgcagtgagttctgattgtgccactgcacttcagtctgggtgacaaagagagacccccaactctaaaacaaaaatttttctatttaaatttttaaaaaagacaatgaaatcacatggaagattaacatctaaattccatacaatcacgtaacagcatacaaaaaattcagccaccaacttctgtggtattgacatgcacaaagttcttgcaaccttcagataacacgttctgtgggagtatattatagcattgtatcatttgcatcacagagagatcttgtatgcttatcatgacaaacaatgtcttatgcttatcattaaaaatttttaaaatgcccagccacagaatgtaacaagtgagactgaatactttggatcaatgggatagaaaatgtgatatcaggacaattctaggacacatgatctaagaagtataattctacttgtgaaggcaacaggactgaatatactgatcctcctcagtctagtaaataaaacttagtgtcagattttgaaatgattacattttattgctgttataatttcataaagagataaaaaactgagcagcttctgaaagtcgagaaggactgatttttatcatttgattttgaagtagctttacttattatagaacttaactagggccctagacctcagtaaggaggaagaaagagatgcagtaattgtttagaataggactgcctttcacagagaaagtcaaatatctgagtatttttcttttaaatttaattagtttctgatggcaaaaagtaaatatatgctaaatgaataatatcaatgtatgtcaactggttcaactgcagttcccctcaatacaaattgcttttcttatatcccttttctaggttctgtctatcctaatgactagggaaagacaactagacaaagtaaagattcaggggtgagccagacatttttcctcatctgtgcatagccatgtagtctatgaacatgagactcaatttcctgtttggggagatagcatcagaacccaggaactacatatacacaccgcagggccctggtaggcactgaactttgagcttcaggcagcacaactcacatttgtgcaaagagctacatgccacatgctgttctccagcctgctgtgtgtatttgtggccttcagctactctggtatggatggttccaagtgtgagtaaaaatgttaaggatggaaggattccaaacaggcatatggtatttctcatggacttgaggaggaaaggagaaattgtaaaaaagcgagcatattatgattttagtttggtttgtctctgggtcctaaattagtctagctcttacgatattttattcactatatcaaaggatcagctctgttttctgatttttcccacaggatcaagtgtggcccagaaggttactcaagcccagtcatcagtatccatgccagtgaggaaagcagtcaccctgaactgcctgtatgaaacaagttggtggtcatattatattttttggtacaagcaacttcccagcaaagagatgattttccttattcgccagggttctgatgaacagaatgcaaaaagtggtcgctattctgtcaacttcaagaaagcagcgaaatccgtcgccttaaccatttcagccttacagctagaagattcagcaaagtacttttgtgctcttggggaactcacagtgtttgaagtgatagtaaaagcaaaacaaaaaccctagggctcaataagagaacccctctactccccatcctttgctacaggagccaatctgaaatgcacacctgcagatctcaggcaagagagggtagtgactgtggtctgtggatttaatctgtggtctggatcagatggtttaattccaagtaaaacctccttctatctcacttggaaacaggtgttcagagcaactttcttctaatacttcaatttttacttaaaatagatcatacagaaaatgtgtaaagttgtctaaagttggaaagacttccacataataacttaaagtggcagtttcacttaacgatgctcacagcagaaatctgggtctagttatcttgaatcaccataaaaatcatttccttagccctttcctcttaagctttatgtcagttaggatacaatcagggaagcagaaccatcgtgaaagatgtagaataagattaattataaggattagacctcatgcaattgctggaacgggtggctctcggaagttacttagttgtttatgtttttatgaaattgtaacaggaataaaatgtaatctattcaaaatctgacactgagttttatgtactaggctgaagaggatcaggacattcagtcctattggcttcacaagtagaatagtacttcttagatcatgtgtcctagaattctcctgataccacatttctatcccattaatccaaactattcagtctcacttgttaaattctgtggctgggcatgtttttcatgtgtaaaataaagtcgtgataagcatgccagatttctgtgatacgatgccataatctgctcttactcctatgcaaagctgtttgctgaatttactctaggtcagctagactcacatttgggaaggagagttgaacatggacaagagcatgcaaaagctgtgatttgtaaagacattttggaacccatggtgacaggtggaacccacgaggacaaactaaaacttgtctgtctcttacctccttcaatctcatagtgttggtgaccttcagaagaaatggtgttatttgctatcatgctccctgggtacttggcccaagaaaaagagaagctgaaagaggagatctggggggagtgggggagttgtgaatcaacaataagatgagttagcagatcagagcaacatatgtgagttgccacagtgcctggagcctggcacctgccttacacaatttttttcaacttaatcgagaacaatatagggaaggattttcttagaaatatatttccaggtagttacgacgagacagtacaaagttaccacaatacccccaccttgtaaacttgacatccatatgcacctcttttaatagcacttagctttcaaataaaggcaattttaaaaagcatacttcctgccaatatgatgccactgttcttcattcaaccacacataccctaaccctctcccctaaagagaatacaaagtatttattcatctttgggtgatgttctttcctcttctagctgagtcacactctcccattgatatcctgtagtttagcttctgagatataacaagctataagagtaacttattaacatatctttcactattatgtataggcaaatgggaggagagtaaaaaatggttgacatgtattttaatattttcatatcacaatgaaaaagaaatgtttataacagtatagtctttttttccacaaatggtcacatgattgtagctggtttctataactacctcttccattacccatttcataatctgttttcagcaagcacctcaactcactggtacacttgactttctataaaacaagctccttggtcaggagcaatgttatacagaatgccataaagttgagtaaggaattctctaagcccaccactgtggttttgccagaagcactgcagatgtggaaggaaagtccatattcagaatgtctaagtggactaaaacaaagcaaaacttgccagcagccagagaaagttgatatatcatgatatatcatgatatatcatgtctttaagaatgattgctgaattctcatcaaaatcaacagaagccaaagaggaaaaagtatttttagagtacttacaaaacaaacaaacaaacaaacaaacaaaaaaactctctagctagcttcctatgaacatgaaagtctaattttaaaccctttgtcaaaaatcattgttaaaaaggtggaaagtcagtgcacagattgggaaattatatttgcattggtgtatttctgaaaaagattcaaatgcagaatatataaaaaacttgtacaagtcaacaagcaatgagaaaacaatacaaatggccaaaacttgaagagacacttcagaaatatgatatctaatagtaataagcatacacaaaaagcacttaatataattactcattaggaaaatgaaaatgaaaccccattgagtgatccccctgtgccctttcagcaccccagttgtattaatgtagccaggaggaaatgaccacaagaggataatgaaaaatagtgactacttccaggggaagggatggccaagtaggttttctagaaacttctgttaaattaagtttagcctaaagctgcctccttatttatttaaaactcagggcaaaggtttctccatacacagggccctgtaacctaacaggatgcataaacaggctacagtctgctctctaccaatccctaagtttcggccataggtggccaactgttcaaacatgttcaaataaggcaaatgccaagctttaaccaatccatctgtttctgtaccttacttcctttttctataagtcactttactttctctgtccataaatattctttgaccatgtggcagtgacagagtctctctgaacctgttctggtctggtggggggctgcctgaatctctaatcgttctttgcttaattaaactctgtaaaatttaattcgtctaaagtttttcttttaacatgtccatcattgaaccatgttcagtggaagaagaaaaagcagtaacaggctaaagaccggaacactgaaggaaagcaggttttactaggaaaaaagaaagttggtattcattggccatactatatgtcaggcactatttatacatttcaaattcattacctaatttaagcatcatacaccctacgagataggttttagtcttccaattttttatatttgggaaatgagacacagctttccctaactttgaaaagcatctctaactaaagtcagccagggtgtaacatcttagagggctcctaaaaaatcaaagtttggactatggagaagcaaatagccacaaagcagcagcattggctttctcagtgaggatgacaagatgacaaacctaggcacaaattgcctcaggatcaacagatggaggaaatcaccgactaagtatttaagagtgctgaatgtatcagtgagtctcttctacagtagtgtgctatgaagcacaagaggctagagggaaagatgagatactattccttaaacactccaagcgggcttccatatcaaggcctttgcccactctgcctggaatgctatacccccacaaaacctcatggtgtagctctgaactcctctacgtctttacgcaaaagtcaccactttgtgaagcctttatcgaaatctttctattgtatattccttctttgagaatcaggctctagcgtattccacgtgttgagaactaaagcaccaagttctgaagcactgccacctggtgtcccgctgaactatttggtgaggtttacgctggcttccctgctgccctccagtgttcacgggctaagctgtgatgaagcctggttgcaataggagctagcatttctgaaccagtcagtaaccttcccatggtagtaatcatgtgagacaggattcagcaggactggctgagacttttttttttctttgaaggaagcaatttttatcccttacgcagcttgtccctgctactgtgtcttgtctccattgcctggatccagacctcacaagttatttatgtatttatgtatttatttatttatttatttattccaaggcagaagaatttttcttagtacagaacaaaatggagtctcctatgtctacttctttctacacagacacagtaacaatctgttctctctttcttttccccacatttcccccttttcttttctacaaaaccgccatcgtcatcactgcccgttctcgatggtcgctgtctcttcggagctgttgggtacacctcccagacggggcggccgggcagaggcactcacttcctagacggggcggccgggcagaggcgctggctgggacttttttaaatttcatttttaaaatatttttcccttaatatgtgaggtcgattgatttcaaaatggcaaatataatatatgggatggtttaagctaatagaataccttggaaacaaaggttggcattattgcacaaggtgggaagtttttctctattaagtgagagttcatctactgctctgtcccttactgtagtatagaaatatcctaagaagtgagaacaagagtcaatgatggagagaaataagccattgtagggaacacagtgcagcatactctctccatgttatcatatgctgcccaacctcccaatatagcatcataacgccactgatttcccactaacagtaagaaacatgatagaacatggatatgtattatagtacataaaatatgctatgcaaattgcaaaatgcccctcggaaaaatactgaattttatcttgtggatagactgcactgcaatttcagatacagtctcccaaccccccaatattttctatattgaatgcatctggttgagtgcctaagatacagaagttattgtattagatgatttattcggttggtgtaaaagtaatttctgctttttccattacttataatgtaatggcataaccattatataggcttggattgcatttctggacctaccactcattggttgaattatcttgagcaaattacttaataacttttatgcttcagtctccttatccctacaatgtggatattgatagtacttactacaaagggttattttgagaaataaacaaaatgacaaatgccaatgcttagcccagtaccaacaaaaagctactggttacttacagaaaaggaaattgaatatgagagagattaaatgtcttgcctagcatcacaaagtgtcagagttgagccttccctccatgccttatgtagagcagataccttttctcaccccaagaataactctctatctcattacagtgctatattgtctttatagagcttatcaccgtatagaattatcttattttgtaaaaactcatttatttaacttcttctcattgcactctagtcccttttctatctcttcaccaccatgttctccatgcctggaacaatgcctagcacacaggagacacaaacaatacatgtttgttgaatgaatgcacaaaaggtaaaattatgtccagagtccttgcaattcaaatattaatataacagtttaagctggattaatctttgtgttatttatccagaattgtcaagatttatatcctgtaagtttcttaacgtaatatttaaatatgtaaaggctaaatagttgaatactagctttggtttatctacattggtttatttttgcactttgggggaattaataaataatcttactaaaaattttatctataaatccctcactttactcactgtggatatgaggtagaaaaaattctgaggcatttttctctgtagtgcatgcatcttatcttttatgttgcaaaagtttttcagaggactcatgtatatgtatatatttttatgttttaaaaaattctgtgtgcacacatacacacacacacacacagacacacacactccttgcataagagttgatatacaggcccactgtttgctcaaaacagagaaagcaaattgaccttgtttcccttcactatcagggtgggtacatttagaatcctccctgatatattaggctgttaagaatgataaagattgatattactagttgagttgtcctgtggccaaagtggggaggaaggaaactaggatcatgcactcttccagaaagagaatctcgtaaggctgtatttagttgccaacaggcttggcctttacttcaggtcaaatgtgtggctataccttgcaggattctgtcctactattatagatagaggaattctccctgctgttagaggtatatcttcttgatctggacactgctccttcaacatgtgggtgaatttatcagtggatcggtgttctcaccagaaatgagctccacagcatgtaggctttctgagtgattgtggccatgacttcactctcctatgataaagttacctgaatgctatgatcttctccatgcatctggagaagaaactacagaaaagaaactactacagcaaagacttggaaccaagccaaatgcccatcagtgatagactggattaagaaaatgtggcacatatacaccatggaatactatgcaatcataagcaggatgagtttatgtccttggcagggacatgaatgaagctggaaaccatcattctcagcaagctatcacaagaccagaaaaccaaatactgcatgttctcactcataagtgggagttgaacaatgagaacacatggacacagggaggggaatatcgcacaccagggtctgtcaggggatgggggactaggggaggtataacattagcagaaatacctaacgtaggtgacaggtcgatgggtgcagcaaaccaccagggcatgtgtatacctatgtaacaaagctgcacgttctgaacatgtaccccaggacttaaagtatgatttaaaaaaaagaatggcttgtttgtctagcagccatccctaaccctagtcctcatgcttctgaactaggagtcattattgaggcttccaggatttcctttactacccatacatttatctccttttctgggaaggaaagctagaagttaaccattgagatactttctaatcctgttctaattttttagaacgtgatttaaatgtatgtggaaagtgctgtcccctgattttagtacataccccatgctgtttcctttgcttacttcagttgttcactggaaaggttttaaaggcacttcatacactaaatacctagaggttaaatttatattctgaaaaaaattaatgctatcttatattattaaatttcccttggatatatcttatttctccaattatattttgggctcacagggaatagggaatgttgctttgtaatctttttttctttcttttcctctcccctagatgaggctgtagctttgtaatttttaattcctcagagctcctagggaaattcaaagcacaaaaattactgtttaaaaaatacatgcatattgaatcaaactaacgttatatctggactgtgacagaagcaagacagcataattcttatttacttttaaacaactttattggagtatgtttacgttccataaattcatccattttaaatgtatggttcagtgatttttaattaataactgatttatgaaactattaccataatctatttgtaaatccttttcaacactctagaaagatccttcatgccaaacttatagttaatctctaacccaaccctggccccaggcaaccggcttacatctttatagatcttccttttctgaacatttcatataaatggaatcactcaatatgtaatcttttgtggctggattctttttcttaaaatagtatttttgaggctcatctgtgttgtagcatatattatgttttattttatttatttcatttttgcttatttattttattttatttattatttatttatttttgttgccgaatatcattcacatcttgtatgaacatactgcattttgtttattcattcaccagctgatggacatttgggttgttctcatttttttagccttaataaagaatatccacaaattagacttccattatttttagaacatatctaacatgtaaaacattcatggtgcatcacaaatgtaggtggcatatcagattccaattataaagtctagagctagacagatatatgttctaattcttaatatgccacttaggtaattgaccttgagtgaattatttaatctccttgagctttgggttattttttgtttgtaaattagaaacagtaatgtctctattgcatgactttcttattagatagatgtacataaagaaaaaggtaatttagatgtgtgcacatttataatttgagggggattcaaaagttgttttttaatgtttgaagattcaaagaaaaatgcttttcctgccacaaatgccatcccacctgtaactccctctaaatttgaataatagcagtccacagttaggcagcgcacttctgaaagggtgtcaattctcgttgtgttccacactcatgggggatttcctcaaagtttatgaagttggcctgaagaaagcagttacttcgacccctctttgtgaaccacaggaaactgaacatagggcagagcgtttctaggacatttatgggagctggtctctgattggctaggcaaccagatgcagaatcctgttttctgaagcagaatatttccacagattttggctgaaaaacgtttttctgctgtgggtacgtgagcaggaaacatggagaagaatcctttggcagccccattactaatcctctggtttcatcttgactgtaagtccaggggttacaggagacattcttagtctggggtgatgatgaggaaggaggaggatgcagtcagacactctaggttttatttggggatgtgtgaagaaaatgccaactctgtagagagaccaatttctatgtctgactcttttttaaaaaaacaggcgtgagcagcatactgaacgtggaacaaagtcctcagtcactgcatgttcaggagggagacagcaccaatttcacctgcagcttcccttccagcaatttttatgccttacactggtacagatgggaaactgcaaaaagccccgaggccttgtttgtaatgactttaaatggggatgaaaagaagaaaggacgaataagtgccactcttaataccaaggagggttacagctatttgtacatcaaaggatcccagcctgaagactcagccacatacctctgtgcctttacacagtgctgttcaggcacctgcagcccatacgcaaacctgtgtctggtgttgcactgttaccagcattgacaaagaaccatgagtaggatggaaaagacaagttcgttgaattacagttttttttcaagaggattgtgcaaacatagaaaaataagcatgctagtgatcataactaactaccacaagagcaaattaagtaaacatattccttatgacagatagatgtcagagtgctaatgaagcataacgcatgacctggtaactgggccgttactaaacaatactaaccccagctcccaacagctcattaaccacatcatggagtcagacccattgcctgctcttttggcatgattctgaaagaacccaatagttactcaaatctatctaaaacaatctgggtaaacaaaggcgatatttaccccctcattgttgctatgtcctgaaaacgaattcttctattatactttatcacagcacaaaaggagcatgtcggcatgcccctccctcacacacctggcctggaaatatgcatgtttaataccagaacaggtgatgctgcctcctttaatccattggggattttggttttgctttagttcaacttttcccccacatgaacatttgtatttttatttcttctcacatgtggctattttcatttttaaatatcactgataatatcataaaggagcactgatgaaggaccttcactattttacgtggtctataccccagcttgtactgtgattgtgatattggatgactaactgaactctattatcaaagtctcttcatttgtaatttccaggtatattaagtaggctgagtgtttggtgctctcctccttttgcagatttccaaacaacccaccagtttaaggtcccacttgtactctagaggcatctaattctaagcgttcttgggggctgttaagatgaagtaagttgcttctgggcctcctcatctaaaagctagaatttcaactttctctaaacatctacattaataattatttatccagctcctgtccagtttcctaaattatgctgctattgcatttcctctctcttttgtggatttatgtttttaaaaatattattgttattatcacatatttaggaaaaaaagctggtacattttaaaaataataatggagtgtatacaaatctctgactggacccatttagagatatatatatatagagagagaattacttttttcaaaatttattcacaaggtagtaatgaatctatttgactatcagatcagaagcggctaaatttgtaatattatttgaacatatatggaatcagaagggtatagcacaggactgagtgcggagaagctatggttcattgtaccctagtgtcggtggagaagaactacacaaaagaagactgatcactgttccagctgctagtcaaattcccaaaccagctctccattattggcataaagatcaatggaagaatttctaatatttccagcaatgatcttgaggcttgaactaactctgaattggtagaatcaaaaggcatgagtaaaataaaagatgaacatctgactcatttgtgtgtggctgcaacacaatgcctcacagtctcccgcatgtcaaggcacacatagaaattaattacattcatacaacacttcagtgtggaatgacgctgcttgaaaccagcccatgactccaacttccttgagaactctgcctgccttaagccacgatgagatagagatcttcccacacacacgatcaagaaaaatgtaaatctgtggtgcatggtccttacaaaaatatccctatctttatgaaagctgtatgtaaccaagtaaatatggatgaaaattttcagtgtctttggattctaaaactgatctgaaattgaaaataatgtgtcaaattatgattatttatagagacacaggcatgttcttgtaaattttgttagtttagacacatggaaagagaagagtgagtgaaatataaaaatgttaaataagaaacacagatctctattgattgcagggccccaacctgagcaatcagccacctgctcctgtactgtggctgcacagagctcttgttacctctgatcattgccaccaggtcttctgtgccagtgcagaagcacaaggctggcttttgaaaagaagtttggtgaaacaggcagatgtttcagatcaagctattagagactagcagaaatcagccagaggaagcatacatttttattgttgatttctcacaagttctcaaaaagactatttttcattgaactccagagcttttgtggcttgctgaataacaaactgttgtacaactcacttaagcaagtgccattttactatctcatgatacttctgctccttgtgatgctgactgcagctagggtcctctgggggcttgcctgactagaacccctggagctcacttccatacccggagccttggtgggaatgcggaaggctgggctcatctctcatcccaactattctcagggctttcattacacatggcctctgcatgtggtctctcatcaagatctctctagggcttccaatattacaaaagtggaaggtgccaggcctttttaatgtttaggccagaactgccacaatattatttctactgcattctcatgcatacataagaaccatgaatgtgacattacttggaaaaggggcctctgtaaatataattaaaattgagtcatagagccaacccagagtcaacatagaagggaaatacacaagggcatgaatatcagaagcacgattttgagggcatctttggatactaactcccacaagagctaactaagtaaacatattcctatgccagatagatatcagagtgctaatgaagcataacacatgaccttgataatccagtaattatcaaggtcatgtcaatttgaacttccaaatactgctcgtatctgtttctctatttctatattgcttactgctttcctaatttaggcattcagcacctctcacttggatgattgcaatggcttcctaattgtcttcctgcctctattctcaactctttgaatctaacttctacatggcaactagagttattataaaatgtatctaataagatcacttcctgcctccctttgggtagtaaggaaccactagaagttgaaactctgtattaaaactacaaggccggctgggtgtggtggctcatgtccgtaatcccagcactttgggaggccgaggcaggtggatcacctgaggtcaggagttcgagaccagcctgaacaacatggcgaaaccccgtctctactaaaaatacaaaaatttgccggacgtggtggcatgctcctataatcccagctactcaagaggctgagacaggagaattgcttgaacccaggaggtggaggttgcagtgagctgagattgccactgcacttcagcctgagtgacaaagcaagactccgtctcaaaaagaaacaaacaaacaaacaaacaaaaatacaaggccatctacagaatcctgtttaccttctattttaatcttccatccttctctcatatatgtaatatatatatatttatattatatatatttatatattatatatgtatatttaaattctaaccctttatgtgaatattaagggccttcctaaatctgaccccttttcccagaatatatttttcccattgtaatatgcacacaggtctactcaccctttatggcccaattcaggcattatttattttttatctgagatttcatagaatctcatagaatctgagatttcatagaataacacttgtaacatcttattataaatatttttgaatctgatcctctcttacaattgttttgacaaaaatatttgccactgagagctattatatgtttatattcaatggaaatgtttcctactaggaaatgcagagattcagtctaagagtgcagagatttcttttactccttgaaccaatgcatggccagcttcccttctcttcctttagtaaatttccacttccaaccataagatctagagagaggctacaagacagaccatgctgcgagttgggaaagggcaagcttgacccgggcgagattcctctgtctgggtttatgcctcctacgtaaactgcaccagtactgctgccctggatgaagagaagaggatttctaaagcccccacaggtgctccttgcacactccttgctcttcttgaatggggaaggagtccttattgccttaaaattgttagctttgtcttcattttgagatccaaatccaatattcctacgaaggaaaaaaaagcatcccagtggcatgcatttcaaaagtttatcttaattcacaagatttgccatttttcagcacatccgaaaactgcttcttggtctgtttccatttcatgcagtaattcagatttagattcactttttaccctacacaaaatgttgagatttccgccattaatacatttacaaggcaacactttaaagacattagatttcttgtagtgggttgaatgatgacagaagatatgtccatgtcctaatccctagaaatagtgaatgtggtgttatttgaaaaagggtctttgcaaatgtaattgagttaagaatatcaagttaagatcaccctggattattcaggtaggccttaaatccaatgacaactgttcttttaagaaacacacggatgaggctgggcacattggctcatgcctgtaatcccagcactttgggaggctgaggcgggcgaatcacctgaggtcaggagttcgagactagcctggccaacatggtgaaaccctgtctttactaaaaatacaaaaattagccaggcatggtgatgcacacctgtaatcacagctactcgggaggctgaggcaggagaatcgcttgaacctgggaggtggaggttgctgtgagccactgcactccagcctgggtaacatagtgagactctgtctcaggaaaaaaaaaaaaaaaaaaagaagcacacagatgagaaggccatctaaagacagcggggtagaggttgcaattatgcagccacatccaagggatgcctggagccaccggaggctggaaaagatgaggaaggatcctcccctagaacgttcagagggaacatggccctgctgacaccttaatttcagacttctggcctctaggggtataaagaaaataaatttttgtcaagccaccaagtttgtttgctacggcaaccctaggaaagtagtatctcctaaaggtgatatttctaaatagctacaaccaaaccttgattgtttttatagaagggcacattgtcaaccaataccatttgaatatggtattgatatggttctaatattttaatactttttggaatattttaagtttaaatcgtgacacagtgtatatacaaacacacacttttttttttatcatttaatgaacacctgagtatccacaatttacccgctattagagtaggacatgttggtgaataatagacaaatactttccaatagaaattgattatctgttagataagactttttttctaattatattaatgtcttccctcatcacgctggcatgtgtaaaagtaacatagtgggatggcagacatgatctctaaattggataatttaccagggaaatcagggtgacgaaagagaaatttgtatttcttatcgtctgttttgaggtaatgcgttgtctaacaataaatcacaagtgtctcccacatttattaaaaagtctgtgacctaatatgtcccattaaggcacttataagcatgtgctacatggcacaacatgatgcttagtgacaatggaagcgacaaaatggaactttctcttttcttcggatgccctagttttaaatcacagactccatttttaagaggcaaattattcctccttgaacaatgtcaccatcagtaaactcttttcttccaatccttgacacacatacataccacctaaattagaaagcagctttattaataaaataatctgttgtcaaatcagcaatgtttgagtccaccacaggggggcagcatcggcaaacatagactctcctctgagagggtgggcaaaatagtgtgattggttttctcaacttgcagtcacctctttccctttctttccaaaatgcacacatctactttccaaaatagaccgcaactatttctattgatctggaagaagcttgtaccaggcaacccatttaggagaagttggatgaagagggagagggagatgctactcatcacatcaatgttggtcttatggatgcaattgtcacgtgagtttgagacgtccctgactgcttccagagaataaatccaacaggatagagaagtatctgcaggcagggaatggactttctgtttgagaaacaagagttaagacaaagggagagaaacagagagaaagagacagaatggataaagcttgagggagatgggaagggagacgtggacagaaaggggaaaaaagaaaagaggagtgagagagacctgcgtagctcaggagctaaatatctaatctgattttatgtgatgcttcccattgtctttctaaacagaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcagggcacagtgctccccaagcacctgctgcctgtctccaaatcttgccctgggtcttcaggagcagatcatcctactctccccaaagagcgggcgccagagaaagccaaagtcacaatgtctgtgaggatctcgagcaactcctccccatggcagtaggaatgcatgtagaaattcactctgttaagacctggaagagtttagcagttttagttcctaaaacttaactaccggttttcttctacacaggtgtctcaaagaattctaattgtcttaggaagaatcggtggattttaacaaattgtgatacagatatttatataaaaagtcatctttcagtgcagtggtccccaacatttttggcatcagggaccggttttgttgaagacaatttttccacggagagggtggggtgatggtttcgggatgaaactgtttacctcagattatcaggaattagttagattatcttaaggagcgagcagcctagatccctcgcatgcgcggttcgcaatagggttcgggctcctatgagaatctaatgccactgctgatctcacaggaggcggagctctggcagtaatgctcacctgccgctcacttcctgctctgcggccaggttcctaacaggccacagaatggtacagattccctgccgccaggggtttgggacccctgtttgggtggtagcagaggtttccaagcagtttctttaaggttttagctcaattgtattgcggaagatttgaaaattaaacatttttcattatgtacacaaaacttaaaagaagtttacgaccaactccctgaagagtcacctctgtagaactcatctgcttcaatgcaacgcagtccaacatagcataaagattatgcaggcggtaaccacctttccagagaactgagtgaaaagagctctttttaaaatgaggagtttagacgaaactggaaggtgacccatgaagagatttaggcatggtctctttttcactcttccaactgcaattatattcgccaagcccagatgaagctgatgattcaagttccgttagccatgttcattggtctaactacggggaaaagtcagccatagatttcaaagtgtgttcactgacttgaccaattactttatttctcagtacttacaaagatttttatcttgggaaagagaggataaaaatacaactgtattggagagtttaaacattaaaatcaactgagattggtcagctaaatggtcaaataaagtttttgcacctttttaataaaaagttttgtagccataaaattattgtgatgaaaattttgtaacataggaattaagttaatttatcaaatgaacaaagtcaaatacaaaatagtactatgccacttataaaacaaaataatatatgtatatagaaaaatatggatgggaacacacgcatgtttaggttaatttctaagagcaccgtaattatttagtagttgttttcatccattataacatttccaaggctatttcagagttgtgccaaaaacagttatgttaaaattattgtaaaaattattttctcctcttctgtcatagccttggcccttttgcacacggatcctctcaaactgacctttttttcgggggaggggaggggaaggtgggtctttctcccacaaagttttccttcctttctctttttttctttcatacgttttctgtgtttttctgctacaatcatgccaaagtacaaaataatactaattaacaaaatcacaagcactagaaaacagacatgaattataaaaggcctcataaataattctggaaagatcaaaaagtgacctttacagccagtaggggagtgatttcatccatcaaaacagctgccagagatgattcacatcagaagtaaaaaaacaaaaaacaaaaaacaaaaaccacaaacaccaccttaccagtataattaggatctcgttttgattctttaccaaatttaaggagagtatggtctgatatttcttggtttccctcactgattgtttctcttttcttcccagtgtatcttttattaagcacacatgaggggctgtcatcctttgattctccaatattttctgtctgggagaccccatgtacagaaacaaggggtggactgacagtttcaatttgactctagtgtcaaattgaagtgtttggctacttcctccaaaatctttcttcataggattttttttttgaaggttttctcaaagactacacctaactactgtacaaaaacacatcagtagagtctgcttaaaagacctccttcaaggtttcagtgagcatagatcgcaccactgcactccagcctgggtgacagagtgagactccatctcaaaatataaaatgaaataaaataaaaataaaaataaaaataaaataaaagacctccttcagaaggcattaatcatgtctttcttcctttttatctctctttctttccttccttccttccttcctttcttttttttctttctttttttttgtcacatccaatctgtatctccatgctgtctagagtgattagagtgattctctatcctttacagcaatggggcgcattagtccacatctctgtttttcttgctcactcacaggagataagattaaaaacaggtaaggataatattgttttatgaagcaggtattataatttcaaacttataaagaaagaaattgaaacctcaagatattaagtaacttacatctactcacttataagaatggataaagttcaaatatatgagaatatcagtactggttaggctacacatcagctggaactctcatacattgctgataggaaagagaaatgatcagcactttgtaaaacaggttggcagttcttacaaagttaaacttcacttacaatatgattcatcaatccctctcctacgtatttagccaagagaaataaaagttatgttcgcataaaaatttccatgtgaatgtttacagaagcttaattcataattactaaaacctgggaacgatcagatgtccttcacctggagaatggttaaacacattgtggttcatccatatgattgagtactactcagcaacaaaaagaaatgaaatattgactcatgcaacaacatggatgaatcttcaacgtgtcttggtaaataaaagaaactaagtctaaaggactacatattgtgtgagtttatttatattattaatacatatgggtagaagcaaaactataaagataggaaacagatcaaagggttggtgagaactgtaccatagacctgtataccgcaaaaagtaaatcttactgtgtataaattttttaataattagaatgtgagtggaaccccaaaagaaatagaaagtgtaacaaatgcttccaacaatattatagtgaataatgtaaacacagtgacactgtctttaatgtggaagaaaataactaacctaaataatttttgaaaacagtattttgaatagatattgtaagactaaaggcaaaagaatggcacacaaataccattctgtagttaataaatttgtttctcaaggggtataggctagcaattcttaaagtaatttatgtgagcatttggattgaacaaatgtgtataagtaaaatatataatagatcatagatcatgagagccagatttctcactgttgggaaaagtaataaataatgaagggagaaatctatgcagacccagtggagttgaactcatatttttttaaacattcatacatataggttgatacataaataaaattattaggagacttgagtgctttctgatgcccaacagcaaaggacaagcctgtggttactttattcaaattgattcaaaagcctgaaagactttcagcaaagtagataagaaatgtctgggaaacctaggtggtcttaatattaggaaagataacagaatttgtgttgtcaccatatttagttctgtcagcgtatctctttggtttttgtattgaggtataatatgcatatagtaaagtgcatgaacattcatcaaatgtttgtgaacgttttagttatgcacatacctgtgtaataatcctccaccaatcaagatgcagaatatttccaccaacccagaaattatttcattcctcttttcaatcaatacccacctctagagataaccactattttgatttctattgccttagattagttttgctttctcttgaatttcatattaatgaaatcatgcattacattttatatgtttcttatgttgaatactgttccattgtatgaatatgtcatcttgtttatctacttctctggtaatagaaatttgtgttgtttccagtttggggctatgatgaatacaactgctataaatgttcttatgtaagtctttttgtggacatgtgaaattgttgaaccttcttatataacttttattgttgtagtagaatctctgggtcataggacaggcgtatctttaaccttattagaaacttccaaggcatttttgaggttatatcattatggaaaggagtttcaattctccataaccttgctagtacttaatattgttgacatgtatttttaaactttttaattttgagattattataaattcacatatattttaaaaaattaagacagatcatatgtatcctttactcagtttactccagtggtgtaaaactatagtacaatatcacaaccaggatattgacgttgactcagtcaaggcacagaacatttctatcaccgcgaggatgctttctattgtccttttgtagccatattcatttcctctctgctcccatcccctccttcatccctaggaactattaatctgtccttcatttgtataattttgtaattccatatatgttatataaatgacctttggggattgactttttaaactcagcataccgctgtattttgtgtcttgccaaactcgagaagtttttggcttttacttctttgatactttttcagccttgccccttttcctttttagtgctctgatgaaaggaatgttagatattttgttatagtcctgcaattccctgaggcttggttcatttttttaatcattctattttccctttgttattcagattgagtaatttcttctgttctaccttccagttcactaataattttctctgtccactccattttgctattgagcccatctggtggactttttatttcagctacatttttaagttctaaaatttccattttatatcttggttcttttttatgtatcttacttctttgctgagatttctatttccacctgaagctttctgtttctttatttgtttccagcatgtctgtagttgcccttcgaaacattttcatcatggctgctttaatatctttgtcaggtaattttaccatcgctttcatctcagggttggcatctattgatcgtctctttaaaattctgtttgagatcttcttggttctgagtatattgagtgattttttttattgaaatctgaacatttgagtattgtgtttgaaactctggatcttatttaaaatttttgtttttcctccttttctctgatgccactccagcaggggaaggggaacaccgccttactacctggtagagatagaatccagggtccccattcaacctcattgacatcagagggcagggaggatcgtcaaactgccaggtgggggttggacttctgggtccctatgtacagatgagtcttgaaaaacatgagggtttggggcaccaacccccaagcattcaaaaatttgtatacaacttttggctcccccaaaacttaactactgatagcctactgttgactagaagccttactgataacataaaaaatcaattaacacatattttatatgttatatgtactatataccacattcttacaataaagtaaactagagaaaagtaaatgattttaagagaatcataagaaagaaaaaaatatgtttacagtaccatactgtatatagcagttctgtaagtttatgtagtctgttcacaagatgaatcatctgtctgaaattgcaggcaactccaattgcagctgcagcttaatatcaagcaataaagttttttcttgtaaggtcatgacttttctctgcttcttgggcgcacttccagcatcactagtggaattttgtatggattccatggtgttattcaaggtttacactattgcactaaacacagcgaaaagtgtgggagatcggtgagagatgactttttactgcaatgcgcaaatggctagagagatgaactgctcatgtggagagaattagcattgcattttaagtaggtattcacaaacttgagctcactgcaacagcaacagaaggtggctacaaaattattacagtagtatagtatgtactatagttaattttgtgcagttgtgatttaatactgcatctttaagtttgtttgcatttctctggactccaagtgccgccacatacactctgtgtttatgtgcttaagttttgatacatttaaaatttttataataaatttgtgtatgttttatggtagtaagtgataaaatagactagtatttacatgcattttacacattcatgacatatctttttcttaattttattgatatttttagactacgttgtgtgtttgcaagtttttttcaactttttgcaaatctcaaaaaatttttccaatatatttattgaaaaaaagttcacatataggtggacccatacaggtcaaacttgttcaagggtcaactgtagtctccactgtaatttatttttcttcctttatggttagggttttttgtgcacttttaaagatattgctgtccacttctaatataatacagttgttctcctgtgtcttcttttaaaactttatagcttcacccttcacatttagatgtctgacccatctggaatgtgtgtgtgtgtgtgtgtgtgtctgtgtctgtgtgtgtgtgtgtctgtgtgtgtctgtgtgtgtgtgtatatatatgattaaacaattactttggcatctatattgaaaagaccatttcttccccactgaattgcattggcacctttggagaaaatcaagtgattacatatgtgttcatctatttctgggcatgattctgttaaatcatctttttaacaattctcataccaatagaccattttctcttaattattgaagtttcacataagtcttgaaatctggaaatgcaattcctccaactatcccccacctttttcttcaagattgtctagcttgctataggatttaaatttccatagaaattgcaaaacagattctcaaacttctaccacaacaaatttctagtaatttgattcaaatttgctgagtttatgatcaggttgagaaaattgataatttaaatatggattccttagatttataaatatagctcttcatttatttaggtcctctctaattccttttattaatgttttataattttcattttaatgaactttcatatccttaattaaattcattcatttatttcattgtaaatggcatttttattttattttccaattgtttttagctagaatctagaaatacaatggaattttttattcaatgactgtgcaattcatccattagttctagtagtttctttacagatccttttaaatttttttatattcaaattatgttatctatgcagaagaagaattttacttattcctttcccaaatgtatgcattttattttctttcctgacttgatgccagttattccaatgcgataataaatggaagtgtgataatgtatcttgttcctaacctcagagaaaaaatgtttagtattttaccattaattacaatgttagccttggatatttttatagataccttttatcagattaaggactcttttctacatttctagattgttgagagtattcatcatgtgagggtattggccttgtatcaaattctcttgtgtgtgtaagttttgataaatttaaacttttaataatagatttgtatatattttatggtggtaaatcataaagaagttaaaataagttgaactcattattttggtttttcatcaagcaaaggaggagaaaaccttacccattatgatcttagagatcatgtaatcttctaaaatgtaagatactctgcgaatactcagtagattggacaaatacattttttattctttagagctatgcaaaatacttaatgatttttcaataccattaaaaaatcacctgttagtggcctcaattgtcttccaaaaaataaaggcgaacaaaccaaaagcaaaaaaggaaattgcattaattacttttcttctgcctttgttaatgtaacaacatgatatagtcctccctactttcagtaattgtttgtttcttcttatattttcggcagtactgtcctgttaacttacatctttgtgatctggtacagagtaggctcttagtgaatattttttaaatgaatggaatattattactatgacttttactctatatctttgtagcttgatttttcacacccgtgttggggaaatttattgtctatcattgaatttttgcctacaaatctgaccctgtgtttaccccattgtagtcttttgttcaaaatctattccagaaaactgaaagagtgcacagacaataatttaaagatttgctcagcataagttctctcagtaaatttgtcagttatgactcatctacgcattcatgaaacaagtaattattgagtgcttattctgtgccaatatctcttttttttttttttcttttgagacagagtcttgctctgtcgcccaggctggagtgcaatggcacaatctcagctcactgcaacctccgcctcccgggttcaagcaattctcctgcctcagcctcccaagtagctgggacaacaggcacttgccaccatgcccggctaattttttgtatttttagtagagacagggtttcaccgtgttagccaggatggtctcaatctcctgacctcatgatccgcccgcctcggcctcccaaagtgctgggattacaggcgtgagccaccatgcccggccgccaatatctcttataaacattgaatagtatgggcttttgaactagcctttaattatgggaatattagaaacaaaagaaaaattaactccaagtcagcaattgagaattataatgggaatattattgaaataacaaagtaatttaaaaaatagttaaaacctttcttggagtgttagaggactgataaaacaaagatgagtacagaggtattaaaactaagatacctaccttcaaacctgataaaagagtcagaagattgctggctgactttttgcctgattatagctacacagttcattcagtcagtcagtcacaagagggggctgcttcaccttaaaactcaggtttctttcttgcagaagggacgctaagcttatgttttccactaaagttccacagaaaacaggaaaaaaaatgatacacttttatcctctttagacaaattgtactttatgatctcttattaagtgtgttatggcttcaaaagttctggggcccttacactgatggactaagtcttttcagagcacctcccttaacactgctttctccaagttacacttccctaatcatctcttacctcccctattccttacacctttttcttcctttcctttacctattcttaccaccatcaccccaaacttctttgcttttcctggtctcttttctttccgcctcagtgtccttggtgcacacagtaggcataagcacgggcatagaaattaggaaatgaacatgaaggccatgagtttaaggaggatgagagccagcaccatttatgtcattagtcactatatcaagaacagatatattgagaaatggctacttagacaacagtcaacacatgattccagggacctctatagaaaacccgagtttggggagacttagctttcagtgtcaatgttatcaatttttattttccccctgagcacatcacttcctacttttgaacttcacttccattttctagaatgtagatgggaatttccaactccttacaacacagagctcactataggcttctgggatttaatgacactttccacaagctccatggagcagaggaaactttatttggtacattgaggaagaaatgatggaagaaaaggtctggatagatacatccttatgatcagttttcctcattctgtgccagcctcttagactttaaacctcataaatgatttcagtagacaccccctgagttgaggatgtctggttgatatcctcaccgtcttctcaggaacatgactaaacctggggaggaagacatagaaaagcaactgctctatcattggctgacaagatcctgacaacaacacaatgagagctgcactccttgcaagtctttactagtagctgttgcttctgttctctggaaattctttaaacctagaatcagacacaaaaactgaactctgggtccacaatcctcatttgtccttgaagtatgaggctggtggcaagagtaactgtgtttctgacctttggtaagtgctctgtgtctacctagggagggcttctgaggacaagggaccccgaagggtggtttgccctctatgctccctgtgctttatccagcatactagatatgactgagaactgttctgtgcatttgtctaggaagtacatacatctacataccaggctagatcataaccataatcccagaagagcccttggcagtattcagttttaagaaatctatgggtttactaaatcaagctcccatggaatacagcctagagggtctctgattattggcatgtatctttggtctttataattaacagcaatgatattttttgtgttcttgcaggacataaaagttttggagtgttaagggagtgttgtatccttgatccatagaattgcattggtttgagagtcaggagctaatctgattttcttgaccccttaggaactataattgatgctaagaccacccagcccccctccatggattgcgctgaaggaagagctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagagtcgcacactgggacagatggggctgcacctgtgcaatatctccctggtggcaagtgaggaggagggtagcattcacctagagcaaaatgtcgataggagtcaaaaagtaacaagaaaagaggaaaaggaagggaaggagagaaggaggaaaataggtaaagtaaataagggagatacgatgaagggtaaaaagataagaataagaactttattgttgatgcggctgagaaaaatgataaagaggctgtgaatcataatttgaacatagcaataaaatgaagagggttaagaattttcaagactcttcttcatgtcaaaaaaaaatcatttcagtttgttagtaaaaatgaatggataaggaaaatcaaaataattctgcttgtcccaaaggcttttttcgtctggatccaggggcaagtccaagctttgaaatgcatgctgttatagttgttccaattaccagaaacaagttgatgtttctgcaagaaaaatctgaaatgttctttcttactagtgcagtaacatcagttactagagcatgcatatttgtgatgaaggtttttctttttggaaagaaacaaaaatcaaatgaatattaatttgtttttatttttcttgaagtcttgaatctttaaatagtcttcatcacgttttatttcctaagcagcacacaaatccatcttaccataaaagactcagataaagcaaaagtgaaagacctagctgcatttcctcattcttccctatctcacaccactcttttcaaagaacactagctttgacagtttaaggtataccatgatagccagtttaatttcagttatctatgtttgcatataactttatgcaatcacacacaaacttacatacatacacacagttttgtcatgtaaattggatttattagattttttaacttgccatttatttttcatttaataaattgtcctagagatctttctatatcaatagagaagttcactttattctttttggtgcttatttagtactttgagacattccatcatataattgcttttctcttgatgcatatttgttcctattgcctcactgtcataaagaacattgtgttctacatctttacagattcaccttagtttgtgtgtatgtggaagtgtttattttaatgagatttctgaaactgaaattactatgtcaaagggaaggtgcatttaaaatttttggagaaagtggcaatttgccctccaaatgatgtaactacactccatataatacatatatatgtattattatacacataatgtatccattataactattatataattaataaatataatacatataatgtgttaaatagcttccaaccaacagtaggtgaaagaactcattttacatttttataaaaattgaattgagaattactaacggcttttatttttattttacttaattattctatttatttattttgagtctgggtctcactcttgtcacccaggctggagtgcagtggccggatctcggttcactgcaaccttcacctccaaaactcaagcaatcctcccacctcagcctcctgactagctgggactacaggtacacaccatcactcctggctactttttgtagagacaggatcttgccatgttgcccagtctggtctcaaactcctgagctcaagagatctgccagccttggcctctcagagtgctgggattataggtgtgagccaccgcacccagcccagtttttaataatccaaagatatattatctttagtcattttcctgattcatagtgtttttgagcaacttttttctacatgtattggcactttttcatttggcaatatgcttattcctaccttttgaatatttttctatttagttgtcctcttttctctttttattcgtaagaattagtttcatgccttaaataatacattatttgtatgaatattttattctaacattacctttttattgcttatttctaatataattttaaatttttacatattttaacctatcaagtattcctttcctttaggccttgaaggtcaatatctttacaggaaatccctaagtatatcacatattttaatatttattaccatttggttgagaattattttgagatgtatgttacagattagaaaactgagtctcaaagagatttaaaaacctgctaatattcacagtattaataagtgagcatcaactttaaatttatttttaaacctgagattgtctaacactaaaatctgaacacacattgtttaacctcatcttactggaagcaatcataagaagaaaaccccaaaataatgaatcaaataaagcatcagtggaatggattatagtagccatctaagacacatgttagagcaaaaggtccggaatgttagggtagaaattgcgagttatgagttgagaaagtcaatggtccttaatcttatagaaaggtaatgttagtaccccaaacattcaaatagcagccaaaatgggtgttttgattgtggaagaactctaacgcatcctcagctctttattagccatatgtgttcccaggcagaatggatattgaagaaattagaacataaagcaaaggaagtaggaaagaggagtttgatcctggatctgagtggcttccaattattcttggaaacttcacacagattgaggaatttttctggtccatagaatgggtagataaatgtaaattactatgatgatcatacttggaaattgctttgattccatgagtgaaagataagggaacagatatctacacacaaatcttagaaagtgcactgagatgtgctggtagcagtttccaaagattgacatatcactttcaacgtccttacagtcactttattcacactccttttctctttcacacagtctttaatctcatttaccttttgtttaacaccatcctctactctcctgtatttgaacacacaaatgtttgaggcctgtatttttggtttttattcactgaagcatcctctgtatctaggacagtgcctggcaaatagtaagtactcagaaaatatttactgaacaaatatatttatttataattgaaaatttttactggcaaatactaaggatgcaataaaatactagggacatgagttagattcgctatgaggatacatgagccattcagtgagaagcccgaactcatcaactttaaagaccattaatttgaatcccctttagccattaactcccatagccaccatctagacaggtcttatgataatgttctgctccacctctgaaatcttacctgcagtctaaaacctcccgccctgagattctcaccctcagttactctcactgtacttgttctttgactatatttggttatttaatcccttgacacctttcttttcttttttttttttatttaacttttgttttaagttcaggggtatcgaacttaaaataggtttgttatacaggtaaacttgtgtaggtttgttatataggtaattctgtgtcatgggggtttcttatacagattattttgtcatccaggcattaaacctagtacttatttgttatttttcctgatcctattcctgctcccaccctccaccctcaagtaggccccagtgtgtgtttttccctctttgtgtccatgagttctcatcacttcattcccacttataaaagagaatgtgcagtatttggttttctgttcctgtgttagtttgctgagaataatggcctccagttccacccatgttcctgtaaaggacataatctcatttctttttatggctgtgtaggattccatggtgtatatattaccacattttctttatccagtctttgatgggcatttaggtcgattccatgtctttgctattgtgaacagtgctgcactgaacatacacatccatgtgtctttatgatagaatgacttatattcctttgagtatatacccagaaatggtattgctgggtcaaatggtatttctgtttttcaatcttcaaggaattggcatactgtcttccacagtggttgaactaatttacattcccaccaacagtatataagtgttcctttttctctgcaacattgctagcatctgttgttttttgactttttactcatagccattctgactggtgtgagatggaatctctttgtggttttattttgcatttctctaacgatcagtgaagttgagatttttttcgtattattgttgactgcatgtataagacatacatgtaagacatacatgcagccaacaataataacttcttttgaaaagtgtctgttcgtgtcctttgctcactttttgttggggttttttcttcttgtaaatttgtttaagttccttatagatgctgaatattagacttttgtctgatgcatagttcgcaaaaattttcttccattctgtaggttgtctgttcactctgtagatagtttcttttgctgtttagaagctgtttagtttaattagatcccatttgtcaatttttgcttttgttgcaattgcatttagtgtcttcgtcatgaaatttttgcccatttctatgtccagaatggtattgctaagttgtcttctaaggtttttatacttttgggttttacatttaagtctttaatccatcttgacttagtttttgtagacagtgtaaggaaggggtcccatttcaatcttctgatttgtctagtcagttatcccaacaccatttgttgaatagggaatcctttccccattgcttgtttttgtcagctttgtcaaagatcagatagttgtagatgggcagccttattcctgagttccctattctgttccattggtctatgtatatatttttgtaccagtgccatgctgttttggttactgtagccttgtagtaacctatagtttgaaggtggggcatatgatgcctccagctttgttcccctttattttcaccttatttctcagaagcttcttatcttttattttcttacctataatgcttatactctattacctgttgctttcaatctttagtcattgactatattattctcatcccaattctgcatcatagcagtgatctaattaattcccaatcatgaatctgtgtcttccttattgtaatgcatatcttgtctgatcagagtacaccgatgcgcagattggtgtcattaaaacatactgttaccagccgggagcaggggctcatgcctgtaatcccagcactttgggaggccaaggtgggtggatcacttgaggccaggaatttgagaccagccaggccaacacagcaaaaccctgtctctactaaaaatacaaaaaaattagccgggcatggtggcacacatctgtaatcccagctattcgggaggctgaggcaggagaattgcttgaacctggaagacaaggttgcagtgagctgagatcatgccactgcactccagcctagacaacacagtgtgactctgtctcaaataaataaataaataaataaataaataaataaataaatgttgttaccttcaaaattaactaggcccacaatgtttccaggaaagtattcttcttctctgtaatcacatctcactgccattttctaaaacttctcacatacctcagacttcctaacccagatcctcctccattcactctcttgggagacatttaatctctgtgtataacaagaaaaaagatcccattagaaggtaataggtgtttcactttctaccttcacactccaaagtatcacttaaatctaaactactgtaatccttttctccttcatttcaataaaattgaaaataactgtttttcctcctaccaaaactttgtccttctacccataatccacattccaatcccatctgtctcctcaaaactttgatccattgtttatacattctttccaaaagcatgtaaatataccctaatttgtataaaccctaccattacctcttcaacatcctcatccagttaacaccatgactcttttctcctctttagaggatccagcaacctctagaaggagatttctatattcaaattttttcttccttgtctcatcacaatgcctcttcccacagcagttgaccttttgctgaaaagaccaaaatcatgatttttgtgttgttaaaaaaatcagtagttcaatagcacagtatggtgactatagttatcaataatttattgtatatttcaaaatagctagatttggaatgttgtcaacacaaggaaataataaatgtttgaagcaatggttaactcaattaccatgatttgataattacatgttgtatgtatgtatcaaaatgtcacatgcatttcataaatatgtacaattattacgcatcaataaaaaatcaatagacatcgaaaagttatcatcttatagacatttatttaccactcactctgttagccattcatttctttttagaattccttttccttctcttttagaaatccagccatttctgatttgccacttacctccctggataccctttgaggtttccttttctttttctttttttttttctgagatggagtctcactctgtcacccaggctggagtgcagtggcacgatgttggctcactacaacctccgcctcccagattcaagcgattctcatatcccagcctcccaagtaactgggactataggcacaagccactatgcccagctaattatttgtatttttagtagagatgggatttctccatgttgaccaggctggtcttgacttcctggcctcagatgatcttcccgcctcagcctcccaaagggctggaattacaggcttgagccactacgcccagcttcaaggtttctttagtactttttccattatctatcccttcagtgtttgggttccttgaggatttttttaagtccctattctcttctaaattttgctctaagcatttgtctcggtaaaattgcatctagtcttatagggtagtactacgtcacagataacatagtgggcaaggaactgagcttgcagtggaaaagaattggattctaatccttgcatgtccttggacaaattatttaacttcataaggacttgatttcccatctgttcagtatagataagatctactgtaaagggttatagtgtaaaatgtgcaatagttatcagtggtcaataatgtggattattaaatcatattgatgagacaaactccaattctgttgatatagcagatcagccagacttgttttctgagcactggtcacaagaccctgctgaacaaaacaggagctgatcaaaacagaatgcagcaaagagagtggccaaaaccagctaaaaccaagatggagatgaaagtgacctctgattggccccactgctcattatacactaattataatacatttgcatgctaagtgaaactcccaccaccaccatgacagtttacaaatgccatgacaatccccagaagttaccttatatggcttaaaaggggaggaaccctcagtttagggttccttttccaggtaattcatgaatttatttattatttagaatataataaaaaaatagccatatatatagctagccaacaatccacaagggctgtaactgctgctgctattactctgtctatggagcaaccactttcctgtactctgtagctccaatacacttgccttcactttgctctgtcagctcactcatgaattctttcctgtgtgaagccaggaaacctgctgggctggttttggggatcacctacatcactatcacttactatgacttggacaaattgaatcttttcttccatgctttagtttccccgtttataaaatgacgatgataatagtatttacttcataggattaaataatattatttactttataagattaaaatagcttcctcataagcagacccctgaaaacactgtcatcagattattctgctaagaaattcaaaccaaggaaatggagcccaaacccaaaagactcagtgtgtttccacatttgacctccagggggcaatgtctcacagaccggaaatgtctctgctaagaagagttctgtccttcctgagcggctttatctcacagctcactgaggtccatattctgagtaggatcaacaccagagtggttgttgtcaagagagcagctcttactagtggtctctaggccttacctaagcagggaactcttgaatcccagattttcctcattatagggactcaccatcctctggcacattccttcccactcaggagatcttctagaatagagctctcagcttcctcactgcctagccatgctcttagtggtcattctgctgcttggaatgttcttcacactgagtaagtataataatattgtttccctgctcccgtctccatacaaggaacattgttccaatcggaatctaaatagagactctgtctcattacaggtagatctgttctggtctcactaacagagtgttgatgttgcaggaggaaccagaacccagtcggtgacccagcttgatggccacatcactgtctctgaagaagcccctctggaactgaagtgcaactattcctatagtggagttccttctctcttctggtatgtccaatactctagccaaagcctccagcttctcctcaaagacctaacagaggccacccaggttaaaggcatcagaggttttgaggctgaatttaagaagagcgaaacctccttctacctgaggaaaccatcaacccatgtgagtgatgctgctgagtacttctgtgctgtgggtgacaggaggactgtgcctgggactgcaggaggagctgaacacaaacttcctgagacactgaggttttcaggaactcaagggcacagcctgacctatttgtagcaaggtctctcatttgatgaaagtgagaaaggtggaagaacagagccatgaggagtgcttgactccagagaagaaacagagacttcaacacgttccttcttttactactgggtcacatcagacaagatgtagaagagacagacttctatgactgttctccttctgcttggaaataccacactgaagagggtcaagttttttttttattatactttaagttttagggtacatgtgcaagattttaaattagtgtgaccagtactggactcctgatcctctccttctcactgccaacatgctgcttctattaccttttgtttttcaatcgacagcatctcattctttcagaatctctgcccgtagcctcagagttatttttgactcttattttttctttcactattcacattgaatccatcaagaaattcagttggccctaactaaaagatcgacccatagtttgaccactgctatctctttggtcaagccaccctcatctcaatgaattaccgtagtagccttccaaatggtttccctgcttgtcctcctacagaacattcttaatacagcagccaatgagatctttcaaatatagataggtcactcatctactccaatccttgcaatagcttcccatttctcttagagtaacatcaaagtacttacagtgacctataggaatgcatgatctatctctcgttacatttttaaaacaccaacagaaaaataactttggcaaccctgaattctataccaataaaaatatcacaaagaaattatagtaaagacattctcgaaaggaaaactgagagaattcgttgtgagcagacctgctataaatgaagtcctaaaggaagttattcaggctgaagggaaaggataccagaggaaaatttgcaacttcaaatacgaaggaagaacaacagaaatagtaaatagatgataagatacaagaaactagtttccatttctcttttacagtcagctttactgaggtataagttatatacaaaaactatacatatttaatatatgcaatttgatgagtttggacatatgcatacaaccgtgaaaccatcatcacaatcaaggcaatagacatgtttgtcatctctaaaagtttccttgtgactctttgtttttgttgttattgctgctgctattgttgtaagaaaaattaacatgagatttaccctcaataaattttcaagtgctcaagcctgtattgttaactatggacactatgttgtatagcagatctttagaacttatttttacataactaaaactttaaaaccattgaacaacaactcccaatttctccctccccccagtccctggaaaccattattttattctctgcttctatgaatttgactattttagatacctcaaataagtgtaatcatgcattatttgttcatctgtgactgggttatttcacctagcataatctcctccaagttcaatcgtgttgtcacaaatggcaggatattcttctttttcaaggccgagtaatgtttaattgtatgaatataccacaatttatttatttatttgtcactaatctttcttttccatatcttgcatattgtaataccacatgcagaagaataaaattgaacaccatacgcaaaaacttactcaaaattaattaaagacttaaacatgatacctgaaagtgtgaaactactagacgaacacgtagagaaaaagcttcataatattggacatgacagtgatttcttgggcatgacaccaaaagcacagacaacaaaagcaaaaaaagacccatgatattacatcaaactaaaaagcttctgtgcagcaatggagcaatttatggaaagggagaaatatttgcaaaccatatattgataagtggctaatatacaaaatatgcaaggaaccataaaactcagtaacaaaaaaaaacaagtttaaaatgggcaaaagactcaaatagacatttctcccaagaagacagacaaatagtgaacaagtatatgaaaaggtattcagtatcactaatcatcagggaaatgcaaatcaaaaccacaatgagatatcacctcacaaatgttaagatgaccattattttttaaaaagttaagtataggtgaggctgtggcaaaactgaaatccttgtacagtgttcttgggaatgtaaaatggtgtagctgctatagaaaacattatggagttcctcaaaaaattttaaatagaactaccatataatccccaaaccctacctctgggtatatatccaagataattgaaatcaggatctcaaatagatatctgtattcccatgttaatttaagcattatacacaataatttctcttcttaatttatttaaaatgcatagactgttgaaataaaatgttataaaattccccgttggggttttcaaagtctaaagatggaaggcatctgagaactataacatgaagaaatgagggtaaagtaacctatatacaatttctatattgttcatgaagcagtataaataaatataaacagactgtgaaagattaagtagtaagcatagtagtagtaggcaatcctaatagaaaccactaaaaacataatacaaaaagaaatagtcaaaaatcaaatagatacattataacagaataataagagaccaaaacaaagggcagaagtggaaaatgaatactgaagtaatagacttaaatacaaccatattaatagttacattaaatgtaaatggtctaaacacagatatttaaagacagagattatcagtatggatttttttcttaaagaagacccatctacatatgaactgactttaaatacaatgacaaagattaaaagtaaaagaatggaaaaagagatccatgaaaacactaatcaaaagaaatctggaagggctatattaacatcagacaaatgggacttcagaaaaagaaatattaaagaaataaagtgaaatattacataattataaaagggttgcttcactaaaaaaatgtttaaagtgcttgtacctaccaacaaagcttcaaaatatttgaagctaaaatggttagaactaaaagaaaaatagacaaaaccgctattacacttggagacttaaaccctttgtgttcagtaaataatagaacaagtgttatagttagagaatcagcaaagatgcagcagacctgctcaacactattatattgacatttatggaacactccagtaaacaacagaaagaacataaagccatgcttagaagaaaatttataacagtaaacatttacattagaaaaagaaaaaaggctcaaatcaataattttatttcttccttctgtgtatccccagtgatgaatgtcctgcacagaaaaaagtaatcctagcaatccaagaaactctgtttttgagttcaggcaaagaagagtattttctgctgttactgcaccaggtacccaactggaaaatgatatgtctcatattttatattgctctcctatgctcaaagattaaaatgagattaattctatttatatcacatgtcacagttctggaggaggttatgagccttcctattatagtaatgatatcagaaagggtacaagataagtttagtccttcatcttttaaaaaaatatatcagttatgaagattgttcgccacgaaatgaattccgttatatacattataaattatataggacattatagggtaccttacaatacatctgcgtattttcacacaaggtgagatatcactaattattaaatggaactatgccactatgtttttccttagcttttcaagggataagcacaagaatattcaagttatgcagtgggtcaagcctaagaacaaatgggaaagctgatagaataaagaaagactcaggctaggttctggactagctgggactaacatataataagtccataagtgcagaatgaactggatgtgaggagtgtgtaacccttctccatttcaacgtgcccaccttttgctttatttttcgctgaatgcctctcaatataacaatgtaacaacacactgacatgtcatttaagtgtcagaagcattatgggacatgatagagggaacaatcagcttttctgtgtcctatttgatctttgacagtataaaaatctgacttttttcctgtgggcaggtatagagggcgtatatgataattttgtgtactttctgctcaatttttctgtaaacataaaactgctctaaaatagtctattaactttgaaaaatcaattttagtatagaagctaaaaagaaaaaagaaaaatcaatccaatgcgctcaatctcatagaaaatatttgctacaaccagttcggattatttcttactttcctgccttgtgtactctcttcaactttttgtgttggtgcttctttggtttgtgtatttactatgcagcatgcattatgtaaagttttgcatatattatataatttaagtatactaacataaaagtagaaataacttctgttaggaaaagaaatataataagtaatttaaaagaaaaagtttatggattggatagggtgtgtagaactctcaactctgtcattatttgaattatagtagaaacgttaacaaacatcttaaatttcaattttatcatctgcttacaggagatcatcatgatcatcctgtcagcagttgttccaattatcgaataataaaatatctttcaagggcttagctcatattctagcacaatgtaaacatttaataaattattataggtaaagaaatggaggcccagaaaacataactaattttgctcataatcagaaacctagtgcattagagaaagaacactgagttttgaaatcctagctataaaatttaagccaaatatcttcaacttatgatatcactgatctattctcttgaatacatatattggaagtaaaagatgagcagctagagaaaagtagaggaaaagagagaaaccaggggaagcactttgaaaccaccaaacatgtattatctcttcagatattcaatcacacagataggcatactccttgatggccatttgtactagggctgcaggacttgataaaagagaacctacaacaacattctgtaaccttcaattgatttgttgccctagatctggtccgcatctctctacaaggttataaatgtaatgttgttttcagctgtttttccttgtattaatgaaatggaaaatcctttctcttctgtcctgacacagccctgattattaactggagtcacaatatttttctttctattgttatacaaactgtgtggaaagtattctctttattctcaagactatgatttaatccagttagtaagagggaagatcaagatagttagcttgatttttccattattcagtagatgggcctttatataaatgaagcgggagactggcagtttactcctatactgtgtgagcttcctttcattaagacctcggtgtcttacagcttctcatgactcttctctctcccactgtcaccttctatagcagcagtctctttcctggcagatcttaatgtgggaattaaaaaaggattgatgtgtccacatattaccacagacagattgatagggtcaggctagaaagaattatgtagaaaaactcggcgatagaagcaaaaggcagaatgggatgtacagctgagccagaaaatacaaggcaagaaaagataacagagatcgaatgcccataaatgtccttatttctgtgctagggctctgtgactgcaggtacaacagagaacacatgagatcctaaggaaagagtgtatgtacgggcgttggaggcctgtgagtaccatcagaacttcctgagtttcttccaaatgtcctttcttcagtaggtatatctctgaagcacctgtgtgttgaatgaagaattacctaaagggctgaatctttctcttcttaccttttctctagtcagtgccagactttagggcatgttgtcctctgggatcacagacctcattgaaaacaaatcccagtatcccagtacggcttccattctagtgggaatgggaaggcaggcccccgttgtgctcctctcctggggatgaatgttcactgaggttctgcagtacctctatgccatggctctcctttagtcctggaaacagcattcagactccagtccgtcatagcagtcactcaggatcttacagccagctcagcaacaaacaaaaacatagtctggggctcatagcatcccttccaaagactagattttctgatttcaggtacaagattcttgtggcaaatgacaaaaacaatttgtcaattcttccgaacagaaggtccagcaacccgaacctcccagggtggaccagagagatgctgttgtatatgactatgctctgagagggatgagagtgacaaatgaggctgctaccttgtgatagccctatgacaaaaatgaaaaggatggcagccttggaagccagttgaaggaaagatacataaaacacactagcaagaacagaatgcttactctttctttttgataagaaagcccatctgtcacatgcttccttggtctagggaccaggttacaataataatgatgataatgatattaaaatatatcatttaatatcattttcattagtaataaataaaaaacaagatcaagtaagtaagcacgaaattcaagtaattagaagaaagaaataaatctaaggaaatcatgaaaatggtacagataaatgtataaacataactaaattatgagaaaaaagaaaaaatagaattggacaattttttaaaaattgaatcatgaaaaaattagattaactcttcttttattgaagtaattattcaaaaaagagagaacctatgtaataggtattatacaggtgtatagatacatttatatatacattatatagttttctatcactttgttatcttaatttatgttttagtcctccgtgtgtttctccttccttcacctgttttcaagcaggtggtgtctctgtgtttcaacatgtaagtgatgatgcctgcgaagacagaaagctgtgtttgcctgtagagtcttctggcttgttttgaaaaatctaatttctttcaggaataatagggtttatggaagtgggagaggtggaaggaggttttttggtataaatagaacagagaatggcttttccaggagagaataaaggggtctgtgggtcctaggcagcagggaacaggtcgttgtttcttgacaactctctgagaattagtaagacccaagagtgggatggctgtttgataattagaaagagttcccaggcttgcaaaatattttggggactccataaacctgaaaaacagaaatcttccacttagaatacacacctaacatgaatagtttataacatattggataagaaggctatgtttgtgattccactcacagaccatagtgataccatttatagttaaattggcttgtgagaacgattactaggcaaagaatagaacttgtcttggttgtctttataatcacatacacaggtctgtctctttgaagcattagatctcaacagttcttaagtttggatattgggctgggacagatgaagaagacctggggatccctcagttcagctctcatggcttcacattggatgtgagcacagaggctgtcaaagacttttcccaacaggctaagggatagggcaaacagtcacgctcattgtggattactcagaattccctatgagaaaggcataaaaaggttgtaaattcggtagtaatcctgaatttacaatcttatgcagttctgcccatcaacagggagcagacttcgtgatctctgcacgccaaagggggaaagaagatcaaagcttcttttcatgctttaacaggtattagcaaaattctgagaaggattgccaatatcctgttcataatgaatctaaactggagtgaaaaggaagaggtaagagctctccttactaataaggaggcagagcttcctccacccttcagtcttccagcctgaggctcagccacctacctctgcgtgctatgttcttttggcacctgcagcctgtccccagtggtgctgctgggcttatggctcccagtgtcaaggcagcaaacttattctcaacaggtgtatagggaaaggcaaactcagtgaatcaaatatttttaatattctgaaaaaatgatctggaaatacaaacatataacatttaataaatattatttataaatcatatgaaccattatcaacttctcttcctctgcctcagccatgtcagtaactcagttactctctcttatttcttggcattatatgatactcgagattattcaagtgtatacattggcctatagtagttgcttttctgtttctatcccctaaatattggttatattatcttattttttgctcctacatgaatgggacctacaatataagcagtccccacatacacacacacttgtgcttaaatctcaataatctcctactagtgaatgcagtgcaggtctctttaatttatggttacttttttccagtttcttccatttcaacaatgtgcacattttgttttttgtgccacctcacaatttttctttcctgactctttgtttccttgagaggatcaggcaagaggaaactgacttctctcatctatccatacccactctgtgatcttagataggcttcttcctctatcatatggagacaattttacctactctacctcttacaggattattctgaattatcttccaaaatgaagatatctttgcatcaaataatatagaactaggaaagaattatatatatgatgagatgagcctcattgtatgggtgaagtaaaatgtggactatttctgaaatggattgtatattaaattgcaatctggttagaggtttaaatcactaaagaggtagttattcatataaaactgacttagagttgctttgataaattaatcaggaacacagaccagttaattaatttatagcacctgttaacatccaaagaaattaaacctttcttctcaaaattaagctctaaccatttacactatagtcattttaagaattttaggattatgggccaggcgcggtggctcacatctataatcccaacactttgggaggctgaggcaggtgggtcacctgaggtcaggagttcgagaccggcctggccaacatggcaaaaccctgtctctactaaaaaatacaaaaattagccaggcatggcagtgggcacctgtaatcccagctactcaggaggctgaggcaggagaatcgcttgaacctgggaggcggaggttgtagtgagctgagatcatgtcactgcactccagcctgggcaacaaagcaagagcccatctcaaaaaaaaagaaaaaaagaaagaattttaggattatgtaaagctactaattggcttacagaaactgactaaaataggaggtcttttccttggaaggaaaagatgtaataatctcagttttggataaaattgggtaaacagatttccctacggtggttaaagggataaaaacacaagatatccccagcatctacattacagacttcaatgaaggaagtaaaaatatctcaatagttgagttgaggaagtgggtcaaggatatgaatatccacagatgctgacaagggaaatatatgttatattcataaaattcaagtaattaagataggtaagtatacatgtccacttaggttagatgttaattcttaataagtaacataatgatctgaggctgtttgtgtgccacttctacatctcaaactttgacgtggatcccctggagatcttgttaaagtacagattatgattcagtagggtctgaaattctgcatttctaataagctccaaggtcatattgaagccgctattctgctgagcaaggtttccactatctgagaggcagtattccacaggacctaagtgggtccactctttagccacactgcctagattagaagactggctctgcccgcttactaactatatgattatgggaagattaatgaacttctctgtgtctcagtttcttcatttgaaaaatgagaataatgttaacttcctccagtgatgttgtgaagaataaatgtgttgatttatatgaagtgtttagaaaagtcaacaacattgttaattgtacatattgtttgtcaagcttgccatatcaaaaatatctatgtgtttttgactactaaatacctgtgtgtttttgattggtatttaattggctacttgtgtactagttgtttaaaaagggacaaggtgactaattattgagttttacatagttgttacacttcttcacataacgcttgtcacagaacaatatagtcatatattctgggcatttttcactcaggatgagtgtggctgatgaggctgatgtattcttggatttttctaggtgatgattcatctgggctgggcctttcattagggcctgttgagaaagaattgaagtagtaaagttgagcttcagggaatcctctaaatagattggttgaaacacagtctggtttatatacataatctcaatgaagactcaagacatccttgtggcataagtaatataagccccattcaactcattagaaaactattacaggcgtgggttaagtaaattgtttgatgtgacctagccagtaaatggcaatgatggagtattaatataagtatatctgaatccggtatcaagtcatttaggcagaattcaccacttctctacgaaaagtgttaagtgttaaaaatatttctgaaagttttctcttgtatccaaacatttttatattcagtattctatttgtcctggtgatcctgagctcccttgaggacattggtggcactaaggggaggcttacacagaactggtgccttgaactcagtttcccctcaccacccttatcacactggaggctacccagggtggactcagagtggaaggagaattgttcatgtggaccacaggctctcaccgtggaatgattctggaggacttgatagtgtggctagaggttctattttaagctctgagaaatgtggaaaatctcctggggaggtcaacagttgaccctggccctttcctctctggtgcaacctccaaagggctattctatttctctcactgagctctactttatgtgtaaaggcaggttggatagtttccaaatctttgttgggctgcccctctaaaccttggataaagtctttccctgtggccccattgttagcagttattacatgtccaatgtttgcctgtaatgctgctacaggtcttttttgacacattagttttgaaaattgtttttgacagcaactcttttggacactaaggacctggaaggcagagaccttatcttgtctcatttatatcccccaaatctagtacatggcctgaaactgtgtttattaaatgaagaatgtgttggaaaattagattctggagaaaggcttgcttagaatattttaatcagaaatgaactttgtactttttcgcctatactcctacggagccacattttttctaattatataccaagagggataatggtacagtttgagtgtgagtgtttttattttcttttttatatattgataacaaactttttttataatgggcatatttggggtagaatattttctttttaatatattgataaactttttttataatgggcacatttgggatagaatatacttctatcccaaatgaacatgaaacaagcaaaacatttcttcaataactgaccaaagatgatagggattccacttcaccttagaatatgaatagctaaatagtgtgacttaattgtgtcatatattatgaataacagagttcatgagaaaatgagctatattttcatatatttgacggagcagaatatggcagtgaaagagcaaaatctctttcatctggatattcatcatcccaaaccaaatcttcattaaacttgggtgctagagctactaggaaagctcttgggagtcttctttgagactttgcggtgtggcttctgatgaactgttaatttggagacttgcataaatgtaaataaagtggcattaggacagtcctcaaaagccaaaagatggaagagtgcaaccaaacctggctcatttgcaattgcagtgatgccttgtggaaataaaattaatatctggggtacagtggctttaaagcaagatcctagatcactctaaatagctgtgaatcaggaaaaaaaaaaagtttccggttgctggatattctagatcttcatttctagattccaattatttaagagaccacagagcctttgtcaccaggacagagtcatttgctctgataaaggggaacaagatcttacaaagaacattgttgatgtgaacaactagtttactgaagacaagtccttcaacacaaaaagaaacaagaaaaagagaagggacaagcaaattgttatcgttcagtcactccttttcaatccacttgttactatcctgatccaggttctcattatttctcacctggctaattggaatagcttcttaagtatatcctctaccacttagttcatgcctctccaatctgttaccacctctggagttgtcctgctaaaacacatgtgtaactagattactaacctatttcaggaccttccacagctcttcattacccaaaagtaaaactcaaggtttatttggccatctacaccactactccccgtaactttttatcctcattcctatcattacctccatgatctctgaacttcagcccatcagatgacctcactctaacacctccttcttttatatgttatttcttcataaacttggcaaaactctacgcaatcataaaggcccagtaaacatgatacctttaaaaaaaagatttttccaagaggtgcctctacttcattatatccttcaggccaattcatgactatatttccttttcttatacccagtagttcttacttagaatagaaccccaggaggaagatatgactccagccacactgttctgaattccatcctttttataaggatgaaatccagaacagaaaaattctgtggcagaatttttcttctgactgaaactgcaaggagattcaagcactaaaaaagatcattccatattcccaatcagtataatgacaacgatagttaatcccagtgtcaaggaaattttcttctcatttccatcttgaagctaaatcgttattctacttttcagataaaagcatattatatctaaagggctcgggttatgggattcctcaaagaagcagtcaatagcttgtaatccttgagcagctcttttcttgttcccatgagccccacaggctgaccccctctattttaagcccctcaaggaatctggattcccacatacccacttacaggtaaaatttttaaaaagaaaatgcatatgcattgtattttcccatttaagatattaacaaatagtcatatggccaatctgactatctttactaatgactgtatgcaatggctgaaacaatcctctcggtacacaagattttgtgatatttgaatacatactatactcacaccacaacatctatatccttaaatcactataccaatgcacaaacagtttacatatcaattcatgattatgtgttcacatctttctgtctagtaactgctggggttacaagagtgaaaaaaaaagcacaaccttttccacaaggaacttgtagatgagcccaacaagtgcaattaccagatagtgtgatgagggctttgataagcatgaaccagggatctaataacagagtaatgcagtagaatatcaaaaaagtattctaaattaaataatctacaacagaattgttcatctttaatttagtaaaaataggtttatgacactcatgctctatggccctgtaaatgtagcatcatttcacaccacatatgccccctactacagttacagttactcagatactacatggctcagcacgcttgttgaggatatcagaaatgataagatggtactttcattattttctattattcttttattctggcttttaaatgatcaatgtttaaaaggatatattttccattttttttaataaggtcacaatactctttctgtaaccggaccccagtccagctgctctccacttgaaagccaaacagagagccgagggtagatgggaaaagcaggtttaatatgagagccagcaaactgagaagatggcaaactagcattctaaagtaccattttacatttttaaattcaccatgagattttaaaaatgaaacataggatgggagacatgcaggaattctgcagggtgcagggtttgtgtgtcttgttctcgaggctgtattgggtaattgcgcctctgggggtctggaagttgttatcttgacttcggcctggtggtggtggacaaattgttcacaagtccccctaagcttgatgatgcctcaatggggactgcgtggtttgtttctaggtttgactctgggatttcttaagcaagagaataattagacaagcatgcattactggcaaggagtgtccagaggggaagaaatgaagggatgagaggggagggaagggaaggaagaaaaagaaagtgggtgaggtccccagttacatttctactttaatcttgatatttatgcctaccaaatgcaattgggagaaacagagcattattggaaataaatcacttttctatctctccacaggagggtagtatttcaaaaggcaacatacattttgggttggaggaaggggcgggtggagagtgaatgattccattggctgccacactgaggctcctggctttctatggaactcaaagtgggtggcagcaagcactcttctagcccagagaagtctgttccaggacgggctctttcaggagcagctaaagtcaggggccatgtccaccatgtgatagaaagacaagatggtcctgaaattctccgtgtccattctttggattcagttggcatgtgagttgaaaaggttcccaattaaattaacagaaaatccctgatggcaagttgttttatggcaaagtatgaaaggaggaattataaaagaaggaagaaagggggaaagcaagggagggaggagaaaggagtaaggagggaggaaaaatcatttcaggttgggaaacaatccctaattcccttccctggttccttctgctctgtttctaaacaggggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagcctggtgatacaggcctctacctctgtgcaggagcacagtgctcttgaggcacctgctgcctgcacccaaaccctgctgccagccccagtcacgaggctgccacatgcctccagctccgcctcgcacagcttatggcatgaatagagagaacaacctcagcccctcatggaaccatttctgctgcctttccagaaaacattttccacacacactggaggacaagacccctctgctataacacaaatatctggaaatgcagcctgctattaggatcattaacgatatgggcctgcaactccccggggtaggcagtagcaaagagagtcgatatagagggacaaatggaagctatcagacagactgtttctgagtgttccacccctgtgtagaaacaaagcagaaggcaccagggaagggagctagggattctttcccaacctgaaatgagtttttctccctccttccacctttctcaccccctcattctctctttcttccttctttcattaattcttcctttcatagttggcatcagggattttccatctctttaggattttctgttaatttaaatgggaacgccttcagctctcatgctaattgaatccaaaggatcaacatggagaatttcagaatacttcatggttcagattggtcattccgttttccagaagaccacacccaggaatgttcagtacaatggggcagaaatggatggtttcccagctttcttgtagtactccagagatgatgaagctgctatctttccagactcttacactgcagtaaaatgcagaagtattgtaaaaattagaagaaagttactacctttttggaagaaagataccgatagtacacctcagtagcatccaactgtggtttcaaagcaacatcctagttggtggttctgaaagtgaccaaacattaactacaatggcctgtatgttcataggactggcttggggaagagtctttgaatggcaaatgtcaataacttcaagttttcaagcctgaagaagaaagaagttggcagtttcctccacatagcaagccctccactggcccattttcatacttgaagcagttgtatttgttctgtaaggcaagatgataagcaaaatgcacatgagtttctgagttttgaaatcaaaataacttaaattaaaatctcgtttttgcaattttctagctctgtgtccctgggcaattatttatcctcacctacatttccttataaattaatgttagtaagaacacctatcttgctgagttgctatgaattaaatgagataaaatacataaaattgtctcaagttccaggcataacatgtatactcaacaaatgtccttaaaataatattgttatttatggccatatgtaaatgtcacccctactgtggaattttcactgactacttaagggggaatgagttattctctgcctaatactctgagtcctcaccagaggagtcaggaaggcagacactgcaagctgccaacctaatcacaattcttttctgcctccttattaacaatgccctcaattttgatttgggcaacaatatgtccagctttaaaaaagctcaacactacattttaccctctcttgcagcaagagattgccatatacatatagaacagttctgaccagtgagataggaccagaagttggatagggccttcccataatgtttttttctctcctgatacaagtacacatctctctatccctccttttctctttttaaaacatggaagagataactttaccgtaaaggaaaacacataactaatcccctttccttatcccatgcctggtagtcttttagatgccaagtcaaatccagcccccagatttaattttgcatgaaaatttttaataaaccattatttggttgagttttctgttgctgcagctaaacatagttctaactatagtaagattgacataaaatggctttatgatttcttgtttccatgtgtaaaggcaggaaaagatatataaacaaattactttgtttatacaaacatggggactccatttatgttgatcatatctgtttcataaagtattaatattcctatatttttttataaaggaaaaaaacttcacctttcatttagagaggactcgttattaaatttccatagcaatttcttatactcatggaagattatggaatccagatttcatcctaaagtcttttaaccacagacaatttccatgcaaataataactatagtcttacatttgtcttaactttatattccaaaggttatttttcttattttcttaaccttactctacccagtaatccattttaaaagcctcctctaaaaactttatcacattaaactccttcattctgaaaattttaaaggcaaatacaaataaaaataagaaaacaattttaattatctctgatgcaaaaagagaaagacactctcccctccctttcgttagagcacctactttagaaaacttgtaattgtgagttttctatccctttgaaatgtaggtaaatctttttaaaagctaaataaatcccttgccagttttacaatccaggactgtctttctcaagaacctgagagcatttttttcaaaatgtaatcacgaagggaggtagtgccctaatctagttttagtggagaataggtgcctaacttcagctggtactttgctcccagttgcaaaccaacctcctgtcgtaaagatatgagaaatgtttcctttgcatgaaggcaattacgaaacaggtggctacctcaattaccaggtaaattgaggatgaactatgtttgaaaaatgatgctgtcaagtcctctttcttgcggactagttattgtttatcttgagaaactgtaaacaatcagttgcatctgctcggctatataaaaggataagatttctttatttccttgtaatatctttagtggattgcctgtgagatgcatcacattctggtttaatgcttattcaataaaactgttttttttttttttttttttgagacagagtctcactctgtcacccagactggaatgcagtggcataatcagggctcattacaacctgtgcctcccaggctcaagcaatcctcctgtttcagcttcccaagtagctgggaccacaggtgcatgccatcatgctcagctaatttttttgtatttttatatagatggggcttcaccatgttgcccaggctggtctctaactcctgagctcaacctatctgtctgccttggccccccaaagtcctgggattacagacgtgagccactacacctggccaaaactgttttctttctcttctacctttgtgggaaggtgttatgggttgataggagattctgttttacttcctcaacaaaatggcccagggtctttccctaatcactgggcttacatgtctcttcctgaaaagcaccatgacactatgaaaagagcaagggtttctaaaggctctgtcccttattggctgtgtaaatttgggaatattatattaacttcatgagcatcaatttcctgataagtactgcaggaagtaagaataaatacttaatttacagtattattgtgaagattagcaatgttttggtaactgcctagcataatggacttacaaattaaaaaattgaaagtgggaaccacggcttccacaaggtacactcaaaacctcatttgtgtcctgatatatgttttgagccaggaatatgtgtaagagttaaagaaagaggaaagaaacacaaaacacagcttggcagttaaagacaggtttactttagataaaacctgagaggggcttctggctgatttatttatttatttatttatttattttatttttatttttattttttggtcaggagcactttctcttgcagactaagagtatatattggttttagggtgagggggtttatcacaatcttggaatgtttatgtgtggaggagaagtttatggcggggtttggaatctctctgggaggaggggaggttatcttgaggctgatgtctttttggcaggagggggattatcttggggctggcaccttcccagtcagagcagggttatctcagagctagcatgcctctggttggggaggagtttggaatgtttctggttggagatgttatttgtggtttatggtcatgctgaccatagccattaggctgatggcctttggacttaggaagtttttgattaaggtgaatgttaaaatgagggcttgtccaagacagcgatgctcctgctttgtcaatatggaaaggacacagtccctgcttccaaggaactcactctcatggtgatagacagtcatagacttgctcccatagccatcattctccaggggctataagttgaagaatcctctgacctacaacctccattcagagcagtaatttctgagagaaattgcacactctccacactcctgaatcactgtatgccttcctaaaaacacactgctgatgtttaagaccagactcaggcaccacccctgggtggggcatctgcattgctgcagaggaagtggtgttagctctagggggtactctaacctgagaaaagtctccttaggctgtcaggaggattgatggatgaatggagaataaaaatctctgaaacaggaagaaggctaataatttaggctgagggtgggggatcagtagcaaaagagtatatggaccataaaattcttaataacatacataatcctgctttcttatcaccaattctcctttatctccaagagccaagatgaagcttaagatttaaagaagacaatttgtttaacatttatttatagttcatgaattaatattttttagtatcaggggccaatatgagactagatctgtttgtccagaaattatttctaatctctgatcactgttcttatctaaaccatgcctatggacatagagggtagaaggatgattaccataaactgggaagggtagtgggaggctggggaacaggtgggactgtttaacaggtacaaaaaataggacgaataagacctactatttgatagcacaacagggtgactatagtcaataataatcgtacattttaaaataaagaatataagtggattgtttgtaactcaaaggataaatgcttgaggggatgaacaccccattctccatatgtgcttatttcacatagctttcctgtaacaaaacatctcatgtactccataaatatatgcacatacttaagtactcacaaaaattaaaaattgaagaaactcaaagccaagaaaaatttttaaaaagaagcaaattgagaaaatgtaaggtgtagctgggaagaaaaggatagagaaaggttaagaagaaaattatggaggactgtctgaattgaaaagcattgtctctgtgagtttgtcaacagcaacattactagcattttgggcagggtaattcttttgggggaaggggcttttctgggcactgtagggtgtttaacagcatccctcatctctgcctactagatgccagtaagattctcacctgtggcaaacacaaatgtctccagacactgtcaaatgtccctggaggcaaatagcccctggttgaaaaccaatggtctatatgtctacatattgaatgttgaattgatagagcaggaaaaacttttagaaggtatatatatgtgtatatatatatttagtatatatatgtatatatatttattatatatgtatatatttattatatatgtgtatatatatttattatatatgtgtatatatatttattatatatgtgtatatatatttttattacttatatattcatatacacaaaatgaggatgttaacatttttctactattataacacatttttattcctatggtggtcatacgtcctaagttgctattatttcatttggctttaataaattaaataagataatttcaatgtaaaaacgggaattgtaatatatatatataaacatatgtattttatatataaatatatataactttttatacaattcattcacaatgcaaaaaatttttcagtctgatcacgttccagatttcaccttggtcaatatcttttatctctgactcctcaaagacatatagactgtttctctattctttctctaagctactgtgttcctgttcttccccaaaatgattcttaaaccctaaaaagatgacccctccattaccccccacccacacacatacacacacaaggactcacgcatacgcaccacagtgtgcagaaggtgaactaaaccacaggtaggtggagttttccactaggaagctgaggggcaactcccgggagctgctgccgctgaatctgtctcatgaaatttctcagccatgggaacaaaattagttccaaattcaagatatgatacttaccaatatttaaagagaatagatatcaaggtgtgcccctgtagcaaaaaaagtaaagaatcatgaaggcattaataggaatcttgctgggcttcctgtggatacagatttgctgtgagttaaggacagcccagaggaaacctggaggagtatcacaactgaatttggaaaggagcaatggaggaacgggagagatggagaaagagaaagaacgcaactctcaattaagctgtgtcctctatcataaggaagaaaactacagagaaattttctacacttggaaacagctacagtgattttgtgatgactctcatctgcatctacttttctctttctgaacgggggtaaaagcgcaaatgaaagtggagcagagtcctcaggtcctgatcctccaagagggaagaaattcattcctggtgtgcagttgttctatttacatgatccgtgtgcagtggtttcatcaaaagcctggaggacccctcatgtccttatttaacattaattcaggaatacagcaaaaaagaagactaaaatccgcagtcaaagctgaggaactttatggccacctatacatcagattcccagcctgaggactcagctatttacttctgtgctgtggggacactgtgctcttcagacacctgcagcctatacatgaaaccatagctgaaggcctaacccatccccgagagtggcagtaggtcccgatgtgattagcattgcattcccactgcctacatctccttgcatgtcctgattcatgtggaaagtatttctaaatgagttgtaacttgacactatggtgcaggtgcataaatggttcccctgcagatatctgtgggaatggtattactaggcaaaatctattgattgatcaactctttcatatattatcatatctctctggataagaatgagcagagtcctcaatcctccatatccaagagcaagaaagcaccagtctcacctgtacttccttttccacatcttttttatggcttactttagtacagacagaatcctaggaaaatttccatgatattttttctaacagacttaagtgaagatgaaaaggaagagggaaaatagatggcctctactaccatgaaggatggtcagagctttctgcatacttgaccagagactcagccacttacctctatgctgtggagacacagtgcttcccaggcacctgaagcctgaaatcagacaagtacctgcaattctaagactcaacaataagttagagatgtccatgtgttttgctgtaacatggttttgagaagcatacacttgataaatcaaagtgatttcatttccaaaaaagattctgatgaatacttactctagtaactatctctgtgctaaacagaacaattcctaacatcctaatccctaaatcagggaatcaatgagtcagaaattctagataaaggatccctcaaactcaatgataaggctttctgtcaaaaagggtatttgcaccccgaatgctacttattcttatcttacattatctatgtataaaggaaaatcttgagaaagtcaaaccaaaatgtgtcaaaaaagacatgctaagctctctaatccttcattatttttttttccaacttcttttttttttttgaatcggagtttcactcttgtcacccaggctggagtgcaatggctcaatctcggctcaccacaacctccacctcccaggttcaagcgattgtcctgcctcagtctcccgagtagctgagattacaggtatgcgccatcatgcccagctaatttcttgtatttttagtagagacagggtttctccatgttggtcaggcttgtctcgaactcccaacctcaggtgatctgcccacctcggcctcccaaagtgctggcattacaggcgtgagccaccacacccggtctccaacttcttaaagtatttttaattgttcattttgctcatattcaatagtatctatatcattttcctctttgttatgttttgtgaaggttattagaaaaaagcttatttccagtcatgagtatgctatgtcatcttcagcaagtgagtcattttatttgtccctcatctcagaatcctcatttataatgtgaagatgatatttcccacccaccactactcacaagtttgatacattaattattcaacaaataattatcaaatacctattaggttctgtagggaactttgaataaataaagagttctttccttgttgaatatatttctagtggggaacacatttttattatcagttcctataaaatagagaaggacttaactgggacagtaaagggtattataaaaacaaacagatgtctgttaaaggaagctttctggagtatgtggtgcctcagttcaaaatctggcaatttaataggagttaatcagactgaagaacaaaagcaagtgggggaaggttctccaatttgaggaacagcatacatatataggcaggaagcaaggcagattatagcaattttaagacataatgtataatttgcaagttattaaataatgtgcataagtaactcttattttatgggagactaaataagaaccttgaaatgaatcgtctgtaaatcataatatggtaaggtgaaggatatggggaacaaaattactaagcatagctacatcctaacagagcagataaggataactgcactaagaacaaataaaaataatcatgcaactgattgatgataagaaaatgttagttcttcagagaccctaatcccttttaagtgtggaaagtatttctaaataagttgtataagatatgataaatatgatacataaatgtgatccattttgactattaaataaagctgaaatttccaatttgataaaagtctccactgattcaaggtactcagcaaactctaaacagggtaaatgtaaagcacatgcacacacacacacataaacacacacagaacaagagaaatgcatacttctacacatcagagtaaaactgctgaaaatcaaggaaaaagagaaaaatccttaaaatcagctttgcttttgtttttcaaagggtcaatttcatttccctcaagtttttctgaaatcatggatgagtgagtctagcaaatgcccagccctcttcaggagccgggaaacatatgtggcccagttgcaaatttggggacagcttatggaggcctgaagatcactgcatttgatccacataggtagacacctgagcagctgggctggccaaaactaatttgacattatagtataggcaagagaatggcatggactcctcattccagtcaaccaaaagcaaagaagaggtgttattctactggctgagatgattgatgctgcctttcatggagaaatggtttgctacaatacagtgggggtaaagaagagtatgtctgtggaaactcttaatcccaccatgaatgatgataaaatttaatggaaaactacagcaactcaatataggcaggactgctaagacatagatcttgaggttatcatcccaccagacaaagaaatatgattgctgagggcaaaaaacaataatgaatgatggcagaagaatgaaattgtgcatactagctacaacctcttgaccagtgacagaaacaagatctgaagtagttatgggtacatcttccttactttgatgtgtgtgtgtggggcggggagggttaacaacccattctttttatttcttttattcttctactgtctgcaatagtatgtgtttttatttgttagctttatggctcactataaaattcacaggttatcaaaggagaagtatgactcaactagaaaaagaataaacttcatttaaagatgtataaagtgacacaagggaccttgcattttcttttggggaaaaggttagcatccttacaattttatggaagaaattgcatcctattaggtagaataattattttactattgtcttatatggaaattaaataccatcaaatgaggtatgacctaacgcaaagtttataaggaggtacaaaatggtggtttgtactggattaagcagggaaccaagtttcccagagtttccttttttgtatagtagcaggataaaattggccaaagagtaatgtgtgtgagctatggaaggcaaaagtgaaacagtagccactgctctctgaagcagtcatttgtcatatctgacaaatagacacggatatgcccagcaggtgccagcgtgttctaactctgttccactccatgcctagcatgccttcctgctgaccagtcaccttcagatgcctggcgatagatgaatggagatggtaaccacacaaaggcaagagcttccttagacttctccttgaacttccccttcaaatcacacttcagcagctgcaaatgcttggtttctcagattaactggttagagtttccttctctggccctcccacagcccttagaccttcactttcctgtctcctttcacaatcacgtaaagccaaattcccataattaagcccctatcccatacaactcatggtgactttcctgcacttgacgataccctgattgatgcactagacaaatataaattagttcaatggaaagttgtccgtcttttaaaaatgtgtatccagatacctattgggagaaagaacaatcagaaatctagtcttaccagaaaaagagtagaccttaaaagaacacatgtagcaaggtgagttgcaagggaaagaagagagggaagaaagggatacagcctgtgggctcctgcatttccatgaaacactgggtgtaaagaatcaaatttactgaacttaaagtataataataaaaaaaaatctatctatatatatatacaaagaatcagatttatcactatgtgaagatgtaggaattatttttaattaaaaaattctcatcaggaagaaattacttataactttatgaataatttaacatatatcaatctaattctgtgttgttaaagtaaagatatcaaaggaatagctctactcccatgtttcagaaattcctggtagtataactgagtagtctttattagggaagacagacttctctaaacatatctggtgactcagtttggtgtatgcaaatatgaatatggatatgctatgacaagtgtccccaccccctcccccaactaatttcctgtgcagagacagctgtgtcacccatctccactgattctgcaagggacttgtcataaatactgaataaggccaaggttcaggctctttagagtggttacttccctaggaatagaagtgtcaacgtgacttttataacatgctttgagcacgttataaaatttgtaaattgataggctcatcttctgctctcccacaagctcaaaacactgtgaattttttacatctccagaatagaacctcttgctcttgtgtggcggagccatcatcagttcttttaatgttcaccactctcggtagataaaagttctatttcattctaattgttctatgatatgatttagaatcactttaatgacacagtcttcagtgtgagaacttctcttggttccagcatgcataccccaggaggagcagaatctcctcaggtctaggggacctagtgggctgtaatactctctctttctctctctttctctctctctcactctctctctctctctctctctctcacacacacacacacacacacacaagcaacaaggtgaattcaccacaaatataaaattgtgagccaccaataacccacaatcagcctcaaagcttgctgaaaaatctcgcactaacacccctcccaaataaaacagttttctgtagcaaggcatagagtcactcatatccaatgattcaacatggggcttgtgatgcatctgtgcattgtgtattttgtacttttgttgtctaaatggtgagtctgtgtgcatgtgtatgagagcacgagcgagagagagactattacagaccactaggccccatggacttgcaaaatcagccttcttatacatgattcatgcatggatcctcatgttttgcgtgtgaccacccttcctaacatcaagtcataaatttcctacagacagatactgaaattcaactataatgaacggagttcatttgctgagcactcttggctataatttgtctgtgtacttttaaaattgcagatacctttgtccggaatgcccttttcctacaaagccaacttgttaatcttcctttatctcttaaggccccagctgaagggctctacctttgtagggtcttccctgactccacactgctaacctcctcagcagaactaatggatcaccgttatgctttcctcataaaaacactcatgtctcgtgctatgttgtaagtatatagttacacatttttctttctcttcaaattaccaggtatttatgaatgaagattgtcccataaccatatttgagactctaagccaggcacattgctaaatattgcataaaaactaaattaatattgattgatatataaatacacaaatcaatgaaaatttcttcactagaaagtctgaattatataggtttaaagtatataatatgcaacacagacaatttatcagtttctcctgaatcaattatttttaatagactatatatatacatacatatgtatatatatactatatgtgtatagtacatatatacatatgtatatatatactatatgtatatactatatattatatatgctatatgtatatactatatatattatatatactatatgtatatactatatatattatatatatactatatgtatatactatatatattatatatatactatatgtatatactatatatattatatatatatatactatatgtatatatattacatagacatatatattttttttgagatggagttttgctcttgttgcccaggctggagtccaatggcgtgatctcggcttactgcaacctccatctcctgggttcaagcgattctcctgcctcagcttcccaagcagctgggattacaggcaggtgccatcacgcccggctaatttcatatttttagtagagacagcgtttcgccacgttggccaggctggtctcaaactcctgacctcaggtgatccagccgccttggcctcccaaactgctgggattacaggtgtgagccatgatgcccagccagacttaatgtattaatggacttaaaacacttttaatagaggcattttaacttttctgagtatttgtttcattattcttcaagtgaaaattcaaaatgtttattaccataataaaatatgcatcaaatattattttattatgtgttatcagtccttgctaaaaataatttcaaaaaacattttggaatttaatctcagctgaaatcactagttgccctactaattcagcattaaaagtacaattgattcttcttccttcctccatcatagtaaaccatggggaaatacattacctgtggaccaagagtgaagataagcagctatgttgcctttttggcatcttctggtaaatttcatgaatatattgtctatagactttacaggattatgtcaccgtttttctcttttgaaaatacagaacacactaaatgatctcattcaagttccaatagagataatttcagttcagaaggtgatctaatacagaagataaattttgttgtgctgatttgtgtttttgagagaggtacccagaatttaaatttaatttaattatgttgtgctatttatcatatagaaaatatgggcatatttgaagaccatattagaattcaattgcactaaagagtaagctacgaaacttctttgtgttctaaattcatatcattgtattaaataaaacatcatacccatatgcgtccccaataagtatcaatccttattaatgtttttaaacaagatgtctgccttagtatgccagttgacaaggtgtcagtcatttgaccttatgtaattctctaattttcagctatcattttctactattgctgtgtgtgtgtgtgttctctaaaaacttttccttctctttcaatctcttgttttttaactttttatggagaaggcattataaaatcatctttaggaaatacagaaacacatttacagaaactttctacatttgaactaaagggggcagtgcttcctttcataaagataaataagcttagagctccacacaggttgttcatatgtaaaatgaagggtctgtggaaggacatgaataaagcacaggaggttgaagtcagatttgcagctttctaggcaggagacaagacaatctgcatcttcacaggagggatggccatgctcctgggggcatcagtgctgattctgtggcttcagccagactgtgagttgtgcatgggaggtttgaatatagtaagaaaagctacaaggaacactacaaggctgggagataattggagaagttttgttttgttttccggatcttgatggtttcctgtggggacattaaaaataaaactgaaaatctgttattctctttccaaacaggggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgtcttcttaaacaaaagtgccaagcacctctctctgcacattgtgccctcccagcctggagactctgcagtgtacttctgtgcagcaagcgcacagtgctctccaggcacctgcagcccgtactcaaacctgctttggggactcagactgggagacacatagactcgcttccatttacacatgccaatatgagagattatgctttgaagtaggtgaggcaagttgagcctaaagaaagactgatacatgacaaaaccttacaaataagttaagaaagttccctgagttttagagtgtttaagagtctaaccactctccttttctactttcagaaagaggttgctgatttagctaaagcataaatctctagtgatgctttgtttctgctagcttctggaatgcgggtgccctgtctcccttgtatactagggggcaaggatgtgtgtttggaatgggaaaaccaaggtcctactgcaggttcttccagtgatgaacatttcctgagatgtcttttcttttagtttttctcagtgtacaggcatttctgagcaaagaattgcatgtgtgaatactaacttatgtatatctgcatatctataaatatttctatatgtagcataaccatctgtatctatattaagttaaacattcgttcttagcaatgtctccaatgctaaatcattaccacgtggatcacactagcctcctccccttacttatccataaattcccactacaggggtgcacagcctggctctcactgttaacaaaaagttattcagtaatacttgttaaaacacggtgaggcagaatttatttaggaccatcatgataggtacagagaccactgcaacaggattttgcagtgagggagaagaattggattcaactccgaatacagcatagacaagtggagatttctagccaaggggcagattaggggtcagtggataggaaattactaagaggaaacattagaaccaagggatagtctggctagaccagccaaacaggatccttgcagaagacaggtcagggtgatcagacatcaatcccctgggggatgatagaggatgaggagcccagttggatatggagtgtaatcagatatcaagcggaggatgacgagggcagcaggggagggtgtggttcttgctaaactgacttagaaggattcttgttaaaactacattttacaagaaaatgtacagatgagcttaggagaaacttcaaaagcctgactaaagtttggtcaagcaaagaatttttgtcattaccacccactattcatttacatcatagtccaattccattaaacatgtatagtggtatcagaattgttacttgtagctccatgagaaagaattttatcacttagagcacactgttgtgtaatggtaataatgtctagattatgttgaacttctattattccacctgttttgcatgtattacattaattcttctaataattatttaagacaactattagaataatccatattttagtagagaaaacaggctgtgggagttcagggatttgttcagtatcactaactttgtgagaaaagagagttcatggtcactcatgccccaaaccaccaagtatgggcccttcctacagaagctattaacaagtcatgcttttgaacagctagcaatctttaaaattcttatcatacatgtcttcatcattgacctatagaagagtgagattatcactcatagagaattaaaagctgaaattatggttttatatgtatattgtatttgtagataaatgattagagcttgttcctcacaggctgattttctgaagctgaagatctttacagagagaagatacagaaattcaggatacttcccaagaagcatgcggaagcctctgtaaatcccattacttatggcataatctgaacagtgacttcaggaacagtgatttcaggaatgctgaagacatttttgatcagaataggggtgatatataggttggcttagctttgttcatctagggatccttgtggggttggtttaactataaggtaaaatctgtaggttgatcaattctctcatatttaattctatattcctgaacatggatgtaaagctaactcagtgtgaattagatttattatccctccatatccaggagcaccaatatcacatgcagtattttttctgttctttttatggcttacattggtataggcaggaaaaattccaagatccttttcgtaatgcacgtaaatgagaatgaaaagcaggaaggaatattaagcatcactcttcatacttagggtattccatgcacatctcgggctcctactctagagcctcagctactctgagcggagagtctgctgtgcatactctttgctcacaggcatccagagcctgttcccaaattcaaagctgtagccacagatcccagcaaaagggcagacacgcgagagttgttgctgtcttctagcagggtgtagagaaatgtagctatgatgaatcatttcatttcagtttcaaaaaatatggaaattcagctgaataatcagtccagttactatatatccctgctcttaacaaaactatttcaaataccttaagacaataaatcagcttttcttcttttcagatatatttaacatgatttataaattactgaaacccattataaagttctgttacaatggacatttttcactctaactgctgttacatttaccccatttcatgtcttgcataatggggagggaatatattaatgctgtctttatccttctaaagcaacgtagaatcataccagaaaaaggaatactacatccaatctcatccctgtctttttgttcaagctcttcagactgcttcaactttcacatttcattcattcccacagttatctatttacgttcttttcttatctaatatatttgggaaacagcattgggaaaacatactttctagcattgttctagccataagtgtgttgtatcttcttgagcaagtgaatcaacttcttaacattgtatatcaggaccttcatctgtaatgcaagggcaatgatttccagctaacatcggtctcaagttttattcattttatcaattagcaattgttaactggttgcctgctgagttccgcataaatgttacatgctgggaaaaaaagagctatggaaaaatacatatcttctttgactaaattgtagtctagttagttatgtaggcagctaatcagacagagtaaagtgaaatgaggccaaccttgggaaagcaaacggaggtatgaaggcatatggaaagtcccacccccatcttagccttagaggtgagtcaggggcagcctgtagtatgtcttgcctatgctgagacctaaagatttagtaggagtcaatcaagttgaaagacagagaaggtagtaaaagtgatcttaaagatagaaacagcatgtacaaggtgacacagaacacaatgaacctgaggactaaaagccagaattatgctataattaaaattatgtatgttataaaatgttcaaaccaccactgcaaagcagttgtaccttaattctcagttttataaatgagtaaccataatatttgtgaggttaccaaatatgttttctatttacttgagatttcacttaataaggttattcatttgatacctaatatgtgtcttagactcgaaaacaatagatgcaaatgagaagaataaggcattgtttctgccttcagggagcatgtaatattgcagagtgtattacaatatagtataataaaagctatcataggagaagcgtagaatataaccacctaacagtggcatttaatttggaaacttaaatgtaagggaaagctgcctacgggaagtagtatctaggttaagatctgtaaaacagttagccaaaaatggagtcagagacagggtattacagaaaaagataaatagaatgtacaaagacatgaagtcaatatttagtttaagagaatgacattaaactaattcaggatggccagagcatacaactcaaaatgtatgtcagtaaatataaaactaaagcaataagcagaaaccactttgtgaaaataattaaaagccattataagatgtttgtacattacattatcttgaagacaatgatgagcagtgaaagaaatctgcacaagtaaataatataatgaaatgtcactgtttgaaagattactatgagttcacatacttatatattatatccatgtgtgggcatgtatataaaatatatatatgtagtaaaatacatataatacattttcccttgatacttcttttttctcttaattctggagtaattctttctgtaacacagtatattgataggaccttcttatagcaagaaaaaaacctatcctgtatgaaaacttactcaagaaaagccaaaatccacagtttaatcaacattcctcagtctggccacaggggagagctgtttaaaaagtattctaggtagatgcatttagttctctgcagttaaactgttgtgatgtgtctctgattggttgcccccaaagttgcaatatcctggaagcaattgcaacaggcctcattctgagttcaaagcaactcctgttaaggaagcccattcagaagctgactggatattctggcaggccaaggatggagactctcctgaaagtgctttcaggcaccttgttgtggcagttgacctgtgagtacacgattcagtctgggagaggttgtgatatgacagcatcttaatgacaatagctttctgtcttgggaagggcccttttaagaaccagacctaagaagtgaggaaaatgtaccgtaattatgtggtgatgcttaatgttttaaataaggaaggaagagagaaaatcacccttcccttcacgagattgagcatctcattcgattgtctttctgatcaggggtgagaagccaacaaccagtgcagagtcctcaagccgtgatcctccgagaaggggaagatgctgtcatcaactgcagttcctccaaggctttatattctgtacactggtacaggcagaagcatggtgaagcacccgtcttcctgatgatattactgaagggtggagaacagaagggtcatgaaaaaatatctgcttcatttaatgaaaaaaagcagcaaagctccctgtaccttacggcctcccagctcagttactcaggaacctacttctgcggcacagagacacagtgatacccaggcctccaagacctgtactcaaacctaaagctgagccgcagatgctcccctagcacagatgcccaccacaggagtatggggaacttaccagaaggttcatccatgataaaagagaaacctgaaggaaattcatttgcttcaacacataacacaaaaagcaagccatggccttaagaccatatctaatttggcattgttttcttgataattatttaattgctttgttggtattatatgatagataacttagattcagagaaaattacatagatttcagtttcaaaaactggagtgaattcctatttgactgaagctatacatataaactccttttggatctctgcattcctatctgaaagtgaaaagtaacctctctttcttctcctaggtacccacagcttgacaataggacagcaaaaaaaaaaaaaaaaaaaaattgtctggttctttcttggacgtgaggattgtacacggtaggtatttagattgttaatcttgttacctatctggaaaggtcactagcattattttttccaaggttttaaatatctgttttggggaaatggcatttagaagtacttcaattttatatttgccttgccttctcttctcattgaggtttattctgattgatttccagctttgcccaagggaccctgagttatcttaccagtttgcccaatggtcaagatccttcctcaattgttcctttcatatcaacccagcacaacactgcatgtaggaaacactcaacaagttttaattgagtcatatgttgataagaattgagaatggccaggtgtggtggctcacgtctataatcccagcactttggaaggctgaggcgggtggatcacttgaggccaggagttcaagaccagcttggccaacatggcgaaagcctaactctactaaaaatataaaaattagccaggtgtggtgacacacacctgtaatcccagctacttgagagattgaggcatgagactcacttgaacctgggtggtggagtttgcagtgagccgagatcacgccactgcactccagcctgggtgacagagtgagaccctgtcccaaaaaaaaaaaaaaaagaaaaaaagaaaaagaaaaagaaagaaaaaacaaacaaaataatcacacacagaattccttccacaagatcagtcttccacaaacattctacaacttgcttaaatctttagtcttgtcctatcagtctaccctagaacaaaaatttaatttttcaactttctatattcattgagttttatccatcattttttttactcagaaaactttaaaattaactttttaaaaacttaattttaaaaaattaatttaaaaagatctccatgctgggaaaaattactttctctttaacagaaaccagattcccatgccttcttagaagctttttatcaaaaacacaaaacaactttatacactttgcatatataactgtttctcttatagctagtagtttgttgttttgttttgtcttgttttgtttttgagatggagtttcgttcttgtcgcccaggctggaatgcagtgatgcaatctcagctcactgcaacccccgcctcctgggttcaagcaattctcgtgcctcagcctcccaagcagctgggattacaggcacacactaccaaacttggctaattttttgtatttttagtagagatggggtttcaccatgttggccaggctggtcttgaactcctgacctaaggtgatccggccgcctcagcctcccaaagtaatgggattacaggtgtgagccactgtgcccggccatagctagtataattatatacataaactgtaatgttacttcttagtaactcttattcttagtgaaaaactgaggaagtaagtaattctaattaagcaccagatacagagtccaagacaaaggacaatccctggagctaggcttcacaatctcctaaaggcccaaatccaaaaacatagtttatagacaagttaagtgtcaaaaattgtcataaaaacacattttatgatcttaaaacatctagcagagataatatctgaacaataggccaatagacagacaaagtgtctaaattaaatttggaagaggtttctattttattttatttcaccaataatttttaaattgtctttatttgttaaagattactaaagtcacatgaacttaaaggtgtttgagttaaggtttctatttttctcataaaatatttaagtgtttactttttaagccaattaattagaactctttcacatattttggttgtgaaacatcacatacacataacacatataaatatatagacactagacacacagacacacagacagaagcagatcttgtagaactatatgattttttatttaccaaatttaagtagttgtttttattcacagtttcaattacctattttattgctctaggcaactgttaggcgaccctaaatttgcatttctgaagtgataactctcaggtgaaacaagataaaggatttgcatctcaaaatacagacagagacagggaatttaagctctttaaatttggttgtgttagaggaagattgaaaacatggatgccaagtaacacaaaattatataaatttatcacgggcttttataaggtgaccaatttcatttagataggtgcttttaatttagtctcttttttatctggaccattgaattcaaagcataactcacactaaatcttgggtcccccaaaagaggtaaacaccatggggattaggacacgccatgttttcactgtacatttcactgcaaatacatttcccctgaggctggtgggcaacccattgccaatcagcccactctgcgatcagcccattccttagccattatacacaccaaaggcaagcttttcacaataaaaagaaatttctagtaactccagaagcaaaaatttctggtagtgcaatgcaaaggagagaagagttttagatctgagaagacactgtccattttcaactcttgggattccctgaggaaaaaaatagcagtttctcccataaatgggtctgtggcacattttctgttttttcttaaggaatcccaggctgttagaattttttgttgttgttgtttgtttgtttgtttttgtcttcttatgtggtactgagggtggcaagaggaaggaaagggcgatagaaagagagagacagagggagtgcacattcctagcagcggtttaagaagaaattcagttgcctgagaaatgtttacagagagagagagaacagaggccttaaagcagtaagtaaatacatacatagcctaaatatcagttttaattaagtcaacttttgactatggagccctttaaataaatcctgtcaaatctcttattatcagattttagctgagacaaacagttgatatttctgacttttgaacttctttaccaaaagatatacccccaggtgccttaatcaaggttattatataaccgtgggtacacaagctgtctccaaagagttggcaagcattttttaacaagatccagaatcaccccaaagatcgctcagcgaaggaaagtttcattaccaataaatggggtataacccatatttctgtcaggccatgtgtttagagtcttaccttctcagctgaccatatgcacacaaaggccccaaagcctcatgtgcccccaacagatgaaaaaagacaggaaacaaaaagctatggaagtgggaaagatcaatcataaagatcaataataaattgatacccaacaaaaaagtcacacaaatattaaaccgagaggggctggatccctgaccagtaatcagactcaccctgtggatgtgaaagtgcagaattttaactattaggccacaggtggagtggcctttgtttttccttgaccagaaagcaaacccaagcctctgcaggaattttacctaccagaactggtttaggtcagatttttcactcttaatttagtcaagagaatttttaaggctggccatgacactattatatgtcctttttaaatgtgatctctttgttaatagtttagaataagagatccctaaaatctttaaattaattgcaccgaaagaaaggatgggaaaagggtctcgttgtgtaaatgaaacttctcaggtagtcaaattgttgacctttcttacccagccagggtttttagaagtgaaaattgactttctccagctgcagagtttcattcaacattagagggggccaggagttggtaaagtctaacagaaggtggaccaaaactgaaaagaaaaaccagaaaaagtgatcacagaattcacatataattgcgatctctcagcataagggtaagttatagccaactgacaataaaccttgcccttcagctaccaaatcccaatatgaaaccagctccttacctggagatggacccaagctgaagactgctgtctgccatcatggaagcagaaactaccagaaaaggagttttacagcagaataaacctcagatcccaattgaaaatttgggggagatcagggatctctggagggagaagttcccagaacttacatagcaaatcatccaatctgtaagagtaataaagagctccagccggtaccagggccccaataggagacctgctggaggccaagagccagactccactcagagtcccttcgtggtcaccaacatgtaaaccaaaaagtgactgaggcagatctctattgattagaggtttattttgccagtcgaggatatgcctgggaaatagaaacataagtcacagtaggatccttgacctgtgtttttccaaagagggttttggaaacttaactatttaaggtgtaagagcaagcaggagggaaaggggaaaaaaggagggacagtaggcaatgagacaagtggttacattcttataaggctttgattaacactcaatgaatccacattttgtgtgtgaaaaaaagagagtagaggaaaaaatcaattaagcattcatctcatcctcagtaaatctacattttacatacgatagagtaagcatgtgaaattagagttacctgtttgggaacagaaggaaggcagtgttttgtgtgactccgtttccaaccttaattttccccttggcataataactttgtggttttcagattttatttttctttccagattgagattcccatgaccccccatttgagttcaattaataattaatttgctagaacatctcatagaactcagagaaacacttacttacatttactagtttattataaaggcatacatatattacaaagcataaggatgaagagatgcaaagggcaaggtatgggggaaaggggtgcagagcgtcctcactgtcttggggcacaccgctctcaaggaacctccatgtgttcagctatctggaagctctctgaacctagtccttttaggtttttatggaagattcattaaacaggcataattgattaaatcattggccattggtagtcaaccttcagactctctccccttcccagatattggggatggagctgaaagtcccaactctctaatcatgcctttgtctctcccatcccccatcctgaagttacccaggggctgccagccatccgttcagtcaatcattaacaaagataagacatcgcttcagagtttctaagtattttaggagtcgtatgtcaggaaaaggggtcaaagattgaatatatacttcataatatcacaagtcataaaactgaatagtacttagcaaccaaaagaaataaagtactgattctttcaccaatatggataaattttaaagcattattctgaaagaaataagctagacacaaaagaatacctaccatataattgtatacatacgaaattttagaaaaaagcaaatctgatcgatggtgacaaaaatcagatcagtagtttccaggtattgggaatggaagaaggacattgacaacagtaagtcacataggaacttaaaaggtgataaaatattctatatgttgattaggatagtggttacacagatgtaaatgagggaagagagagaccctctcgtactgttttatattgttttatactcagtacctgttttaagaaaaaacaacaaggaagtaaaaccaaagacaggcagcctgacgccaggcccgaaaccaggtctgggcctgcctggcctaaacccagtagttaaaaatcaactcataacttagaaactgatgttattcatagattccagacattgtatagaagaacactgtgaaactccctgccctgttctgtttctctctgaccactggtgcatgcagcccctgtcacatacctcctgcttgctcaaatcaatcacaaccctttcatgtgaaatctttagtgttgtgagcccttaaaagggacagaaattgtgcacttggggagcttggattttaaggcagtagtgtgccgatgctcccagctgaataaagcccttccttctacaacttggtgtctgagaggttttgtctgtggctcatcctgctacatatacatttttcaaaaacagcttgactgttatgcttaaaatgtgatatattatttcatgtaatttatattcaataaaattaatctaaaaaagattaataaaaggatttagattctagatctcatgataatctgtaacacttcttttaactcaatagaagtaattcctctgttttaattttgggcaaaaaataaaagaaagagataagataacaagaagtaggaaaaggaaggtaacaagaggtagtatgcaggaattaaaattcattctcttaaattagaggacgattacatcccaggttcttcatttactgtatacgtgatcttgagcatgtgtctgagcctctgtctcctctctgtaataatttctcacaagattcaactgtctcacaaggggaggattaagtaataatatgtacataatgttcctagagcatgataaatgttcagtgaattttatctagtatttttattattaaccaaaggtggtcattttaagtgagcctaggttctctaaatcaaattatgggtggtaatcaacatggtatggcagctccagaatatttttttaatctgggcaacttgaggggctaggggtaaaagtagagaaaaaagataattgtattattatctcagaaactgtccagtagcctggaatcccaagtgctatagtttgaatgtttgtccccttcaaatctcatgttgaaatgtgatccccagtgtcagaattagggttgaatgggaggtgcttgggtcatggaggcagatccctctgaatagattaatgctctggagtggagagaatgaataagttctcactctgttagttcccaagagaactggttgttgaaaagagcctcgtatgtccccctctctattgcttcctctctcactttgtgatctctgcaaacaacagctcccctttgccttccaccatgagtggaaggagccggaggccctcaccagaagcagatgctggtgccattcttcttgtatactctacaaaatcatgagccaaataaatttattttctttataaattacccagtctcagtattcctttatagtaacataaaatggactacgatgatgggaaataatattttatcaatggaagtgatcttctattataactgagccaagagaaataaaattgaatagaatggaagttttcttttgtcttaacaaagttaccaaaatcacacattgggaggataagcagaagtctaagataatcagaaaacagagtagactgcaaaagaattgtttgaaatcatcaattaagatggaaaggaggcagggaaaacatcatagtttctagtatcaccctgaaattttgtgtgtaacaatatatgtatgtctatctacatccaaggatacaaaaccacatctgtattttaaagtaaaatatattttcttcactcaaaaaaatatataggtatctttttaatctcagtctaaatctgggaataaaattttgtggccccaaaatgtctggagaataactaagcaaactttgctagggaaagagctgtcttaaacacatctagtggctcaatttagtctgtgcaagtatgagcaggatatgatttaacaacttgtccctgcccctgccttccccactgtaccactttctttcctattctgagacagatgcattgctcacctccaataattctaggtggagctttatacaaaactgaataaagtaggtctcaggctctgagcaggcagttttttttcctagaaatagaggtgccaacatgactgttggcagcatattacgggcactcatggcctctgccttccttggtaaggacagtagctgataggctgaggacagtctaggactgggagaagacagtggggagggaagaggggatgaacaactggtcatatgtgacaaacactcaggtgtaataagaaggaagaggaaaggaaccagattctgactcctgcctttactgaagatttaacccctgccccaaaagttcttggaagctctcttacaggtcagctcaggggaccaatcttgttatttcttctcatttacgggatccagcatgtcacagagggtcattcaatcccaaccagcaatatctacgcaggagggtgagaccgtgaaactggactgtgcatacaaaactaatattgtatattacatattgtattggtacaaaaggtctcccaatgggaagattattttcctcatttatcagcaaacagatgcagaaaccaatgcgacacagggtcaatattctgtgagcttccagaaaacaactaaaactattcagcttatcatatcatcatcacagccagaagacctgcaacatatttctgttgtctcaaagagcccactgtgaagaacatgttagaagagccttacaaaaagatcggaactcaacctgaggcaattgcctattcccacattctcaggaaaaactcacaaaccttacccaggcatttgttagcagctggtggttagggtgcataagataagacccagaaaggaagtcattgagttcattccaggaagcacaccctcacaactgccttagaaaccacacaggaccacatgtaaaagccatactgctcggatgacatcacatctctatttcttcccatggagtatgccgtttaaaaaagcaacatgtgaaacatggaattttaaagcttaattgattgtacaggactttatatctgctcaaccaaatctcttgaggaaaatagtatggaagacactagggaaaaaaaacacgcatacaaaataaagatttttatggcaggatccctaaacactggccagagagatgcaatcttggtgagactatagactggagtacttttggaccatgtagaacagcagcctattctggaccagatgcatttttctatctccttggctacatttcactctaatcctgccaactccagcttggcttaccatgctttctgattctcatgttccttgcagctgggtctgctagttgggtcctccctgcagtcacatgcctatcacaagatttggttaaccacaacagagaaaggagatatgtggggagacactgctacagatgctaggatctgtagttaatcttgtagccacctaactaattcatggaaactccagaaatgagactgcagtttctaaatcccgtatttctttattcagtccccaaacccaattgtttcggtcaagcacataagactagtcttctgactctgatgagtcatttttcttccctacagattctcctaaaaatccctcctatgaatcctctgctaaggatgctaagtgaaccctatcacatgtggctgcaggcctgacacagtgcctaagccttaaccttcctcttctcttaattctgtgctctcagctaaggttttgacaacttgccaacaccaaaactggaatacacaaagtatctgccctttcttggttgttacctatttcagagcaaactggacattcctcctctaaaattttatctatctgaattcaaaataagattgccatacttggattcttactctcattggttcagtcaatcacttgttcattcaggaaatgaaaatatgtcctacgcaaagctcttcagttgcttctaattgtttcaagagaaatatccaagttctcttgtatggattaaaaattgtttctctccatattttttttattaagcccaaggtagataaaaatgtggagactgctctgtagatattcataatatccataatcgcatcttcaaaatctatgaagagcccagagaaaacccatccgaaccaaagtaaattgtaattatctaattcctcagccttgctatgtttcttgggatttctccttattgagtccaaatttactaccatgactcacaacctaactgaagccacagaataaataactcagacacttgccaattcttccatcaagcggcccaataaagactctagtctctgtgagacttttaacaattaaatataaaattctctcaacattttttgagaaaagaccttagtcttcttttaaaagaaaatggaagggaaaatggtgcagcagaagggaaaacaatgccctccttctcagactgaataggagagaggtatttcaattatgatctgtgatgtacagtgataatatgatttgcaatgcttcttatggttcagagagaatactgacaaaggtcttgcgtttctgataccaatatttcaattttagatgcaatggaagatggctagagttcccattcctgctagaaaagagtgttgcttctgcctcaataagtaaagctggataaatagaaaaattgtaactttgctttaacccatcagagacctgagattacagggcaaataagtaggctggactccaatgaggaaaacactcctccaagggagacaggcagcttatggactggcacaactgcagcagagcatagaaaaagaaatgttatctgccatacaagcaagaaaaagaaactgggtaaaagattgagtgagagctatcatcagaatatagaactgctgggagttgcagacatagaaggagtttatattcactggtagggccatttcacagatgttggaagaagtaattaggggcagggtgagacacagagagagccccagcaaaagtgtaggcttacaagacataattggcagtcactgcaggaaagcacaaatcccagcattcttgcctaaatcagcctcttgcaggaggaaaagctttaagctgttggggatggggctaaagacctgacagcgcattctgtcaccccctagagcacaggttaagatccacaacagcaaagaaaagagtcaagggaaaaaaatctctacctttgggtagagacaggaaaccattctgagctgaagaccctgtaacaataccattctaattttgctacctgtaagaaagaagcagaaaactctctcacatcacacccacagagaaacacggcagtgtttggctgccacagggaggaaaggtatgaatgctgagaaaaccctaaatccaagatccaagcacatggggccagtctaagattgaagctggaccaagacaacagagaagtccacctacccacacagtgagcctcgtaagcactaaataacaagcaacggcaaactattgctagaggagtgaggggtgaggaacagaaagagagatcctctttgtgctgaaggaattcagggacagctaaaagctgaggtagagtactctaaaaaatagagattcataaatcaatagtaattcaagaagccagcttttaagtggctcacaaagcagtaagatggttttaggaaaacttatgtatttaaggatagtattctagaccttctattttcagatccttctacttcctactttctattcctggagacaacatggttggataccactatcagagccatattaggctgactgaaccaccattgtgacttgcattatattatcttctctcaattctttatctccgtggagttttaccttaaaagatgttcattcatatacttttattcactaggtataactatgaggaagctgataaaaagggatgtttctcattagtcttttgtttatctaagatttgttgtaggttctgatacattagcagaataatataatcaatactttgatttgtttatcagatctatctaggttcatatgctacctctttgtgttcttgaacttcttcgagtctttgaggattaaatgaaagaattgatatcaaattaaaagcacagtggttggcatgtggtaggcaccaataagccactaataacagctcttgaaatacgtcatatcctttcattgctcctttacaacattgagtttataacagggaaaaaaaataaatattattgcacagactccaagagactatggactgggactcgagtgcataacattttttacttgcaatgtacattgctgaaatctagacaccccaaacttcctgcatctgcttaggcttttcaatcacggaagaccactgcactctggcaggaaaaatatccagatgcctaacttggaaaataaactaaattaggccatcttgggaaatggcatatagctctttggagggcaactttatatttaccctgtcttctgatatgttgaataaaagaagtttaaatgagacatctgctttagtatttggcatattgatataggtgagctcttacactatgaaagtatattggaaaggatatgacaaagaatatgctgctaaaatccctgaaactcgttaacacttaaaagtggttgatttcaataataaatttcaggcatctcaggaactgatttcctcaaaagtatgatttatagccatctgattgtgaaggcatgaacatcctcattctttgacattaaaggagaaacttggcaattagagggatatgcatgggcttgattctagtcagtaaatggttcaggcagagacaatgacattaatctggggctttttatattggaaaacacaagccaagaaagaaggtgcaaatatctttgccataataatgctggtgttatgatttcacaagaagtaggtgtgaatatgttttactaatgaaaaaaatgcattcattcctcagatagactacaatgattggactatcaaaggaaaattagctttttaaatactaagttgtgtgttttcatgtacacgtatacacaagtcctggctgtagctttactgatacagagaaaacaaactgaaattgaagcactgacaattttcacctaccctctacctttttcatggcagcagagctcaccgtgtcttgcaaagttgttaatagctcaagcaaacaaagaccccattgatatccaatatatgtgcaagatcccattgatatccaatatattaaaaagggactttgatctgagctttattatcctgtagaatggagtgctaatgtcttgaagtacaatggagctagtataccaaatatcatgagcttaagaaccaatagagagggaaaaaatgagacaaggaaacaaaaattttgatgtgtgatggattctattggtctatccattgaagccttgctatatcaagataccttttaaatttatactgttcagaacgcatattgaaactgtcagtaaaaaagatctctctactcttccaacagagtccattgtatatttggtacaaaaataaaacatctaaggttgtattccattcttttgaatggaagctcagattaaagtcccttttaatgtcttgcacatatattagatatcaatgggatctttctgccagccagcagataattccccaatgcagatgaaacctgttttaaatagtacttctacttcagaaactagttactaaaaatctctttgggaaaaagtcaggcacataattgtgatgtgtgatggatttccttgtctcccaattttttctctccttggttcttaaaccgatgacatttagtataccagctccatggtacttcaggaccatgtacatcaatcctctctacaggataataaagctcagattaaagtctttttaaatgtcttgcacatatatcagatatcagtgggatctttctgccagttagcagataattcctcaatgtggatgaaacctgttttaaatagcacttctacttgagcctgagaggcggaggttgcagtgagctgagatcacaccactacactccagtctgggtgacggagtgagactcagtctcaaaaaaataaaaaatatatagcactcctacttcagaaagtagttattaaaatctctttgggacaaaactaggcacactgctctgaatacttcatgaaataataatttttccaacgcctttctgagccaggtgttcctggtgttactagaatgttggtcagttctgcacaaatttacctaatttacatcctaagatgctctaccttttctttgcaatagccatcaattatgccccaattttttaaaataaatctattgataatatcatggaactggatgaggaattctaatattaagtctgcatgccaattcgtccaattactcagtagaggaaagccttccaattgaacttcattgtgtgcctgcttttgtgcttcttttatttaagcattttgaatatatgagactactttagcccttctattccattctcatttccttttcatccagttaaacttattgagagcctaaaatagaaaattcaacacaggcagtcctaaatttccaaaagaagatttgcaactaatggtagaacaaagaagcaacaaatttttttttggacagttttacattattgcctgggctggagtgcaatggcacaatcttggctcactgcaacctccacctcccgggttcaagcgattctcctgcctcagcctcccaagtagctgggattacaggcacccgccaccactcctggcttattttttgtattttttagcagagatggggtttcactatgttggccaggctggtctcaaactcctgaccttgtgatctgcccaccttggcctcccaaagtgctgggattacaggcgtgagccactgcgcgcagctggaagaaacaatctttataatgtttcttaggaacaccatctgggctgggcatggtggctcacctgtaatcccagccctttaggaggctgaggtgggtggatcacttgaggtcaggagttcgaaaccagcctggccaatatggcgaaaccccatctctactaaaaagaaaataaaaaaattagccaggtgcagtggtgcatgcctgtaatcccagctacttggcaggctgaggcaggagaatcgattgaacccgggaagtggaggttgcggtgagccaagatcatgctacttcactccatccaccctgggcaacagaccaaaactccattaaaaaaaaaacaaaacaaaacaccaccatctgtaagacatggttgaccagaaacagaataatgcaaggttggccaacatagccaaactcttctaagccatgagctctgcctctgtctcattgattggtgcctagctgctagagttcagtgataaaagtgaaatcaaaggctgtacattatttattttctttgactatgagtttatctttcctgccagatccaaaatgactaataaaatgagagatacagtcagtctagactcgaaccaggaagagtctctaaaatctaaatgagtaactctaatggtctctctgaagactctgcactgttgcttctttaaagataaacattaaaatagaaacccgcatctctaataaaatatttgtctttcccagactttcttgagagtgagtctggagtgaccattttgtggtaacagatcatcatttggggttattatttaagcaccagttccctcatatttgtgctgtcagtcacttcctcaaagcttcccattcagtatgttttaacttaagactcagaaggacacattgatgataagaagtttctcagtgggtctgaagcttagctccaacactgcttgtcttagaatagagactttatcttactaggacaccaaagaagactgttactacatggcatgaatatctgcttcttctttatttaaaaaaaaaaagtgcagaaggcatcaatggataacattctctatgttttcatttgagtctagtagttttctgttcttactttgtactgtcaggctttttttccccttatatctaccttaaaccctataaagaactactacagatcagaaactttaaatgcaagatctgtaacttaatcaccagaaatataaaccagaaatatgactttctactaatttcctacttgtgaagtaagatgttctaagggataggcagacatgccagctctccttctaaagacagaatgtgtgttatacacgtggccttggcaattagaggtctgtacacaggatggcagcacttcattttcacatgcagagaaatggaatgttcaactctgttgggcagagcatagcttgtctcctattggcttatagccaggttaagaaagagcaagaatacactgagaatagaatatgttctccttcccagatagtatagatcattgatgattctaatggcaagaagaatggaaaagtccctgggagctttattcaaattcagctgaagcgtaagtccagggcttctggaggggtccatcacaagtctggggaaggagggggattcattttagttctcccctggttttctgctgatactctgcaaagaaaacgtacattcggaaaatgacccagtaacccattttccttgtttcaacggtgatgagtggccaagaaaaggatgtgatacagagttattcaaatctaaatgtctaggagagagaaatggccgttattaatgacagttatacagatggagctttgaattatttctgttggtacaagaagaaaacggggaaggccctaatatcttaatggagattcattcaaatgtggatagaaaacaggacagaaggctcactgtactgttgaataaaaatgctaaacatgtctccctgcatattacagccacccaaccaggagactcattcctgtacttctgtgcagtgagaacacagaactcttcaggcacctgcaacctgtactcaaacctgcaactgggagtccagtcacattctttgtctttgaacgggttttgggttagaatggtttaccataatgtgcttgtttctaaattgaaatgaatgcagaaatctaataattgtgattacaaaatcattacgtttaaagtaactcaaaatgagctggtatactttgtactaactccaatgtattcgagaggagaagtagtgttgttttaaatagatatgtaaataataaagataacctcattggaatatctgaggttgtttcattgagatcctacacttccataataaaacaaggacacctaaaactcttctgggtggcaatctgctggccttcagaaaaaaaaagaagattcatttttgaaaaaattttaaaatttttaaatcatcatattttaaaatcatcacacactcattatttattataagtattttcattccaggtgtgtctgcatatgccctaattcatagcaacttaacatatcaagtatatttatcatataacatttatgtccattctcctctggacatccaccttcatagtacgggtattcagtcataaaagttacaattcaaatagccaccagaagaattcctgcaaagatttttgtcttgcaactgttctacattcagaaaatatttaccaactgcctactctgtgccagacattgttcttggtgttgaggattgagcaggatgaacagaaagacatgacaaaatttaattgtattctgcttctctcctccaatggatgtctgctcaccagaaattaactggggaaacattttgatgacagtgtatatccagggatcaatgacaccacctaggagttttaggattttgcccaaattcaccaattccttcatacctcataggtctgtatgtacagtagcaacagtgtgatctttctcttttttccaatgttccttcaagaaaggaagataatagttattttagtcaaactgttcaaaatagagaaaaaaacctaccaactccctcatgaggcaaaaaacataaacaaaatctgtagagttaagagtagtgaggctgggcactgtggctcatgcctttaatcctaccactttgggaggccgaggcgggtagatcacttgaggtcaggagttcgagaccaaacttcccaacatggtgcaaccccatctctactgaaaatataaaaattagctgggcgtagtggtgtggacctgtaatctcagctactcaggaggctgaggcaggagaatcgcttgactctggaaggcagaggttgcagtgagccgagatcctgcctctgcactccagactgggtgacagtgcaagattccatctcaaaaaaaaaaaagagaaagtatttttcatataaattattctcggatttttgaataagtaataagtatacatggtataaaataaaaattatacaaaaagatatatagtgaaaagtaacttttctctttacctctatccccactatccccaacagcctagtataaccactgttacactgaaattttctttgaacattatacatatatacatatatatgatgtgtatatatatatatgtatatataaaaatgatgtatgtatatatgcttgtgggtatatatataacatatatattaatgtagcataccatccacactgttctgttaccatgctttcttacttaaactatatcatgggaaaccatcattgtcagtacatgaagacagctaccttattatttttaatctaaattttcaaacacacacaaactaggaagaattgtataatgaactcctttgtatctttcattcagctttaacaaccatcaactggctatctccttctctttaaagtttcaaattttgccattgtgtgactataccacattttatttagtcaatctcttgttgatggacacagattgtgttcaaattattagttttgtttgtattgtagcatagtttagtaaggtacacagatctcaagagtacagttcaatgagttctgacaaatgtatatgccatacaaccatcactgaaactaaaatatagaacatttcccataatcctgaaaactctctcatgtttcccccccagacaacacttccactaaagtaagaattgttcttatttacataaaaccatagaatagttctgtttattctattttgataaattgagatataattcacatagcataaaatccatgcttttgaagtataccattcagttatttttaatatcatcacaaatctgtgcaaccatcacaactaattcctaaactttatcatcactcgccaaaaaaaaaaaaatcatacctattataagtcactctcatcccctcctcagaacatctgcccctaacaacgcctaaatctgctttctgtctctatggcctatcctagatatttcatacatatggaattgtacaatatgtgacctatcatgtcacgtattgtatgattcacatattcacatattttactggctttttcacttaccataataatttcaaggctgaacatttgtgaccaagtttttgtgtggacatacgtttttagtatttggggtattatgcataaaaatggaattgtgggtcatatggtaattttatgtttaactttctgaggaactgccaaactatttttcaatgtggcttcactactttacattactgtcagcagtaagggaggattccaatttttccacattctcatttgttattgtccgtctttttaattagacccatcttagtaggcataaagtagtatccctctgtggttttcacttgcaattccctaatgactaataaggctaagcctatcttcatgtgcttaatggccatttgtgtacctgctttagaaaatgtctgctcaagtatttgggctgtttttaattgggttgtcttcttattgttgagttgtaagaattctttatatgttctggatactagacttttatgagacatatgattggcaaatagatgctcccattctatagattatgtttttttttttgctttcttaatagtgttttttgaagcagaagtgttctaaattttaatgaagtctaatttatctattttttctttagttgctggtgctttatatgtcatatttttaaaaacattgcctaatccaaggtcacagatagttatatctatgttttctaagagtttcatagtttcagtttgtacattgaggttattgctccacttcaagttaatttttgaatatggtgagaagtagggatgaaagttcattcttttgcatgtgaataataagacatttggagtccccaaccaaaagaaagctgggtagctatactaatatcagataaaattgacattaaaccaggaattattactagagacacagagcaacacatcaaaatgattgagtacgatctacccagaacaaattctatttttatatatacctaatggcgtagcttcaaaatatatcaaacataaatcagtagagttcaccagtagaattaaattggtagaatttattgattaaaagatcaataaataattatacaaccatcatgtcaggcattaacacacatctctcagtagaaaagtattgaaattatgaccaacacaactaatatcctttacctcacatacatagattgaatactttacctcaaaagaacagattacacaaggaatatttagcaaaattgactatattctgaaacataaagtaagccttaatcaatttcaaagaacttaaatcattcagaatagtcatagtctctgaccatatggtattaagcaaaaattcaataacaaaatgattattaaactttattcctgtaccttgctagatataaggttaatttttcaaatgtattgccacagaaaacaccaagacaaaacagagatttggggtagggtagatttttcagtctctgaatagagcaatgtaacatactacttgcacactttatttcctgtttgggggcagaaacactgaacttctccagggactttgcactcaggcactcagagaagcattttgtttccaggcttgagtgaggaagcaaatttcaaccgtaagaagaaattctaccatgctctgccctggcctgctgtgggcattcgtggtcccctttggcttcagtacctatgggcggccccaaacatgggactgcagcttcctcgagagctgggctgcacaaattggaactggtggagtatcaagtaagaggtaagggaagtggggaaatgaaacactatttaattattttctttgtccttttgccataaattaatctagtcctcatgacccatctgagacatttaagggaaccaactctgttttctcctttttcccataggatccagcatggctcagaaagtaacccaagttcagaccacagtaactaggcagaaaggagtagctgtgaccttggactgcatgtttgaaaccagatagaattcgtacactttatactggtacaagcaacaagcaacctcccagtgaagagatggttttccttattcatcagggttattctaagtcaaatgcaaagcctgtgaactttgaaaaaaagaaaaagttcatcaacctcaccatcaattccttaaaactgactcagccaagtacttctgtgctctcaggaatcccacagaagtagaaatgacagtggaagataaacaaaaaccttagcactccataaaggaagccacctgctcaggagcttagggaaaatacatgaagcacagacaggaagaaggcacattagtggcacagttgagaccttataatgtaaacattcctctgtaaaaaaaaagtttccttattgagtttatatataaagcagcattctttcttgcgatttccaactattacgtttctatcttgggttaaagtaaatcacaaagtgtattagtcagggttctctagagagacagaactaataggagagttgtatgtatgaaggggagtttattaaggagtattgactcacacaatcgaaaggtgaagtctcacattaggccgtctgcaagctgaggagcaacgaagatagtcggagtcccaaaacctcaaaagtagggaagccgacagtgcagccttccatttgcggtcaaaggtccgagagctcctggcaaaccactgctgtaagcccaagagtccaaaagctgaagaacttggagcctgatgtttgagggcaagaagcatctggcatgggagaaagatgaaggatggaagacttaacccgtcaagtccttccacattcctctgcctgcttttatcctagttgagttggcaactgattagatggtgcccacccagattaagggtgggtcagcctctcccagtgcagactcaactattaatttcctttggcaacaccctcacagacacacccaggaacaatactttgcatccttcaatccaatcaagttgacactcactattaaccatcatacaaagtgctttttaaaatcgttgctgaacaataagattaaatgaacctatgtatttcatgaaattcagaagcagtttgctgattctcatcttaaactgttgaatttccagatttgaagtagcactataaaccattttatcttccaatctcatgttgattttagcagtttttataaatattatcattttatttatttatatattttatatataaacaaatttcataaatacataaatttacttttatgtattttaatatataaatacatggtttttattgtattcagatagataagaaggcaattaatgttttgaaagaaatggatgaccaaaagaagctttgactaaaacaaactatgattgttagagatagaaaataattcttgggtgcttcataagcccagcagaaggtgggctgagaaaccaatttatccaccaaggcaggcatattccttaatatgtggtcaaaggagataagagaaaaagaatattccagaggactgagccagagaatgtaaaaaacaatgggcaaaataactccctgcatagagtgcagtcagaatctcatcaaagcagggtaggggtcttcataataatccaaaatgaactaggtatgtgcagaaaataattaacagtttttgtaacacactgagattttggagttgattattgtagcaggataacctagttactcaacttatctaaatacagagaaaaaatgagaaaatgttttcccaatttattttacaaggccagcatgattttgatactaaacctgaataaagaaatatttttgaaaaaattattatgggataatctcactaaatgaacataaattcaaaaattctaaacaaactattagtaaaaagaattagcagttataaaaaagaataacatatcacaaccaagttgggttttatataatctttatataacatcttaaatgaattaaagtaataattctcattaataaaaacatgatttaataatctcaacagttacacaaaagtttttaatacaaagtaaatattcattcataataaagagataaatttatggcaaattaggaatagaaaaaaaagtcctcattctgctaaattatatgtattacaacaaaacagacataaaacttaatgaaaaatgttgaatgctttatttcaagaaagccaaaaaaacgctatccctattaaaaaagtatactgaaggtcctaaccaatatttaagaaaaataaagaaataaaagttttaataattagaaacaagactataaatattagccacagatggcatgactgtgatatatacaattccaaatcatttgcaaatatatattacattactgagtttagctatgtagtattaaaaattacattttatatgaaagcaatcagaaattttaaatgaacctttaaaaagtgtccttaaaataggtggggtgaactgggggtggagggttacgcctgtaatcccagcactttgggaggccgaggtgggtggatcacgtgaggtcaggaattcaagaccagcctggccaacatggtgaaatcccatctctactaaaattacaaaaattagccaggcatgatggcccatgactgtaattctagccactcaggaggctgaagcaggagaatctcttgaagctgggaggcggaggccacagtgagccgagattatgccactgcactccagcctgggcgacagatcgagactcgtctcaaaaaataaaaataaaaaaataggtggggatgactaatgggtacaaaaaaactgcaaagaactaataggacctatcatttgatagcacaacagcgtgtctatagttaataataatttaattgtacattttaaaatcactaaaagagtacagttagattatttgtaacacaaaagataaatgcttgaggggatggatacctcgttctccatgatgtaaacttttttttttttaagaaagtctcactgcgtcacccaggctggagtgcagtggtgcgaccttggctcactgcaacctccgcctcccagattcaagtgattctggtgcctgtctcctgagtagctgagattacaggcaagtgccaccatgcccgggtaatttttgcatttttagtagagacagggtttcgtcatgttggctagactggtcttgaactctgacctcaagtgaacctcccgcctcagcctcccaaagtgctaggattacaggcgtgagccacatgcctggcctctatgatgtaattatgcattgcatgcctgtatcaagacatctcatgtgcctcataaatatatacacctacaatctacccacaaaaattaaaaattaaaaaatgtaacatgtatatatccttaaaatagcataaaaatacaaaatacttaaaaataaattttaaaagatatttgcaaggcctcaagacaaaaggctataaaacattaaaaaacgaaattaaagatctaaagaaatgggagaattcatcatgttcatgaattagaagatttacaatgcaaaggcatcaattctcgcatatttggtaaatacattcaatgaaatccccatcagtatcaagagtgtgtgtatatacaagtagattctaaaatatatagtttttaaaagtcagtaatactcaaagcactccgagagaagaagagcaataggaggacttcctgtccctgacaataagcctatgaaatttaaaatatggtatggaggaacaggaacacactcagttacagatctcgtcagctgtgtgtgttcctttttcctctcatatccactctccacctttctcttccttgctgtttgtctcacgaggctgacctgaatgaaccgcatcaacaaggctcccgtgccctctgggttctagtggatttttgccagtgaggtgccctttgccaaaatctgaaaaaggtagcagagtaaggtcagggtgtttgttccttggttctcctcctgaggaatctcttctagtggcaaacatcatttgttcaaagatcacagctcctttcaacttggctctctccacacacccatctccattcaggttttgatattcctctctgccctctggacatagggatagtaaaactccactggcctaaagataataaaattaaaatgcagatatttctcaaaaatctcatagagaaagaagtctgaggattcaggtaaatgggaatgtggtaatggaattatctgatgcaatttaatcagatgcctgctaaccatactccctgggaatcccagaggacccttctttcaccaaggaatcaggaaattcatcattgagtgggtcaccagaattcttaaaatatttcttggaggccatccaacctctatacagtgaaggcaatggggacggggtgggcacattgccatgtaatttgctttcctggatttcagtgggtgtgactggatcctgttgcgataggtagtggagtttaacagatagagacaaagatagagtttaacagatagagaaagagtattaatcagagtcttttaacattcagagatttttggagaaagctaattaatcatagaatacctaggaaggaaagacagaatcagcttcctgaggctctactttatattatctagattttttgaggaaaaaaatatagttttagtagctataatggagattaataggcccttaatcaatcccaattgagaggcctaaaacatctgaactgagggaatggttgcatccatttgagaaagattatgccagacaatatcaagcattggcaaggatatggaacaactgaagctcttatatatttattatgttggcgctaggaatgtaaaattgtgccaccactttgaaaaatggtttagcaatttttataaagttaagcatgcatatactgtatgatctaataatttgcacccatagattgttaaccagaagaaattaaaaatatatattcacagaagtatttatgcagaatgtatttgtgaatagaaaatattcacataatattgtttatttcttttggataaatattcagaggtgctttattcattataggtcataactggaaaaaaataaataggaatgagcaatttatatatacaataacatggatgcattttaaaaacattacatggagaaaaatgtcagatgaaaagagtttatactgtttgtatccattaatttgaaactcgaggaacagcaaatttaatccatattgagagaaaacagatcagtggttgtctggattctgcagttggggaacccagacaaccactgattgacaggtagagaacacagaggaacaatttagggtgaaataattgttctgtgtcttgatttatacaacagttacatgttctataaatatttcaaaactcaccatatttcaaagcacttaaaatgggttcattttactgcatgtaattcatacctcaataatgttgatttttttaaaagaaataataaatattgctacatgccaaccaaaatgtctaaaattaaaaaagaaagacagagctaagtaatgaagagaatttgaatctactcaaacaagtaagagtgtaaattgataccaatacttaggaaaattgtttaacactaatttctcaatttgaatcataactaatgaaaattattttttaaaaagccaaagtctgggaaatcgtcctaagggcataccaaaaatggagaagcatttattcaagaaaatctactgaatctactaaatgtcagcaaacaaaaataaataagatgtgatatatatgtatacacacacacatataatagaatattattcagcctaaaaaggctgtttttatggatacaggttcctttttgggatgaggaaaatgttctaaaattgattgtggtgatggctgcacaactctgtgaatatactgaaaaacattgagttgtacactttaaatgggtgaattacatggtatgtaaattgtatcttaatgaagctgttacataaaaataaaaaagcaaagcaaaaggtaccacaatatttattgttcttttctagactcagtctggattctccataccatttgaatattgcagtaatgaacactatatgtttgacttttgtataatataactagataacatagagacatctacatttcatatttcttttcacaatcccaattttttaaacctatatatttataccagtactgaattattagtgtcatttttaatctgacacatatataacatgacacagtgaatagctgtcaaattaagtgtcactatatggctattgtgtcatatatggtcatattctaataaccagtctttatgtattatagatttgtgaatttttcttttttggaggatggagaataaggtttggtgtgctatttgaattttgctcacagatctaatctggcattttcacttttacttttagatagttttgttcaatttgttttcaaaaaaattagaagctttttgggggaacaattgcaagagtcattccatataattcctcccaataatgttatgagtaaataaaaattaatatattcacccaacaaattaagttctcaatctgtgccaaatcctatgctatacaatgagtaacatgagctttgggaactgccttcaaacatgtgaagaaccagataccacagaaaacaaaaggaatacattaattgagaaaacatcacataaataattttggggggggcttcctttattttattttattaaaaaaattttaaataggtttttggggaacaggtgctgtttggttacatgaataagttctttagtggtgatttctgagattttggtgcacccatcacccaagcagtgttcactgtacccaatgtgttgtcttttatccttcaccactcccacaccttcccccgagtcctcaaagtccaatgtaccattctcatgcctttgtgtcttagagtttagctcccacatatgagtgagaatgtacgatgcttggttttccattcctgagctacttcatgatatggtttggctgtgtccccatcaaattctcattttgaatttccatgtcttgtgggagagacctggtgggaggtaattgaatgatgcgggcagggctttcccatgctgttctcatgatagtaaataagtctcataagatctgatggttttaaaaggtgttcccctgcacaagctgtctcattttttgcctgccaccatccatgcaagatgtgacttgctcttccttgccttctgccatgattgtgagacttccccagccaggtgaaactgtaagtccaattaaacctctttcttttgtaaattgcccagtctctggtatgtctttatcagcagcatgaaaatgggctaacatagcatattggtaccagcagagtggagcattgaagaaaagatgcttgaaaatgtggaagtgaccttggaactgggtaacaggtgcaggctggaacagtttggagggctcagaagaagacaggaaaatgtgggaaagtttggagcttcctagagacttgttaaatggctttgacaaacatgctgatagtgatgtgaacaatatcatcttccaggataaggtggtctcaggtggagataaggaacttgcttggaactagagcaaaggtgactttgtcatgttttagcaaagagactgttggcattttgcccctgccctggagatttgtggaacattgaacttgagagagatgatttacagtatctggcagaagaaattcctaagcaccaaagcattcaagaggtgacctgggtgctgttaaaagcattcagttttataagggaagcagagcataaaagtttggaaaatttgcagcctgacaatgcaatagaaaaggaaatcccattttctgaggagaaattcaagccataatgaagatccaaatgttaatcctcaagacaaatggggaaaacgtctccaggttatgccagaggtcttcacagcagcccctcccatcacaggcctgaaggcctcagaggaaaacgtggtttcatgggctgggcccagggtcctcatgctgtgtgcagcttaggaacttggtgctctgcattctggctgctccagccatggctgaaaggggccaacatagagctcaggccatggcttcagagggtgcaagcctcaagccttggcagcttccacttggtggtgagcctgcaagtgcacagaagtcaagaattgaggtttgggaacctccacctagatttcagaagatgtatggaaacgcctggatgtccaggcagaagtttgctgcaggggcagggctctcgtggagaacttctgctagggcagtgttgaagggaaatgtgggattggacccccacacagagcttctactggagcactgcctagtggagcagttagaagagggccaacatcctccagaccccagaatggtacatccactgacagtttacaccacacacttagaaaagctacagatactcaatgccagcctatgaaagcagccagtagggaggctgtaccctgcaaagccacaggggtggagctgcctaagaccatgggagcccacctcttacatcagtgtgacttggatgtgagacatggagtcaagcgagatcattttggagctttatgatttgactgcaccgctggattttggactcgcatggggtctatagcccctttgttttggccaatttctcccatttggaatggctgtatttacccaatgtctgtaccctcactgtatctaggaagtaacaaacctgcttttgattttacaggctcataggtggaagggacttgccttgtctcggatgagactttagactgtggacttttgagttaatgctgaaataagttaagactttgggggactgttgggaaggtatgattagttttgaaatgcaaggaagtgatatttgggaagggtcggggtggaagtatatggtttggctgtgtccccacccaaatctcatcttgaattcctatgtgttgtgggagggacccagtgggaggtaattgaataatgcgggcaagtctttcccatgctgttctcatgatagtgaataagtctcacaagatctgatggttttaaaaagaggcattcccctgcacaagctctctctcattttttgcttgccactatccatgtaagacatgacttgctctttcttgccttacgccatgattgagaggctttcccagccatatggaactataagtccaattaaacctctttctttgtaaattgcccagtctcgggtgtgtctttatcagcaccgtgaaaacagatgaatacacttcacttagaataataatctccatttccatctacgttgctgcaaatgccattattttgttcttttttatggctgggttgtattccatggtatatatataccacattttctttattctgtcattgattgatgggcatttgggctggttccatatttttgcaattgcaagttgtgctgctgtaaacatgcatgtgcaagtatcttttttgtacaatgacttcttttcctctgggtaaatacctagtagtgggattgctggatcaaacagtagatctacttttagttctttaaggaatctccacactgtttttcatagtggttgtactagattacattcccatcaacagtgtaaaagtgttcccttttcactgcatccaaaccaatgggtatttttttaaatttttttattatgaccattattgcaggagtgaggtggtatcacattgtggttttgatttgcatttccctgataaataatgaggttgagcatttccagatgcttgtgggccattggtatatcttttctgagaattgtctagtcatgtccttagctcactttttgatgggattgtttgttttttcttgctgatttgagtcattgagttagattctcgatattagtcctttgtcagatgtatagattgtgaagattttctcccactctgtgggttgtctgtcaactctgctgattgtttcttttgctgtgcagaagctttttagtttaattaggtcccatctatatatctttgttcttgttacatttgcgtttgggttcttggtcatgaagtctttgcctaagccagtgtctagaagggtttttctgatggtatcttctagaatttttatggttttaggtcttagatttaagtccttgattcatcttgagttgatttttgcataaggtgagagatgaggatccagtttaattcttctacatgtggctagccaattatcccacaaccatttattgaatagggtgtcccttccccacattatgtttttgtttggtttgtcaaagatcagttggctgtaagaatttggcttcatttctggcttctctattctgttccattggtctaggtgcctatttttatactagtaccatgctgttttggtgactatggcattagagcatagcctgaagttgggtaatgtgatgcttccagatttgttcttttttggttagtcttgctttggcaatgtgggctcttttttgtttccttatgaattttaggaaataattctaaaaccccaaagtgactgaaaataatttgacctttcttagagaattatggtaggaagctctttgctgagccttgtcactagagggaggtagcacatccaaaataatctatctttagacctgaaacacaaaccctgaaagattgctaactgacttggttcctagttctatgtaaaggagttcacatatacagtcacaagagggagctgttacagctgcaaatccaagctccttccagggtgagcgaggttgtcattgagttgtataaggaatttatgttcattctttttgccaccttgtgctttattatctctttttgagtgtgtgcacagtttcaaagacatgggtaagccccttcccaaatgcagagcagaagtgaccctgaatgggaaaaacagagaagtgattaatacatagctcaattttaaatggtgaaatatttgttgctataatggactgacaagcttagttattgtagcagagataatgagtaattttaattttattccttcccatttctttaataaccacttttgaaaataactagaaaaaccccttcatagttacttctacctctcttatcaaatggcatcatttgatttccctctccaaacctcttcccatttcttcctttctccttcaatgtatgccactcctaggcatcatgaagatgagaaagcatatgttaaagaggagttcaagtggcatagaaataggggtcattcaagccattggctcctgtctcaaaaccagaggcacaggcaatgtctatctagaagacacttaggacattattccaggagccagtgtgggagacctgagtaccaggaaacttggcttctaacctgagttctaaatttgttctttcctttcacacttagcacagcaatattatacaattatgaaattacttttgttatatatgttgcaaataccttctttcattgtgtcatttgattttcaattttgcttatggtaattttttttaccaaaaagaagtttctaactgttgaaattaaattatatgctactgcttcttctaagacttactcgccctgaagatgtggatagaaattcccttctttcccttacagcacagggctcacatagacttcttggaataaagggctgttcttaccagctcaatgggttgtcaaactaccaattaatggtgggttttgtccttaccataataagggatgggtaatcccatttacttctttagatgtagcctacttgagtttcagccttgaaaatgatcttaatggaaactttctgaattaaagctagatttaaagaaaatattcttcccctctttttaaagttttatttttttaattaacaaataataatcgtattttatcttcttttaaaatgtatgtttaaacctgggggtgggctagacctaaccaggaagctgctctatctttagctgacgatttctggggagcactcaaattgaaacctgcctgatgtgggatgtgctgtggctgctgctttgttgcttgggacctcctctgacctaggatcagacacagagtctgagttctggggcctggaacctcaatgtgcacttgaacaatgaagttggtgacaagcattactgtactcctatctttgggtaagtgttctgggcctaagaaagcatagttttgtggctaatgacaaaagagagttatctgctgtctccatgttttctaccatgatttaccaattgcgggaaaaaatttgtttctatgtgtttcttgagggtgtctgagcgtcagtgtgaggggttggtcatatccactactcagagaagattctccaggtctcacagctctcaagctgtaaggagttttaggttcattgagctcaagggtcatggaagatgggaaatttatttttggccttgtggctctgcatagctcaggaacaaataaataccagtaatatttatcttgtcctgtgcaacacacataaaaacactcaaatatggagtagggcagggaggacagttctggagcagtggtgaacctgaccttcagatgcaccaagagctgatgatccagagctaatctgctgtttttcaaccccataggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagaccacagtgggacagatggggctgcagctgtgcaatatctccctggtgatgaaagggaaggcatctaacgaggccactgcacaagaaggagcagaagtttaatagaggaagaagaaaatttaaagaagaaaagggaaaagaagtaaagaggaggtggtaaggaaatcaatgagaggatgagaggattaaaggaatgaagaaactgagaaagaatagctaagaagtcctgaagaaaggactgagaagcttggcgaagagatgaagaatcacaattggaattctgcagtcaggaagaaaggaaataagaattttcccggacgctttcttttaatcaactcttgctttccatgtagacctcactataaaagatgagaaccatcatctggtagtcccaaagcatttcttcatctagccccaggcaagtgcctgggctttgaatattatatcacattagtccttccaacctctcaataattgaaatgaatttcagaaattgattcatttgcccttacgaaaaatttgaaattttatttgttactcatccatagcacatactcttgggatatagatgatttctggaagggagcaagaaagtggtggatatgtgaatattgatttcattttttaaatctatgttgaaatatctctattattaaacaaaaatacacaaatcttttttcattgtaaaagattcaaactattaagtatgcgaagtaaaaccttagaggcccaaactgactgtctccatctccatcccattttctcttcaattcctacaataacccattttgacagtttggagagtgccctgatgatcatactccttttcatttatgtggatactcacataaatatctacccaattttattacataagttggaacataccatgtgtatctgtctgcaacttgcttttatttttatttaaaaatagttttttgaggtgtgttcataccgagatacatgtgtatgcatgtgtgtataaactggccttattcttttcaatatctacaaatgttcacagtatggttgtataataattttacttacctcacctatatcatctctacatatataaatatatatgacatatgtgtatgtgtgtgtgtatgtgtgtgtgtgtacatattccttatagattccgaagtggaattactggatcaaaagatatgcctattttatatttttatagatattgaaaagttgcattccaaaatggctttaacagtctaacccaagatcaggaacatggcaaaaatgtctactctcaccgtttctattcaacattatcctagagaatctaaccaatgcaatgagacaaaaagaaaaaggaaaccaggctttacctattacagatttgtgaatttttcttttttggaggatggagaatgagggttggtgtgctatttgaatttttcccacagatctaatctggcatttgcctttactttggatacttctgttcaatttgttttcaaaaaattggaagcttttttggaataatttcaagagtcgttccacataacttctcctaataatgttatgagtaaatagtaattaatatattcacccaacaaattaaatctttaatctgtgccaaatcctatgctgtacaatgaatgacatgggctttgggaactgccttcaaacatgggaagaacaagataccacggaaaacaaaaggaatataataattgagaaaacaacacagaaataattataaaagctccgaagtgactgaaaataattctgtctttcttagggaattgtggtagcaagctctttgctaagccttgttcctagagggaggtagcacatccaaaataatctatctttagacctgaaacacaaaaccctgaaagatcgctaacttgactttatggtaaaggaaaccatatttaactttttaaaacgtaactatcattttgcaaacaatagaattgtctgtgtagcaaatcctatagacaaaaaaactactgtaaccaataaatgagttagataaaattgcaagatacaagctcaatatacaaaataatgctgcttccatacagtaacactaaacaagcagaattgaaatttatatagatatgcatatgtatatttatgcatttatatatttatgcatacatatgcataaaaaacttttaacaaaattttagcagactgaatctaacaatatataaaaaggataatacataataatgaagtggggttcgtctcaagaatgcaatttatatgtatatgaatttcaattctgggccaggcacaggggctcatgcctgtaatcttggcactttgggaggctgaggcaggcagatagcttgaggccaggaattcaagactagcatggccaacatggcaaaaccctgtctcgactaaaaatgaaaaattagccaggtgtggtggcacacacctgtaatcccagctactcaggaggctgaggcacgagaatcactggaacctggggggcagaggttgcagtaagccaagattacaccactgcattccagcctgggcaacagagtgagactctgtctcaaataaataaataaataaatttcaattctggcgtgtgtgtgtgtgtgtgtgtatgaatacacttgacagaagttgtctaaggcctgtacactaaaagatataaaaaaattctgagatacatttaagatctaaataaatggaaagagttattgtgtttgcagattagaagactcattaaaattctctccaaattgacctacagattcaatgtcattcaaatcaaaatcccaacagaaattttcatagaaattgacaagtgggtctaagatttatatgaaaatgccaagggactacaacaaaaaaattctttttaaaaaacacaaattgaggaacttacactactgatatgaatacttttatagttacaataatcaagagactatgatattgatataaagatagacaagtagaacattggaacacaataaaggatccaataataggccagcatgtacatagttgattttcaacaaaaataccacaacaatttgttatgaactgaatatttgtgatctcccctgcaaattcatgtgttgaaatcctaacccccagtgtgatggtattaggaagtaggtctttgaggaagtgattaggtcataaaagtgtagccatcttgaatgggattagttccattcagtgaaaccctagagaactttcttgttctttctgtcatgtgaggacaccacaagaagactgccatctatgaaccaggaagcaggccctcaccagacatgagatcttccagcccctcgatcttagacttcccagccttcagaaccatgagaaataaatttccattgttttagtcacacagtctatggtattttgttatggcagcccaagctaacaaacacaatctcaaaataaatatgctgaaagaaaccggacgacagaaagcagatacggtatgattctgtttacataaaactctagaaaatctatagtaagagaaggcagactagagattgcctggggttgaataggcattgggatgatatattggaaaggtatacagaaaggattaacaaggaacacaaggaatagagacacaaggaaactttggggagtggtgcatatgttctttatcttgattgtgatgatgatttcacatttgtatgaccatgtcaaaaattatcatattggaccttgtaaacatatgtaatttgttatatgcaaagtgtacctcagaaaagtagtttttaagaaggctcaaaacaaaagtagacagagataaatattgaaaaataatcactctgtactatagagaacagaattttttactttctcttaattatggagggtaaactttctcaagcatgcaagggtaacatatgttatgagattatattttctttatctcataagtggcatattttaatgcaataaatagatctatgtcatatataaattaactccagaaaacctgtccattattcagcatttctcagtctggccaaagagtggcagtgttaaaaaagtatttgagtaagattgtacagtgctgaacaaacaggaatccaggtatggcttctgattggtgcaatctcctgcaccaatgagcaaagtaacttctgctggggaagctcattcagtaaaatctgatttaactgtgttttctaaatagctaagggatggagactgttctgcaagtactcctagggatattggggttccaagcagcctgtgagtatgtggttagtctgggagaattgcgagatggtgacagcatcctgagggcaagagtcgagtcatcttctgttctgggaaggcccgtttgagagccagatatgtgttgggaaaaaaaatgacaatactttgttttaatgtgacaattctgctgcctaggggaagtggggagggggagaaaaacatcatccctaccatgaccatgaaaatcttatgagggtcttctgtattttctttacattgtctttttgaacaggggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagacacacagcgatcttcaggcctctatcagctgtctccaaacctgcagctgggccacatatgctcttctgacatggggctcctgagatgtggctgggacctttgccaagacatgaagtctcagaacgttgcaattgtcttattggaaaaatggggaggagagtaggaatgatacaagggggagctatatcactaatcccaaatttaatttgactttattgtctggtagttatgttactttttagtagatggaacatcaaattcgaatgagaatagcatgaatttcagtgatttatgcaagaactatgcacgaatattatgtccctgttgtgccaaggaacttctttccctttgctatttacccaccttgttaataaaaagaaattgtgcattgtttgtcagattctttgtcacagattaacattgtaccaagagtgttagaatatccatactgaggagtcatgggcaatagttttttctaagtttgtagtatagatatagaaaaagacaaatgtttagacagataaataggtgatagatagattataggaagctagattattagatagatgataggtagatagatagataataggtagattagatagagtgagctagagagaggggaatatattaataaatatctaatgcagtcttagactggcctccacttctcttctcattgtgctttcattcatattctagtctcagtattcttctggccactccaaattatcagcttaaagaattgtttcccagttgtctcagtatgaagtggagaagatgttaccttcatcctccactccacatcagaatagtgctggcctacagtgggtgtttacaagtattaaactgatactgaataactgataagatcataggttagagagaaataattcacatgtttcttaaaagctatgtgatgttgaccaacaactttaactttacaagtctttattttccctctgtaaagatgatacaatcatattattttattcatatgttcttgttaggatgaagtaaggttatagattacatacattaagtatctggtgtattgcaagccctcaatatttgagatagtatttttactattaatcaaacaatgacaatttcaagcaagtcaaaattctcacataaaagtagggaagttgatcaacatgatatggcttcaacctaactaggagatgttctattctttaaatttagaaaagaaaggaggaatataatggtctcctgtcatcagaaactgcctagtgacctggtttcaaaagaaattgcatgtaaaatgggaatgatcatttatgttggccaaagtcagggaagatttttaaaaatcaagtcgaattagattattttctgttttaaagaaatgttacctataccacccactgggagaaaagtttgctaaaataaacaggaaagagagaaaagagagaagcccatgaaagaaaatgtttggcaacgtgataagaggaaaagcaagcaggaaataagaacataagtttctgattttcatgaaatgttccgagtaaagtgacacttacctatgtgtgtaaatatgcatatacatatacaaatctcaaactaaagagtgtacatatttgcattttaacctaaaatcaaatttttctaattggaaaataatataaagatattgtctccagtagaatgctgggaatattaagggttgaaagtatgaagataagtagtcataaggatgtttagagattaacctgccatgtcccacaaggctggtaaatcaatgttatcaggagaaagaaactgttaaattcacatcagcgtcttaggtcagcctaagcaaataggttatatgacatgcaacttacccttctcctctttttttctcccccatcaaaagccaatttcctattctgagaaaataattcaccttctccagtgattctgcctcagaatgtccagcaaactgaacaaggctgagctccagacattggttttgattctgggcagcagaaatttccctatgggagaagatgccagcatgacttttcctagtgtgcaatgagcagcgaccagctctgtctacctccttagggatagcccctgataggaatgctggggttgagcaagaggaagagtgagtgattagaagaaagaaggcaggaaccaagtttcttttcctcctgccttgagtgcaaggtttagttccttttctaacagctcttggcaattccattataaatcaggtgaaagaattagtctgatttttgtttgtttgtagggcctagcatgtcatagaaagccactaaattctaatcagcaatatctggacagtaagggagattgtgaacttagttttcttacaggacataggtattataattattattgtggtaaaaatttcctcctagcaggaagataatttttttgtgtgctttgggaatcacccaaaagttttccactgcaaaaatcaatggaataaggaactgatattttctaaaccttcagtaagtggctaaatctatcaggcttatctattcatccccatagtgagaattccttgcaatatgtgtttgtggcattcttatagataccacagtcagaaaaaaaggggatggattaaaataagcagaaaaatttgctacattctgtgctaactttaaccccatataaatgctgtcttataagtagatctattaaatagggccatccatagccacagcctttcatattttaagtaaatatcacaacataatattttcatcagaaaacttgtctccaatttctagagccttttgttactcctggcactatcttagtaggactttagtgtgccagatatgagcctgctagatttaagtcaaataatgatttattcttatgccctcttctcaactgtgttgatcaaattcataaaacaaatgttagccttaaattccttacttcacttccttgtcttcacttcctctgggacatagtcttgtcttgtctagtctagtcttatgctgcagccttgacaacttgccaagataaaaagttgagagttacgatagtagaaagaagagctacagagaataaacagaatgagaaagtataaaatatgattaaatggagttccagaaagaggagagaggtgaatgaggcagaaacaatatatgaagagataatggatgaacagtttttaaaaaatggatgaaagacatcaattcacaattcaagaagacaaaaacattcctgggcaatttatataaaaagaagtgtagtgtgtgtgcatgcatgcgtgcatgtgtgtgtgtgtgtgttcagagtaaaacagcagaaaatcttaaatcaagaagaaaatcttaaaaatcaaaggggagggtgaaaaagactgttttcaaagaagtaaactgacagctgacttctcaaaaataacaatggaaaccaactgagatttgaattatttttcaatgttcagagagaaaataactaacatcaaattttgtataaagcagagcaattcttaaaataagaaataaaagcatttaaagaaaatctgcagaatttaacggtatattttctctaaaggaaactccacaagtagatggaaaggatgagggcctggattatactgcacctgccacctgtgtggttgtgctcaaagaacagaacctctttgggatggtttctaaatttcaaaataaagatgaggtattctcagctagtctcactgtattttattaattgaaacaccatatgtgaaacagaagactctaatgcaaacgtaaagagatttgttactaaaaccttaggccaagctttggatgttcttaaaagggcaatggcaggaatgagaatggggaaaatgatctatcctcagtgagttgtaggacttagagaaagcctcaagggctgtcatgtgttttatcatgtcctgagaaacaggtttacaaatattagcacctccttactgtgctggataattctattcggtttcctccagcagtttgtgataccccctatgtgtagagtgggtatgtagggggcaaacaaaggactcatctgttcttgctgccggcaagctgtagccacatccagttggctctcacctcccaaatagcttcaaagagaagcaaatcatattcaacagtttttgtggcagaactcatcctgcagaatttttaaaaaacttgttttatcttatggcctttgataaaagttctgaacccagggccagttgtagcagaatatggacatatgaaaaatctgcctttagtctcttgccattccttcaccattgcctcccacctattctactgctcctgctttttacccagcccctagtagtattctatgatgttttaatactgttagcctgcccaaagcctgatatttctagtcactgaattgctcttcagaatcttctcctacactattgagtagatatatatctctctccactcaatctctaaaataaagtggtttatagcctaacttactctcaatgtaatgttctaggttaggtctccctggactgtttgtatttgaaaaagagatgtagaggagattccaagaaagtctcctcaaagatacattctcagttacggtggcagttggatagaaaagatgtttttattgtaaaatactctttcccacacttctcagccatagtgtaggctgccagtgtttggtcagttcccatcagcaggaacacaggcaacatactgttagcaattttttttttttttttttttttttttgagaaggagtctcgctctgtcgccaggctggagtgcagtggtgccatctcagctcactgcaatctctgcctcctgggttcaagccattctcctgcatcagcctcctgagtagctgagattacaggcatgtgccaccacacccagctaatttttgtatttttagtagagacagggtttcaccatattggccaggatggtctcgatctctttgtcagcagtttttaaaacatatgtttttattccaattattttagaaagataacataattcagaggaaaaaattaaagattctattgcttgaaaatacatagaacaatattctatttaactacaccttgtctatgtttagatacacaaagactcaccattgttacaattacctagagtattcagtacaataacatcctgtgcaggtttgtagcccatagcctatcgtgtagcaggctataccatctagaccagtacgctcttataatgtttgcacaatggcaaaattgcctaatgatggatttctcagaacgcctgtagttgagcaaggcatgactatatcagtaaaacttctacatgaaagaataggcaggggaactagtttgtctaagaaaacatatgaaaatttaactgtttcagaggcagcacagtcaaaaaagtaaaggtttgtaatcttagatatcactcaaatactagtcctcctacttccaaaccagataaccttgggcatgtgactgaatctttctgaacttagattcatctgaaaaatgaataccatctatttcctagagtggtaaagagtcccatatgctacgggacttaggattgcttaggattgctaaggatagctttggctattcaagctcttttttggtcccatgttaattttagaattgttttttcaaattctgtaaaaatgaagttggagatatatgagataaacaatacacattacctgccacatattaactaatatatataacaaacattatgtaaatgacaaagagtactaggtactcccaggaccttttatgatcctcagaatatttttttgaggtaggtattattatcttgcttttattgatgagtaaactgattttcagagaagttaagtaacttgttcaaagtcatgcaattaagaagtggcagagatgtggtagtttttgtgatagaattcttttcctttccctgcctgttgaacggtctgcatttagacatttctttaaattattttcagtttctttcccttcgtccccacaaagagcactaaaggtcatggtaaggtaggatcatttgaatcatgttatgatcttcctaacatgaatgactcctggcttttccagttaacaggtagtggtccattatgctgtggttatattttctgcatgtatgatgatataacgtaactggccaggcacagtggctcatgcctataatcccagcacttttggaggctgaggcaggcagatcacctgaggtctggagttcaagaccagcctgaacaacatggagaaatgccatctctcctaaaaatacaaaattagctgggtgtggtggcacatgcctgtaatcccagctacttaggaggctgaggcaggagaattacttgaacccagcaggtggaggttgtgctgagccaagatcataccatttcactccagcctgggcaacaagagcaaaactctgtctcaaaaaaaaaaaaaagaaagaaagtaaccaaaagactgtcacttacttgccccatgacccctgttacatagcctttgaacctcagtttgtcatagaaaaatgaagaaaatagtctctcccatcctattgctttttactgtattaaatgtaaatgtatatggttctttaaatgttatgtattattcagatttattacaataattgttatgtaaatgacatctatctgataatagaatgaggtctggagttcaagaccagcttgaccaacacggagaaatgccatctctactaaaaatacaaaattagctgggtgtggtggtgcatgcctgtaatcccagctacttgggaggctgaggaaggagaatcacttgaacccaggaggtggaggttgtagtgagccgagattgcaccatttcactcctgcctgggcaacaagagcaaaactctgtctcaaaaaaaaaaaaaaagaaagtaaccaaaagactgtcacttatttgccccatgacccctgttacatagcctttgaacctcagtttctcatagaaaaatgaagaatatagtatcttccatcctattgctttttactgtattaaatgttaatgtatatggttctttaaatgttatatattgtttacatttattacaataattgttatgtaaatgacatctatctgataatagacacagcatattactctattaactgcatatacagtaaaaacacagtatagaagattttaagataatctgtgtctatttttgtatcagtgacatgctgtttgggttactatagccttgtagtatagtttggagtcaggtaatgtgatggctttgttctttttgcttatgattgctttggctatttgtgctttttttgtcccatattaattttagaattgtttttttcaaattctgtaaaaatgatgctggtaatttgataggaattacattgtatctgtatattgctttgggtagtaattttaattatattgattgttccaatcagtgagcatgaaacatttttttatttgttgtatcatctatgattcctttcatcagttctttgtagttctccttgtagacatctttcatctctttggttaaaatgtattttctaagtattttattatttgtatgtgtgtatatcataaatggaattgagttcttgatttttttccttagcttggttgttattggtgtatagaaatgctactaatttttgtatgttgattttgtatcctgaaagtttactgaagtcatttatcaagtctaggcatctttcagaagactgtttagggtttcctagatataagatcatgtcatcagtgaatagagataattttagtttctcttttttaatttggatgccttttacttctttctcttgcttgattgctctgcctaggacttctggcactatgttgaatagaagtggtgagagtgggacatccttgtcttgttcctgttcttagagggaatgctttcaaattttcctcattgggtatgttgtcatggatgacccttatttgtcatagttttttttattattttgaggtatgttcctttgatgcctagtttgttgagggtttctatcataaaaggatgttgggttttattgaatgctttttctgtatctattgagatgatcacatggtctttgtttttaattctgtttacatggtgaatcacatttattgatttgcatattttgaacgtagaccaatggaacaaaatagagaacccagaaataaaaccatatacctacaaccaactgatctttgacaaagtcaacaaaaatacacaatgaggaaaggacatccaattcaataaatggtgctggaaaaactggatagccatacacagaagaataaaactgaatgcatatctctcaccatattcaaaaattaagtccagataaaataaagacttacatggaagacctgaaactacaaaaatcctggaagaaaaactaggaaaaactcttctagacattgaactaggcaaaaaaatttatgacaagatctcaaaagcaaatgcaacagaagcaaaaatagacaagcagtacttaattaaactaaatagcttctatactgcaaaagaaataatcaacagcgtaaatagacaacctacaggatgagagaaaatgttttcaaactatcaaccaacaaaggactaatatcctgaatctataaaaaaactcagacaactcaacaagaaaaaaacaaccccattaaaaaatgggcaagggacatgaacagatatttctcataagaagacatacaagcaaccagcaaacatgtgagaaaatgctcaacatcactaatcatcagagaaatgtacatcaaaaccacaatgagataccttctcacaccagtaaaaatggctattattaaaaagtcaaaacacaaacagatgttggcaagaatataggaaaaaaaagaatgcttatacactcttggtgggaatgtaaattagtacatctatggaaaacaatatggagatttctcaagggattacaaatagaactactattcgacccagcaacaccactgctacccaaaggactacaaatagagctaccattcaacccagcaacagcactactacccaaaggaaacaaaattgttatgtcagaaagacacctgctcttgtgtatttatcacagcactatttacaatagtaaagtcatgaaatcaacctaagtgtccatcaatgtattattgtataaagaaaatgtggtatatatacactgtggactactacacagccataaaaaagaataaaaccatatcttttgcagcaacatggatttagcttgaggccattatcctaagtggaatcactcagaaacagaaaataacgtactgcatggtctcacttataactgggagctaaacaatgggcactcatgggcatatagagggaaataatagacagtggagattccaaaagggggaatgatgggagggttgaaaaattacctattcagtacaatgttcaccattcgggtgatgggtacactagaagcccagacctcaccattatgcaatatatccatataacaaacctgcacacaaatgacctgcatcgtagtaacagtaataataaatatcaaaattatatgcttgtctagggcacttacaatgaatggggcttgcaggactggaaggtgctctgtgtaattcagcaagtgagtaagaggtcagtgaatgtaaaagcctaggacaatattatacactgctgtagactttataaacactatatacttaggctacagtaaatttgtttaacaataatttcattttctcaagaataagttaaccttaccttactgtagctttttttactttataaacttttaatttttttaactttttgtctctttcataatagcttgaaacacaaacacattgtatagctatacaaaacaattttcttttttatatccttatttatatccttttttatatccttattcttttttaatttttttttctattatttaaacttctgtactaaaaactaagacacaaacacacatattagcctaggcctacacagagtcaggatcatcagtattgatgtcttccacctgcacatcttgtcccactggaaggtcttcaggggcaataacatgcatcagctgtcatcttctatgatagcaatgtctttttctggaatacctcctgaaggacctacctgaggctgttttacagttcagttctttataagtagaaggaatatactctaaaataactattaaaagtatagtatggtaaacacacaaacaggtattaccgtttattactatcatcaagtactatgaactgcacataattgtatgtactatacttttatatgattagcagtgcagtaggtttgtttacaccaacaacaccacaaacatgtgagtaatgcatttgtgctacgattttacaatggctataatgtcactaggtgatagcaatttttcagctccattataatattatgggagcactgtcataaattgttgatggaaataccattatatggtgcgtgactgtataataaaacctgttccagtttgaaccattggccagagacaccaacagacacaatgtaatcaagatgtagaccccaatgtcagccttctagacacaaatgaaacaacacccaacttagctcaagaacactttctaaaagcaggaggctccagttccccaatctgtgggaacaaggagaaccacagtaagtgaagaggaaaatcattatctctgaacttgtcagaagaaaaatcccatcaaggaatgcttttgagaacttgaattctagggaagcccactggaggccacagccactacagaaatatagaggccacagcttcctgacatgcggtgaggccacatctccactcacttcctgtcagtaggtgtcacttgaacaaattttctcatgtcctggccagtcacctggagcctggaggcatgtcttactttgcatacacctctgtcaaaatgcgtatcagacaattatgttataaattgaatgtcttaggtgttacagagtaggtgttgtggaatgaatatttgtgtatcctccaaagcgcactctctctttctctcacacacacacacatacataccccaaggaaaggccatgtgatatcttgattttaaacttccagcctccagaactgtgagataacaaatttctcttcgttaagccactcagtgagtggtatattgttatggcagcccaagtagactaatacattaggttattctgctactgacccaccttactgagctagacctactttggtccccacatgtctccccagggacactgtacgaagcctggagctatgtcagtttttctgtactcaaaagtagtgccctcctatatttacctcttgtttgttttattggagttcctggcaggtatctcccttctctttgaactgtaaatagaaataatccttctttttgaagtaggattttctttctgaacaagcttataatttcctaccattgatcttcttgcatggcaatttcaattaaaaaatcatttgaataattatgttagaatacacagcaactatatttcttaggttagtgtagtttgcaaacaaaaggcatatatgttttcctagtaaccgcaatgtgtgtgtgtgtgtgtgtgtgtgtgtgtgtgttttaatttccctacaaatcactgctaacagccaaggaaagcgaggctatattctggaaggcctgggagatatagtcccctgtatgtgtatgaaatctgtttggaatctcatgtactatatttaaaattcatttgttactttctattatgtaatatattctcatttgtttcaacatacaaaaaatactttaaatcgattatttaaatgtatgtcatgttcatcccagagcttaatgtcacccttcatacattcatacactactacttggcttattcttcttgaggagagagaaatgtattgccagtattctcaataggtacactttcaaggctgagacagcagggctcatgaagaactggaacaatataaaccattgccgagactgcaacagcaaccatgatgatctcaaggaggcgacagatctaatggtaatgggaaaacacacccttgaggaatcagtgagcccctgcagctccctgtcatctctgtgcctcccacattccattaagagaatatagaaggaatgcatttttcatctgaattaaggtgttttgctttctgtttattgtttctttattttccaaaaatatgtttttcaataaaatctggcagtgattaaaaagaaaaaaagcaacataagattgtatttttatttggtggaaagcagcaattcattttaggtaacatgccaccacataacaggaatagagaaggtaagaaaggtaaatatacatacagaagtaagtcatgggcaaacctaaacaactaagaaaaaattagcaatgaaattaaaaggagaaaaatgcccagggaggcagaaatagattttcctgctctcctacgtctaaagagcacaatgagatacaaaacacaaatgccagtagatggcagaagctatttacctaaatcaggattgaggctatgaggcatagcttagacactcagtccagatcctaggcatttgaaactccaagttgcagaatcaattttgatcttaaaaaccaaacttcttcaaaattcccttctgtaaaagtgaggtttgctactattcaaagttttatttgcttcttaaagaatagccagaatgttcctaccactgtgttgataagcaaaggtaacattgcctctatcaggggctttttctcttttatttaagtctctgccttttatgtcaagggattcttttaatgtctaatgatcctgggatgctcattcatacttagtaggatacaaatctgagattcaagcaaagaaaaatggctccagttcctgtttttaaatacttcttcacttcactctcaactaagcctgatagcccagaatttcatgttatttattcaatatcttcagaaaaatagtcttttttccacaaaagtggttggaaaggagtggacacctgactattccaggtcaaatgggaaatctgagagtataactgcaatttattcaattttactttgcattttctctataaagtctcctacccctaccctctctctgattttctgaggtaccaggtatcctactcactaagacttctggtgcacctgaatttttgttggcatttgcttctgtgggaccttagaatttgcctttcttcagttcatttaagtcagttaccacttgttcattcacctgcattttccaaaacatctcacatgctgttatcctttgcctgttctatgtgtcctttggggttcataacttttaaaaacatttttactctcatttcaccaggtactcagaaaggaatagagaagtatgtttccaattcaccatacttaattatcagtctagccttcactgatatttcagagcaattataaggtgcccaggggcagagtttccatctgtcttgttcatgtctccatatttctctaatatatagtgaatactcattaagtgtgttcatcaagtgaaacggagaaatagaagaaactgaaaaagtggcatgaaaggacaaaaatttagcatttcaccatatgggggcagtgtctctattcatagctaaccttcaaggttagctcaaaaccctgggaaaacatctggtaagagatccgattggctgatatctggaacagagatttaaatttcgtggtagtgtttttagtgtcactctaagcccaagagagtttcttgaagcaaaaaaaaaaaaaaaaaaacccattcaggaaataattctttgctgataaggatgctccttgaacatttattaataatcttgtggatgcagctgacatgtgagtcttgagagtttctgactcttccatagcgaattctaaagggaaggaaattctgtgagggcaggaggtgaggctttatcagagactatgaaaagaggaaaacagaaggaaaaaagctagagaaggagggaggaaaggaaagacacagatgcaaggctgggaagtttggtgatatagtgtccaacacagctctgaaaaaggtgatctaaagataaccttaaccaccttcttttctctttctaaacaggggtcagtggtcaacagctgaatcagagtcctcaatctatgtttatccaggaaggagaagatgtctccatgaactgcacttcttcaagcatatttaacacctggctatggtacaagcaggaacctggggaaggtcctgtcctcttgatagccttatataaggctggtgaattgacctcaaatggaagactgactgctcagtttggtataaccagaaaggacagcttcctgaatatctcagcatccatacctagtgatgtaggcatctacttctgtgctgggcagcacagtgctccccaaacacctgcagcctgtactcaaacttgcagctggaactctagtctctatgctgccttcagctcttagtcctcttggcatgaaatgtgattatgcatgccacctttgccactgccattctgtcaccacaaactctcctttatccaaggatttgtcctccaaagattgtgctctttgcttgatgaacttgcccctctcaattcatttttagtcgtatgtaatagattttcttagttatttctgccacgatatgaggagaattgatcaacacacagttacagtagaagattttaataagtatctcttttaaaatggatgatatcaataaagtaaaaatgagagtccagaaataaatccataaatctatagccaatttattccaacaagatcattcaatgggaaaagaatagtcttttcgacaagtggtgctgggaccactggatagccacagttggatctctacttcacatatgtacaaaagttaactcaaatggattaaagacctaaatgtaagatctagaagtacaaacacttagatgaaaacatagttgtaaatcttggccaccttggactatgcaacaatctcttatatacaacatcaaaaaaagcaactgaagggaaaatagataaattgggcattatcagaatttaaatctttgtgcatcaaaattcgcaaaatattccacaaaggaaaatgaaaagataacccacataatagaagaatatatttgcaagtcatgtttatctgataaggatctaatatcaagaatatatattttaaactcttacaatttaacactaagacaaatgccaattttaaaacggtcaaatgatttaaaccatcattgctccaaagaagacacacaaatggccaaaaagcatgaaaaaaaagatgctcaacattattattcattgggaaaatgcaaattaaaccacaatgagctgccacatcacacccactaggatgttcataatttttcaaaaaggaagaataagaaagagaaatgtaaaattctaagtgttggtaaggacgtggggaaattggaatcctcatccaccactggtaggaatgtaaaatagtacagacacattagaaaatagtttggcaatttctcaaatgactaaacacagagttaccatttgacccagcaataatagtcctaaatatctacttaagaggtcgaacatgtgatttatttcattggccagaaccacatcatatggccagtactaattgcaagggaggtagagaaagggagcatttaatttgtctagcctctaaaaaagacatgagcatgaaagatgtcaattgcagataaaagtgttggtttaactatccaaaaacatctgccacatcatactaggtcctcattccccagaagagactctgatgatacatcttgatattcttattactgttattaccctaacagcatgtgccaaaggaagctgaagtctgttaagagctctacagagctcttcaaatgtagtattgtttttgctccaaaaaatatactgtaggttttcttccttgcaactgtcctgtgggaaatcaatatctctcaagaggcatcagctgatgtttcagaggaatgatggtccactgcccctgatactgatatgcgcagttccaggcagttcttaaagctagtcgctttaacgcctcacagagatcatcatgttcttaaacatcgatacggaattcacttccgtctccctgagaagcagtcccttgaagacccagcacaatatttccgtgggtcccacatgtgcatatgacataaccctcaaaatcctagggatgttttaattgaggtaatacttttacagctatttataggatctctagcacaattcttttctcaggaacttaaaaaatgggtattagctaaccatgagtaaccatgtttccttctcccttccccattcccattcagctgtatgtaggcaaatctaccatcccaactttctcgatgttgaagctatgatttattttatagcaggctttctattttattttatttttaaacttttattttaggttcaggagtacatatgcaagtttgttatgtaggtaacctgcatgccacgggggtttggtgtacggattatttcatcacccaggtaataagcatattacctgacatgtttttcaatactcaccttcctcccacccttcatcctcaagaaagcctgggtgtctgttgttcccttcttcgtgtccatgtgtactcaatgtttagctcccacatagaagtgagaacatgtgatatttggttttctttcccgtgttaatttgtttagaataatggccttcagctccatccatgttgctgcaaaggatgtgatctcattctttcttatggctgtgtagcattccatggtgtatatgtatcacattttctttatccagtctaccattgttgggcatttaggttgactccatgtcttcgttagtgtgaatagtgctgtgatgaacataggtgtgcatatgtctttatggtagaaaaatttatattcctttaggtatatacccaacaatgagattgctgggtcaaataataattctatagaaggctttttaaagtgtgggctagtattgaaggtaaagattgccttattcagttctgtatgctcctctgttcctggcacaaagaagacagtcaattaaaaatgtttacatgagaggccgggcacagtggctcatgcctgtaatcccagcactttgggaggccgaggcgggcagatcacaaggtcaggagttcaagaccatcctggccaacatggtgaaaccccgtctctactaaaaatataaaaaaaaaattagctgggagtgatgatgcgcacctatagtcccagctacttgggagactgaggcaggagaatcacttgaatccaggaggcagaggttgcagtgagccgagatcacaccactgcactccagcctggtgacagagcaagactctgtctcaaaaaaaaaaaaagttacatcattaaggggcaagatgctaattaattctcatatctgtgcctctgtgccacccagaaatgcagaaggaagcttataaacaaaaaacagtgggttaaattatctgaccttcatggggacagtacaaactatattcataagcagtaatagaacatggcattatttactttattgtggtgttgtcacatcatcagtctcttacttcatgtttctgggttttgtttcttgcttaagatctagagaattaggccactttatcattgtcacaaaaaaagtagtcttggaaaccaagcgatccatcacttcctctcaactgggcaattcagcttttctggaatgcaaatatgtttgtcttcaccttgagatttgaactttctaattagtaattctttttcttagtgatcataaagatcaagcaagaaagtactagtcttcctagacttgaacactacctacatacattatatgtattttactaaaaatagacattcctagacgatgacaagaaaactatgtaataacatttatggaatggaatgcaaccaaagctatactccaagtatactagcgaaggccaaactattctaacaaatatatgccaaacgttcagaggcttaatgaacaaagtttgtctttcttgtgaaaatctggagcagatattccaggtcagcagatgactctgccttacatgatctttgaggaactgaggttattctcatttggggactctgctatttctcagagacttaccatcatatgcagggtcatggcctggctatgccaggtttcacttagcaaggagatgaacgagtgggtatggagcaggcatgaccattcccttaagaatcatggacaagaaataatagaattactgactcctaagattatggacagctttgggtagcctgtccttcaatggtaagacaattttagaagtatctaccatctttcataaaacgtgtggacactagttttcagctattctgcaccagctcacaagatggcggtgttctattttgaatgacttccatgggtgattgagtgggagggatttgaatttaaatagaaccaaatgacactttttttaatggttggctgaattgccaaattgctatttccctttttctgagtgtgtgtctgtgtccgtgtgtgtgcatgtgtgtgtgcacgcacgcgcacacaggcagacgctaggggtagagtgtgatggttcaaaaagaaaaggaaacgcttaaaggtagtgaatcacgttttgcccaggaaaacacacttgataactgaaggatgatgaagtgtccacaggctttactagctatcttttggcttctactgagctgtaagtagggttactacaaagggtcaggggcaaccaggaaacctgaggattgatcctcagaacactaaaagggtaaagtagacttcgttctgacttattgtctgggagccctgtggttccaacggtgaataattatcacatttttctacacaggggtgagcagtgaagacaaggtggtacaaagccctctatctctggttgtccacgagggagacaccgtaactctcaattgcagttatgaagtgactaactttcgaagcctactatggtacaagcaggaaaagaaagctcccacatttctatttatgctaacttcaagtggaattgaaaagaagtcaggaagactaagtagcatattagataagaaagaactttccagcatcctgaacatcacagccacccagaccggagactcggccatctacctctgtgctgtggaggcacagtgctccctagtcacctgcagcctgtactcaaattctacagctgaggctctgcaactgtaagatggggaacttgctacattgagcaagccctcaaaaataaactatacggaaaagcagttattggtcaaaatccttgtgcctatgttgacaattacttttgcagtttactgaatcctaactcagagtcatatcgctgcattcactactttctctgtgagttttctatgggattcagcatagctaatatttctagagggtcactcaggatactaactccattgccacaccattatgctctgtggtagaaagcaagcccttttatcaggattgtacaggcaactgatatgtgcactacacattagggaatctacctaacagctatggatgttttagcttctttcccaggacaggcacatttataggtaaagttctgcctataacatttttttctggacctactagcaaagaacaaagggtaggaacaagcaggtatcattacctgattaaaacaaaaggttttcattctcagttgcattattcttacttactatcttcattttaggattgttgcctatgctaggtacttcattaaagtggtgatagaatttttcaagatattacacattaatttgtgtacttagaaccttaagcagcctacgaaaagaaaggagttagttgaagtaagttatgtgaagctaacataaacttagcctacttatgttgtgatacactctttcaatgaattatgtaatcatatgtatggtatttacaaagagcttgcaatggaagctaccatttattgaaagcaagtattatgtaccttgtattttgcaaatatcatctcattgaattctcaaaatcactttgataaatcatcaatattactttctgttaacatattaggaaatgcagactcagaaagattaagcccccttccccacctcctaccccagacaaataactataacagaatctgaaatcaggtctatgactccaaactatactttgtctattacatgccctgatgttaaacatcactgaggagaaaatttacccacagtgtgaccacaattatgtgtaaaaaatgtacacaaaatacgaaaataatgtgttcaacatgtaaataaaataacatttgcaataatatgtgaataaaataactccaaaagtttgcaacagtattagttatctttgaatactgaacttaatactgttcattgttttactcctttataatattctttatttttcaaattatctactatgaactcaatactattattatttcagaaagaaaaatatacattttaaaataccaaaatccaagtaggctgaactgcattatatgataattatctgacactcacagtagcttaattacaatgaggaatagacatgactatacatagccaaatgatacagcattaaaacaagatttttgattgctagctcttcaaatcactgtagactagtgctctcttcaattgggaatgttttaaaattacaagaagacctatttctcctgagaatttatttgaatgactgtcctatgggtagaatgctttaatatcccatctctgtgtaggagaggacaggcagtaaaggccacccgtgcttgtgagttcattagacaattcattgcaaattgggcatggtttaggtttcactgtctgggaaatggggagatagcctgagaaaagggcaggtaaacattcaaagaggaggggaagaaacagtataaaaattaatagaatgtatcctgccatttttagcctgcacagtcttctgtccattttcctttctcctttctatctacatcaaaacccagaaatcacacagtggatataagaggaaactctgacagtcatttatttaagactgaaaaatagagcgggaaaccctatgcaagatgcccagtgtgtctggctctgcggtgtgaagagtttatgatttagaagccagagatttagctgtctttgatgggaatgtgcagttggaagggggaagtttcttttttcactctttattgtttcctatcctaatgagaaccaaacaatttacatctcaaaagatcaacctgtcaccaaaataacatgtcttttaatgctaagactaaatatccatttgttataaaagaaaaaacaaattaaaaaaatttataacctcaacctacagacattaccactattaactatttagcattttgctttccatttcacctgtatcaatgaacatgaaaaaataagtctgtagagatgtggggaattcaacttatttcaaacaaagagtgtttctcaaagtcactgcaaaaataggtgtttctgttccttaaaaaaatctacatggttaagatcctcccacttttgacctgtgagttgtgataaaaagcttccagaaaactcatctcagtgacttgattatgaaatgctaccagtttgaagcagtcactgaaaaacataaggtcataaatcaggaatccagaagaaacaatgaatagcaactttatcttcacttcacttctaacactggctctccaaggtaacagccctatcctgtacccagagtggcccttctggagaaggtggctggtttgacctatgactgttgagtgttttacattacagggtctgggagagcagactggatcaagccccaggagacagaagtatctggaacagaagggaagactgtgaacctactttgtaactatggtacatcatcggggagctatcttgatctctgctggttttgacagtatccgagccaggcatcagaatacattctctacagagggtggggatattctggaaaaggagatgccagttttgccataggaaagtttattcaaagagtacagcaaatgcaataaatgtgtacattagaaatctggttcctgcagacactgccttatattactgagatgcacaaaaagaacactttctaggggtgtcatacaaaaacaccagcgcacaggaggaaggagagcatttgttataaccacactgatttttttttttttttttgcaaaggcgtcattgtaagtggaagacactggatcaggagaattctgctttaataatagctatatatagtaatttgtaggcaaatagcttgagcttttagagtttccatttcctgaaattagatagcaattctaatttgtaagcttttatgagacatggttttaacacttggattaagtgcctagcatgtcctacatgctcagcaaatggcaaatatcttttcttgctctccctctctgtctaactactttgacctcaaaggacccttctttcactatctgagaatcttctatatactcctactggtaaaataacaacaacaataacaataataataataataaccctaaaaacatacatgcaagacctagatagagaaggcttctttgcccagggatcaatggtcattgtgccaggattttaaaagtgtatgctcagcaaatccaacaatcagaggacaaaaggaccccgagacactagctcctgagttcatagaccagggcagttgggcatttatcgtgatctgaacaagaacaggagagagttcctcacaagactaaagagaagagaaagacatttagcattaggtgggtggtgggagagaagagagaaattcttgggaagactacagccatgttctggtgtcagatctgacctccctagatggagaagagaggccaagtgaggcagtgggtcctcagcccacctggtagaggaagagggcacctgccacttcctgcactggttcaaactacactcctaacagaatcctatcatttaatctggatgtgagcaaagcctagcatctttgtttggactggtgatagatgaaaggtaaaagaggaaggaagatttaatttagagccttattcaatagtctgcagcagcactagcaccttactgcttgcaggccggaaacctcaaggtctagcagttcacagtgaagcctgcaccacactggctgctgagtaactgccccagtcactaggagggcttggaaatcagacagcaaatgacaccttaaaaaatatgtataaggccattcttgcactgttataaagaaatacctgagactgtgtaatttataaagaaaagaggtttaattggctcatggttctgcaggttttacaggaagcatggtgctggcatctggttggcttctcagaaggccccaggaagcttataatcatggtggaaggcaaagggggagcaggcatgtcacatggccagagcaggagcaaatgagagagagtgagggggaagatgcaacacactttatttaaaccagatcttgtgagaactcactcactaaagcaaagacagcaccaagccataagggatcccacctccatgatacaaacacctccccccaggccccacctctagcactgaggaatacaattcaacatgatttggatggggacaaatatccaaactatatcattccactcttgatccctcctaagtctcatctccttctcacattgcaaaacacaatcataccttcccaatagtcctccaaagttttaacaaattccagaattaactcaaaagtcccaagtctcatctgagacaagtcaagcttttccaccaatgagtctgtaaagtcaaaaacaagttatttactcccaagatataatgtgagtatacacattgggtgaacattcccatttcgaaagggagaaattggccaaaagaaggggccacaggtctcatacaagttcaaaacccagcaaggcagccattaaatcttaaagctccaagataatctccttagactccatgtctcacatccaggacacactggttcaagaggtgggctcccaaggcgttgggcaactccacctctgtggctttgcagggtgccacccccacagcttctctcataggttgttgagtgtctggcttttccagacacagggtgcaagctgccagtggatgtactattctgggatctggaagatggtgacccctttcccacagctctactaggcagtgcttcagtgaggattctgtgtggggcctccaactcctatttcccctccacactgccctagtagaggttatttgtgggggctctccccatgcagcagtcttctgccttggcacccaggctttctcatacatcctttgaatctaggtggaggctgccaagcctctttcactcttacattgtgtgtgcctgcaggcttaacaccacatggaagctgcccagagttatggcttgcaccctccaaagtggcagcctgagatgtacctcggcccctttgggtcatagccagagtggccaggatgtggggagcagtgtcttgaggctgtgcagggcagcagagtcctggacctggcccctgaaaccattctctcctcctaggcctcaaggcctgtgatgggaggggctgctgcaaacatctctgaaatgcctttgaagccttttccccattgtcttggctatctggctgtcttttagttatgcaaatatctctggcaagcagttgctttgaggcttgcttgaattcctttcctgaaaaatctttttctttctctcccacatggctaggctacaaattttccaaacttttacactctgctttttaaaatacaagttctagctttaagccatttctttgctactgcatctgagcataggttattagaagcagccaggtcacctcttgaatgcttcactgcttagaaattgcttccaccagatatactaaattatcactctgaagttcaaacttccacaaatccctagggcaggggcacaatgcagccaagtttgttgctaaggaatagcatgggtgacattcactccaattgccaataagttcctcatttccatctgaaatttcatcagcctggccttcattgcccatatcactatcagcattttggtcacaatcatttaaccagtctctaagaggttccaaattttcgctcatcttcctgtcttctgagccctccaaatttctcagacctctgcctgttacctggttccaaagctgcttccacattttcaggtatctttatagtaatgccccacttctcagtaccaatttgctttattaggcctttcatgcaccactataaagaaatacctgaaacttggtaatttattaaaaaaaaaggtttaattggcttatggctcttcaggctttacaggaagcatggtgctggcatctggggaggcctaaggaagctttcaatcatgacagaaggcaaaaggggagcaggcatgtcacatggccagaacagacacaagacagagagagtgagggggaggagccacacacttttaaatgactagatcttgtgagaactcactcactattgcaaagacagcaccaagtcatgagggatctgccctcatgatccacatatttccccccaggccccacctccaccattggggattataattcaacataagatgtgggttgggacaaatatgcaaataatatcacaataatttcttttataaaaaagtgaaaaatacttttattagagaataattttcaaagatctgtttaaaactaacttttaaaaacaatgaactatgggaaacattcactaatgcataaaataaaatatgtaatctttttcattttcagtttgtgcaaagttattttcacaccctgctggtagcaacacaatatattggtacaatcttttacacagtgaattacttggaaagggattttgagattcattaaacagttcatgcctttgaactgtttgaaactgaatgaacacctttgatccatttctcagaatttatattaaagattgattttaagtagaaaaaaccctctaggcaagaaaatagtaaaaatttctcaaccagttagaggaatttggatggcaacttgactgaatactttacaactatttaatgagttaataatactaaaaacatagtaatgctcttgacatacagttagagaaaacatagagttcctataataaccatatgctcacactaatatcgaatgaatgaagcacatagataaaaactggaagttttgatgcaaaactgaaagtatgaaattatttagtgtatgtacttgcaatattttaatttttattttttcatggaataactgtgaacttgtgcctacaataaataacattttaaaaattctcttgactccaaatgttgtagctagtggaaaaacaaacaaacaaggatctcaaccccagctctgtgcctcagctgtttctcctttcttcaactctggggcatcaattttctggttcccttcccttaactaagtcctcttcttcattattccccaagacctgctgacagaaactctgctgaaatattatttgtgtctcaaacctatctttgatatgggcaaataaggaaaaaactattttcagttcttttctattttctctgcagtagactcagtagctagaagattgagctgattgtaccaaaaattaagaattcttcattgacatcacatgggaaaaccatctccggttttccaagaaggaagattaggtaaggctatataccttgtcattttttttaagttggaacattaaagataaagcttaagtcctctctgctcatgttttcatctgttctcttttcccagagctaaatgttgctctgggtttgtgaaaggaaattaaatcttgggaccccaaactcattgagccaaagggaaaagttaagctgcgaactgggccatgcaaacctgccttgccctttcagttcctacataagatggctacaagatgaaaagctacatgactccaccatattttgcccacaaggaaattcctagtgagctgcaagatctttaccctatagtgtctctgttaaaatttcaccttggaaggccgggtgcggtggctcatgcctgtaatcccagcactttgggaggccgaggtgggtggatcacgaggtcaggagactgagaccatcctggctaatgtggtgaaaccccatctctactggaaatacaaaaaattagccaggcatgtggtgggcgcctgtagtcccagctactcgggggctgaggcaggagaatggtgtgaacctgggaggcggagcttgcagtgagccaagatcgtgccactgcactccagcctgggcaacagagtgagactctatctcaaaaaaaacaaaaaacaaaaaaaaatttcgccttggcaatgtaaactgatagcttattatctttacaggtgcagtcaacccctgtccaccagacataaatacacatctgattgttcccctgccccattttgcctatgttatcttgtgtaaaaatgcaaattccctgcattttttctctgccccatttatctatgtcatcttatacaaaaaaaaaaaagcagattcactaagccagacaaaggcatgaataactatttttccctacccttctcttacctaaaaattgtatacttctcaatatcccaccctttcccctttaaatctggagccctcaaaatcatcttcggagaaagtcatagacctgtctcctgggcacacatccttaactttggcaaacaaacctaaaatgattgagacttgtctcaccatttttctcaattgacacgtttataatttacattttaaattctttatctttattaatatgcacatataaatgtacatactcatgggaaatataaactatgattttatggcatttttaactaaatgttacatatgatatgtttttctccacaatttcctttcattttactcaacaaaatagacttgaagactagccaggttgatagagatcatctcatttccttttaattcatgtaaagtaaatcattctatcaatatgctatatttaataatactgatagtaataatattatttctccacaaagtagacaactaaggttcagaaagattaatttgccaaggtcacataattagtaagtggcagaatgaaagacaaatcaaatcttctgactttagaaagttcttctgtctttctcatttccaacatgtttagtggcaagagaaaggttttcttcacagaaacctaatatcccaagcaaatttgtatgtaggatttctcttgaaaattacctctcacttggctctgttcttatggctattaggcaataaatactaataataaaaataaaaataacaaaaacccctctctcccatattttggaaatttttcaatgcaacacaatggtcaatgttgttcattttttccctcatttctttgtctccaaccaaagaagcatatctctattttaattactcaacagtggggaatcaaactgattgggatataaacctaggcatttgagctggcaatggctaccctctttgggtcccctccctttgtatgggtgctctgttttcactctatttcactctattaaatcttgcaactgcactcttctggtccatgcttgttatggctcgagctgagctttcgctcaccatccaccactgctgtttgccaccatcgcagacctgctgctgacttccatccctccagatctggcagggtgtctgctgtgctcctgatccagcaaggcgcccattgccactcccaattgggctaaaggcttgccattgttcctgcacagctaagtgtctggcttcatcctaatcgagctgaagagtagtcactgggttccacagttctcttccatgacccatggcttctaatagagctataacactcaccgcatggcccaagattccattccttggaatctgtgagaccaagaaccccaggtcagagaacacgaggcttgccaccatcttggaagtggcctgccgccactttggaagtggcccaccaccatcttgggagctctagaagcaaggacccccggtaacattttggtgaccatgaagggacctccaaagtagtggtaatattggaccactttcactcactattctgtcctatccttccttagaattggaggaaaatactgggcacctgtctgccagttaaaaatggttagcgtggccaccggacttaagattcaggtgtgaggctatctggggaagagctttctaacaacccccaacccttctgggttggggacgttggtctgcctggagccagctcccactttcaactttcttggggaagtggagggctgactagaggcagaaagctctcatccagaactcccagcagtagccggttgagaccatggcgcagccagaagtctctagtcaacagtcgcccatacctcctgggtcccgaccacaactttcttgaaagtgtagccccaaaattctccttacctctgaatctacttcctctgatccctgcctcctaggtactaatggttcagactttcatttcctctagcaagttgtatctccaaagggatctaaggaagctctacactgtgtccttaggcacttaggctataacccagggagtcttatccctggtgtccctcccaatttaggtatacggctctcaacatgggctgttatgtgggacacattccccaccacccttgtcagggccccaagtttgtaatggctaagagagagagacagagagaagacagagagagagagagatggagagagagagagacaaagatggagagagagacaaagagggagtcaaagagaaaaagatagaaatagaaaaagaaaagtgtgccctgttcctttaaaagccagggtaaatttaaaacctgtaattgataattgaaggtcttgtccatgaccctataacactccaatacttttttatttacactttgttgtcagtgtaaataagggcttagcccgaaagcactgaggccactgacaacctgtagctttcctatcaaaaatccttaacccagtaacccacggatgggccaaatgcattcagtcagtaccggcaactgctttgctaaaagcagaaaagtaacttttagaggaaacctcattgtgagcacacctcaccagttcagaattattctaagtcaaaaaagcaaaaaggtagcttactaactcaaaaatcttaaagtatggggctattctgttagaaaagggtaatgtaactccaacctctgataattcccttaacctagcagatttcctaacaggggatttaaatcttaattaccatacaaaggtccgaccagacctaggaagaactcccttcaggacaggatgatagatggttcctcccaagtgactgaggaaaaaaccacaatgggtattcagtaattgataaggagactcttgcggaagcagagttagaaaaattgcccaatagttggtctcctcaaatgtgcgagctgtttgcactcagccaagccttaaagtaattacagaatcaaaagactatctcaatcctgactcaaaaggttacctacaccctctctgaaatgaatttgcataagaactgttgtttatgggaatgcatcttgatggggcagctgggttgttatgaaatactcaggaaactagcccagatctaggactcacccctgagagcaaaggcaatgttgggcatgctggtaaaggaccgctagaatccagcagccaggaccactttctttgtggtcaagaaaggtgggaaaacaggtgcaggactgctacactggtaagcataactaatccgataagcagaggtccatgggtggttacgcaccctggaaaggaataagcattaggactatagaggacactctaggactaatgctcatcggaaaatgactaggggtactggcatccctatgttcttttttcagatgggaaatgttccccccaaggcagaaatgcccctaagatgtattctggagaaatgggaccaatctgaccatcagacactaagaaagaaatgacttatattcttctgcagtaccacctggccacaatatcttcttcaaggggcagaaacctggcctcctgagggaagtataaattataacaccatcttacagctagacctcttttgtagaaaagaaggcaaatggagtgaagtgccatatgtacaaactttcttttcattaagagataactcccaattatgtaaaaagtgtgatttatgccctacaggaagccctcagagtctacctcccgaccccagcaagaccccaactccttctccaactaataaggaccccccttcaacccaaatggtccaaaaggagatagacaaaggggtaaacaatgaaccaaagagtgccaatattacacgattatactcgctccaagcagtgggaggagaatttggcccagccagcgtgcatgtacctttttctctctcagatttaaagcaaattaaaatagacctaggtaaattctcagataaccctgatggctatattgatgttttacaagggttaggacaatcctttgatctgacatggagagatataatgttactgctaaatcagacactaaccccaaatgaaaaaagtgctgccataacagcagcctgagagtttggcgaactctggtatctcagtcaggtcaatgataggatgacaacagatgaaagagaatgattccccacaggccagcaggcagttcccagtgtagaccctcattaggacacagaatcagaacttggagattggtgccacagacatttgctaacttgcgtgctagaaggactaaggaaaactaggaagaagcccatgaattattcaatgatgtcccctataacacagggaaaggaagaaaatcctactgcctttctggagagactaagggaaggattgaggaagcatacctccctgtcacctgactctattaaaggccaactaatcttaaaggataagtttatcactcagtcagctgcagagattaagaaaaaacttcaaaagtatgccttaggcccagagcaaaacttagaaaccctactgaacttggcaacctcagttttttataatagagatcaggaagagcaggggaatgggacaaatgggataaaaaaaaaaaaaaaaggtgactgctttagtcgtggccctcaggcaaatggactttggaggctccagaaaagggaaaagctgagcaaattgaatgcctaacagggcttgcttctagtgtggtctacaaggacactttaaaaaagattgtccaagtagaaacaagctgcccccttgtccatgccccttatgtcaagggaatcactggaaggcccactgccccaggagatgaaggtcctctgagtcagaagccactaaccagataatccagcagcaggactgaggatgcccagggcaagcgccagcccatgccatcaccctcacagagccttgggtatgcttgaccattgagggccaggaggttcactgtctcttggacactggtatggccttctcagtcttactctcctgtcctggacaactgtccttcagatctgtcactatccgaggggtcctaggacagccagtcactagatacttctcccagccactgagttgtgactggggaactttactcttttcacatgcttttctaattatgcgtgaaagccccactcccttgttagggagagacattctagcaaaagcatgggccattatacacctgaacatagcagaaggaacacccatttgttgtcccctgcttgagaaaggaattaatcctgaagtctaagcaacagaaggacaatatagacgagcaaagaatgcccatcctgttcaagttaaactaaaggattccgcctcctttccctaccaaaggcagtacccccttagacccaaggcccaacaaggactccaaaaaactgttaaggacctaaaagcccaaggcctagtaaaaccatgcagtagcccctgcaatactccaactgtaggagtacagaaacccaacggacagtggaggttagtgcaaaatctcaggattatcaatgagactgttgttcctctatacccagctgaacctaacccttatactctgctttcccaaataccagaggaagcagagtggtatatagtcctggaccttaaggatgccttcttctgcatccctgtacatcctgattcccaattcctgtttgcctttgaagatccttcaaactcaacgtctcaactcacctggactgttttacgccaagggttcagggatagcccccatctatttggccaggcattagcccaagatttgagccaattctcatacctggacactcttgtcctttggtatgtggatgatttacttttagccacctgttcagaaaccttgtgccatcaagccacccaagtgctcttaaatttcctcaccacctgtggctacaaggtttccaaaccaaaggctcagctctgctcacagcaggttaaatacttagggctaaaattatccaaaggcttgagggccctcagtgaggaacacatccagcctatactggcttatcctcttcccaaaaccctaaagcaactaagagggttccttggcataacaggtttctaccgaatgtggattcccaggtacagcaaaataggcagatcattatatacactaattaaagaaactcagaaagccaatacccatttagtaagatggacacctgaagcagaagcagctttccaggccctaaagagggccctaacccaagccccagtgttaagcttgccaaggggcaagacttttctttatatgtcacagaaaaaacaggaatagctctaggagccatcacacaagtctgagggactagcttgcaacccgtggcatacctgagtaaagaaattgatgtagtagcaaaggattggcttcattgtttacaggtagtggtggcagtagcagtcttagtgtctgaagtggttaaaatgatacagggaagagatcttactgtgtggacatctcatgatgtgaatgccatactcactgctaaaggagacttgtggctgtcagacaaccgtttacttaaatatcaggctctattacttgaagggccagtgctgcaactgcgcacttgtgtaactcttaacccagtcacatttcttccagacaatgaagaaaagatagaacataactgccaacaagtaattgctcaaacctatgccgctcgaggggactttttagaggttcccttgactgatccccacctcaacttgtatactgatggaagttcctttgtagaaaaaggacttcaaaaagtggggtatgcagtggtcagtgataatggaatacttgaaagtaatcccctcactccaggaactagtgctcagctggcagaactaatagccctcactcgggtactagaatcaggagaaggaaaaagggtaaatatatatacagactctaagtgtgcttacctagtcctccatgcccatgcagcaatatggagagaaagggaattcctaacttccgagggaacacctatcaaacatcaggaagccattaggaaattattattggctgtacagaaacctaaagaggtggcagttttacactgccggggtcatcagaaaggaaaggaaagggaaatacaagggagccaccaagttgatattgaagtcaaaagagccacaaggctggaccctccattagaaatgcttataggaggacccctagtatggggtaatcccctccgggaagccaagccccagtactcagcaggagaaatagaatagggaacttcatgaggacatacttccctcccctccagatggctagccaccaataaaggaaaaatacttttgcctgcagctaaccaatagaaattacttaaaacccttcatcaaaccttccacttaggcattgatagcacccatgagatggccaaattattatttactggaccaggccttttcaaaactatcaagcagatagtcagggcctgtaaagtctgccaaagaaataatcccctgcactgcaggccatacatttcaatccctgtatctttaacctccttcttaaatttgtctcttccagaatcaaagctgtaaaattacaaatagttcttcaaatggagccacagatgcagtccatgactaagatccaccacagacccctggaccagcctgctagcccatgctccaatgttaatgacatcgaaggcaccccctcctgaggaaatctcaactgcacaacccctactacgccccaattcagcagaaagcagttagagtggtcatcagccaacctccccaacagcacttgggttttcctgttgagaggcgggactgagagacaggactagctggatttcctagactgactaacaatccctaagcctagctgggaaggtgaccgcttccacctttaaacacgggacttgcaacttagctcacacctgaccaatcaggtaggaaagagagctcactaaaatgctaattaggctaaaacaggaggtaaagaaacagccaatcatctatcacctgagaacacaatgggagggacaatgatcaggatataaacccaggtattcgagctggcaacggctaccctctttgggtcccctccctttgtatgggagctctgtttttactctatttcactctattaaatcttgcaactgcactcttctggtccatgtttgttacggctggagctgagctttcgctcaccatccaccactgctgtttgctgccgtcgcagacctgccgctgacttccatccctccagatccggcagggtgtctgctgtgctcctgatccagtgaggcacccgttgctactcccgatcgggctaaaggcttgccattgttcctgcatggctaagtgcctgggttcatcctaatcgagctgaacagtagtcactgggttccacagttctcttccatgacccatggcttctaatagagctataacactcaccacatggcccaagattccattccttggaatccgtgaggccaagaaccccaggtcagagaacacgaggcttaccaccatcttggaagtggcccaccgccattttggaagtggcttgccaccatcttaggagctctgggagcaaggaacccctggtaacaaaacctgatgtttgttctctactaaggaataaaacaggcatacatgtgagataactataaagagtcaggacatgatagaggtctgcacactatatcagaagccctgtttccagctctgtggctgcagcatcgcacaactccagtgctctgcctgaggctggctgtgcatgcagagctgagccctaggttttggcaggacaagacatgttttattcagggagatgagaaggcctgtcaacatgtactgccccacctgctgcggccaactgtggcctccatcttccccagtaggcagggatggactgagggaggaaagacacctgcggcacatctgaaagatgctttgggccggggacaaaaaagaagtgatagaaaccaggctgtgctttttattgctgtcaggacaattttcttaggacatgggggtttcttttttttttcttttttttttttttgagacggagtctcacactgtcgcccaggctgcagtgcagtggcgtgatctcagctaactgcaagctccacctcctgggttcacgccattctcctggcttagcctcccgagtagctgggactacaggcgcccaccaccatgcccggctaattttttgtattttttagtagagatggggtttcactgtgttagccaggatggtctcgatctcctgacctcatgatccgccaacctcggcctcccaaagtgctgggattacaggcatgagccaccgcgcccggacaggacatgggggtttctaaacaaggctcttcagtatcagctcattgtgagtcacagatcagatctgcccagttctcttttgctgttgacattgttgtttcctctgcaggattcagcagtactgaaagggttattcagtcccaacatgggatctttacacaagaaggggagcttgtgaaatgcaagtactttgcaaatagctcaacttattttctttcttgttttgggcagcattccagtgaggaaatatttcacctgatttctcagagtttaggagcatccaggaacgcaaggaataaaaaatgttctgtgaacctgcaaatagctgccaacactgtcattctcaccatttcagttatgagaccaaaagactcaggaaacagtttctgtgcactcaagacatctacagtaagaggaacaataaaagttgtagttaaaaaaaacaaaaaacaaaatactcagagcttgtaccccagactcatctgccacagggactgggagagatccacgggccctaaactgaaaaaatgtgagcctgtggacagcattcatgaagtatggacaggaaacaggtaactgttgcaagaaaaaccctctcaaactgcattcattgagcagtgctttcaatccacagtccttaaattgactttctccttcaaattttagcaggtaacaaaacagtactttattttaatctaattatttttcttttttctttaactttttatttgatatatttcaaaatataaaataatactgcttattgtaatagatgaagtaataaaaagttttataaagaaaaagttaattctcactcatctgctccctactgaagtaaataatattaataacctgataagtgtcctttcccactattctttctgcttatataaatataggcaaaaatccctcctagtggaacaaatctgtttggggttttttttgttttgttttggtttggttttctgagacggagtctcgctctgttgcccaggctggagcgcagtggcatgatcttggctcactgcaacctctgcctcctgggttcccaccattctcctgcctcagcctcccaagtagctgggactacaggtgcccgtcaccacgctcagctaattttttgtagttttagtagagacggggtttcaccgtgttagccaggatggtcttgatctcctgacctcgtgatccgcccgccttggcctcccaaagtgctgggattacaggcatgagccaccactcctggccacaaatctgttaataaatgtgtgaccaattggaatttttcctctgaatcgccttttacatctttgtccatttttcttttaggttatatatttctcacttaaaaatgcatgctagagatgtcaaaaattttttttatttctccagtctattgtttgtcttctgattttgtttatagcacgtagcatggtatcctttgcctctaaatatactctaaactgtatatagttaaatatgcctgtcttctttatatcttctgcatttctaccatacttaaaaatagtacaggtttatataaatattcccagattcttagacaacagttttatcattttgctttttacaataaaatctttcaaccatctggaaactgtttttatatatgaaatctattttccactattgaaatgtctttgtcatattttatgtttcttaaacataatcaaattatatacatccatattaagaactttaccagtatccaaacattacagaataatgtaagaatcacagtggaactgggtgctggtgaaaataatcactgaattctccagtgccagtttgaaaggagaaattattagccattccactggggtgagaaaggccaatgagtttgactgatgttaaccaaagagagattaaaggatggactaaaagtataaaggggtgacatcttggggaaatgcaagtcttgtgcagagagaggaagatgtttaacttatcctactcaactcctttcctatatgaccggaggtgcctagtccagcttccacccactccactaagttgaggaatagctatcatcacatgtctggaagataatcagcttctgaactggcagagcgtctctggttcttgtggcaaagacataaaatgtgggagaaagtagagaaaaagaaagtgtggtagcctgcattcccaccttttattgaggcaatttttcatgtactagtggttttaatgaatctgtataggtctgaaccaacttgaacctgaacctaccctgcctccaaacagctgtcacttaggggaaggctctagcacaggaggctgtggattgacccatgtgtgaactggaggaggaggaggaggttgagcttgagaacgatcaccactccaggaaatcacgcagatgaagggccctgtagccccctgaagaaaacactagcacaccgttgtgagaaagcacacatttggatttctgccaccaagagggaatccatggccaggaagagataagaaccaacaggaaggagaaggaacctctccatcagaaccctgagaaattcacataaggaaacagcatctgagcaaccaagaagacaaggcccctcagcccaggagaggctgaaaagagagtcctttatttctcccaccactctgcccaacagctgagggttgacatggggtgaagtctgaaagaatagcacatctacctgtcagtggagctcccagagtcttcctgctgggtgtgggtggagggtagagctttgactctaaaatactaattaagttcaaaatgaatacacacatagttggaacaaaactgctttagtaactaaaagagaaaggataacctgtttcccagtggaaaagagatgattgataagtgaaaaaaaaatgaaaacaatttcacactcacatttatctcatgacttgaaatgctctagtcagcacagtaatatctggatctctttgggtattttctattaaatgttccgcttattggcttaatccttcacttatatcatattgttttgtttagagtagtttagagtaagtttttatgtcataaaaaaactgatcttaatattccttttcaagaatgcagttgaaagttcctagatatttgttctctcttatgcatttcatcttgttcaaacaaatggcattctgactgtaactactttggaaagtttaacattttaggacattatatttttccacaaaagaaaaatccatctatttaggtcttattttaaaagtaaattttgcatgtttgtttgtttcttacataccttccactttctttttttttgagacaggatcttgctctgcagcctaggctggagtgcagtggtacaatcatggctcactgcagcacagacctcccaggctcaaatgatcctcccacttcagcctctaaagtagctgggattataggcatccaccatgcctgactaattttgttttttagagatggcgtctcactgtgttgcccaggctggtcttgaactcctggcctcaagcaattctcctgccttgaccttccaaagtgcagggattacaggtgtgagccactgcacctggccagatttctgcttttcttattaaatcaattgctaaatattgtatcatctgtgttgcattattactgaaatttttcttcatttagagaaatttattccatataaggaaaaattactaatttttaatatttgcttaatagccaacaatttttgttacttgttgatttttagcagtactatgaccaaagtggcacatgtacatgtttattttttaaattcctgaatagtacagaaaagtctgtattacaaatctggtttcttatttctctccaactttcaatccttgtccataaatatttacacttttaagtctggatcttctagcagtgagctccatatttctaaataatatgttttaactacttcttgcaacatacattttattcttttattttatttacttatttttttagatggagtctcacactgtcaccctggctggagtgcaatggcatgatctgggctcactgcaatctctgcctccggggttcaagcgattctcctgtctcagcctcccgagtagctgggattataggcatgtgccaccacatccagctaatttttgtacttttagtagagacggggtttctcctcgatggccaggtttgtctcgaactcctagccccaactgatccacccgccttggctgcccagagtgttgggattacaggcatgagccaacgtgcctggctgcaacatgaattataggtgttacctgttgactttcgttttgttttttaaatagacttaattttttaaagcaattttaggttcacggaaaaattaagcagaaagtagagagtttcccatatacttccaggcctcacatatccacaggctcccatgctatggacatcttccaccagagtgataacatttgttccactgatgaagctacattgacgtattattattacccacagtccatagattacattagggttctctagtggtgttgtacgttacatgggtctggacaaatatataatgacgtgtagccgccattacagtctcatacaggttgtttcactgccccaaaatcctctgtgctctgcccgttcactcctccctccccccagctcctgacaaccactgatcttgttactgtttccatggtgttgactattccaaaatgtcatatacttagagtcataacagtatatagcctttttagattggcgtctttcacttagcaataggcatttcagatttttccatgtgtttcatggcttgatacctcatgtcttttgagtgctaaataatattctgttgtctggatgtaccacagtttatttacctattgaaggacatcttggccacttccaagtttgggcaattatgaaggaagctgctataaattcatgcacattttgaactcatttgcttaaataagaaagagcataatttctggatcatatgcaaagaatatgtttagctttgtgagaaactgccagttttcttccaaaatggctgtaccattttgcattcccaccagcaaggaaggagaattcctgttgctccacaccctcactggcatttggtatcgtccgtgttttggatttttgccattctatctggtgtggagaggtcgctcattgttgtaatttgcaattccctagtgacatttgcatggagggtatcttttcatgtgcttatttgtcatttatgtacatttttaatacgtttcactttgggggtcatttagccttcacctggcaaaacaaacaaatgaaaatttacacataattctgtgaattaatttttaaaaacttcataaacctcacctttatccacttttattcttacttatatttacctagtcagacttttcagaactttttccaagttgtcagaacatatttaaaataataaaattaaaataggaggaatttttgcctgtcacctttgctcttctctcttttccctcatccactcccacaccttttcttctttagtttccttccccaaccattccaaacactcattatgcccaagcctctttggacacttcgatcaaaattttctcctctatatcatccggaggaaatgcaccgtttgctcagggacacttagctcacctgcttcccacgttttctctcggtctccacttgtgtctggactgagtgttgctgaccaccacagcatcaaagagcctgtgagaccactggatgcagtctgggggtcagtgacctcagaggaaataccttcagtgtcccacgggctctgcaggtcagtgcactcagagtgagcttcctcacactttgctggggaaagtgtccagtagcttcaataatctcatgaccaaaagactgaagagaggggagaagacatccgagttcacattttcaggcaatagtagctgacatttcctgaatgatccttgtgtgtcaggcaccttaggtccgttcatgacttaccacatgtttctgtatgacagcaccatggggaagcttctgtaattaattcctattggataggttgctgctgatggaagtggggtctccaaatcctctatcccagagtctgtgctgttctgcagactgaatatgctttctccccaccccttcctcaggctttggcaaaggagacctctgaaaaatggcacttagtatattattgacttttgttttttaattggcttttggactaatgaggtcagtataatgtgtgaaaccaaactagaaggcagtgctggtaagtttgttgagtctctgacaaatatttggattctgagcaattcaaacatccaggcaactttaaaaggtcttcttcctctgagactcatagtgacttatacaaataaaaataaaagattagtaataatagtagttcatcaaacactgcatttacttatattttctcaaatactattttcttttttttgaggcagagtcactctgttgcccaggctggattgcagtgatgcaatcttgactcactgcaacctctgcctcttgggttcaagcgattctcctgcctcaatctcctgagtagctgggattataggcatctgccaccaggcctggctaatttttgtatttttagtagagacagggtttcaccctgttgtccaggctggtcttgaactcctgtgatcacccacctcggcctcccaaagtgctcaagtgatcacccacctcggcctcccaaagtgctgggatttcaggtgtgagccaccatgcccagcttcgaatactattttctaccataccatttaaatgtcattcaaatttaatattttcaacaaattttgaaagaaggcaatcaggcaaatttcatctcagtcaaataatccctaaagttacacatgctgtggctgtacctttctcaactttgtttcccttcatccagttaagacttggttgtgcagagttaggggctccgcaggtgatgacatgatcaaaggccctgacccttgtcacaagagtactcactaagaataaaagtgtttgacatcctctcagcaactctgatgtgtaatcccaccagcaattagtgtttttctttctccgcgttgattacagatagtttgcttttccctgtatgactgcaaaggtgtgtatatttgaatgtatgtctgtatgttgtttgggttgcagggaaggaaggagtagaaaaaggaataagaggtggctgtgattggctggtcgctctgaatgcaaataactctatgcttttcacctttagtgaatatataaatgtctcaggataggagcgataataaataatgccaaagatcttccttagtggtcctgtggcttcattgaaggcatacattgaaatgtttctagccaggtgcagtggcttacacctgtaatcccagcactttgggaggccgaggcaggtggatcacaaggtcaggagttcaagaccagcctggccaagatggtgaaaccccaactctactaaaaatacaaaaaattagccgggcaaggtggcacgtgcctgtaattccagatactccagaggctgagacagagaattgcttaaacctggagaggcggaggttgcagtgagccgagatcgtgccactgcactccagcctgggtgacagagcgagactccgtctcaaaaaaaaaaaaagaaagaaagaaagaaagaaatgtttctgaacaggggaaaagccaaatgcaatgggcattcccgaaagactgaagaaagaatacgtgcaagttgattcttctggggtttccaggaaagttgggaaaagaaaatgaatcatttaaaaagtggagagctgatgcctggccctctgtacttgtttctctcagggaagaaaggcagcagaaagtagagcagtgtcccagtccacacgtgtccagggaagagaggcttctatttttaactgcagttacacaagactgttggcttttatgtttcagacgcagtgctgtgaaagaccatgtccttgtagttttcattatttcagaggtaaaatggaaagcaggagtaagagccccaatcattaagaacacggcttagctctctgcagatcacagactcagccaccaactcctgccctgtaaccatggagatgcccccacttcagtctgtacacaaccccacaagaggaaccacttactcgcttccttttctaatcagcatgaaataatatttttcataattattatctgaggcttttctatttcctcctctctatctactttgacaacataaaaatatattagggcctggtcgtggtggctcacacctgcaatcccatcactttaggaggctgaggtgggaggatcacttgagcccaggaggtcgaggctgcagtgagtcatgatcatgccaatgcactcagcctgggcaacagagtgagaccctgtctcaaaaatatatatatatacacatatgtattaggcattatgctgtacacaaagagcttattatctaatacacatgataatatctgtcactagatgtaagctttatagagataccaatttttttatccaataaccactaaccaaacaatgatcaaataaataaatggcaggttatatgtataccgatgtgtaaaggcaaatttatggccaatggttaaaatttactgaaaacaaatttcagctcgctataaaaaagaactagcaatcagagttttcccaaaaagaaacagacagctttaaggcataaaatattcctttctacaggaaatattcaaagaaaagtagaatgcccatttccagtgatgttgcagaattacaaaatgatatgattttgtgcaaaactaaaacatgtaagttttgtatgggggaaaatagcatcgaagaacagaacaaccaaacagcttgtaaaatgcatcgtgaataaaaaaagctacttccagcttaatggaaattggattttggatttgtatttgaagcatgtgtaggatttaaaatgagagagatggtaagagaatacatgccaggcaggataatcttatcaagggcaatgatcaagaaataacagagagaaaggtttaggaaattagaagtttccaaatatgactgaaagaaccaatttttattggaaaatgctgtgagataagagggaatcttggcttgagacaattgttagtgtaagaggactgcacacagcccagaactgggtttctttccagacaaagagaaaatggtatgagattatccatccttaccataaacaacattaaggaatatcttgaaattgtttttcagaaagagctaatattaacctaaatttaaactgttaaataacatcaaagatttactttacaagcacatttctaaatgtactgaaaaactatatttccataataattgattcaatggacagataaatttccttttccctgagtagttctatcatcaactaatagcccttattgcaggaaacgaaaaatctaaacacttttccgaaagtgtcgcgattccccgatcactttccagcgtgaattttcttaggggtgaggatgggaacactaatagtttctctgcactcaggaacctcataaaggacaaactttcaaatcaaataatacagaccaaataaataaaacagagctacatcttgctttgctttacacttcgttctcttccttgtctgtctgcaaaaacctttgcatgattttcattgaaaataactcctgaattgatgcgagattttacttaccctgggacctacccaggcctggtttagatatgttcccatagtcttccctgctcttccgggtactgagttaccataaggataaaccaggcagacagttcttagacattagggctaatttctaatttacccccctgtgtctttcttttatcatcacaaacatgtttggtgtctaatttggtttactcttaggaaaggatggtttggagtacataaaacagaatggttcctcaggcagcaatatgctacagttttagagatcttgtagctctatttttctattaattgatgcaggttttgagaatcaacaagcacattaaaaatagacatcaacactatagtaaaattaaaacagttattctgtcttttgttgttgtttccacattattcagaaagagaaaagtactctttaaaattagaaatggagaacaacaaggaagagaaatctattttgttgaaaaacagcttttggtaatattattcagtgaaagatgaagtgacagacgtggaaacttctagtcaaagtttgcagcttttatttgcattgaatatctatccaagatgaatcatcctagaaaagcagccagtggacttggaataatctcgctcaccatggtttctgccaaggaaggatttctttggcgcagaatgttgggtatttatttggggtcttgaatgggtgaaagagacaaagaacaatttacgagaaagaaaggagaagaaggaatggatccatggacagaaaagatttgtcctcaagggtacatccaagatttgctttaatctgtcatataatggaaatttgaaacagttattagcacaggttcacagcttctcaaaactaaaaaccattgtggaaaagaggctaagcacaaagatgtaagcactaaatgagtataactgctttgcagacagtttcatgtcagtggacatgtgccatttttcttctttttttttttttttctgcccagtgcagctgccacatattattcaatgcacaactttacagggcatcattcacatcttagtaagacatggagaaagacaatgctgagataaagaaaagcagatttccgagagcatcatcagagcctacaaattcagctctgcctggagctgcaaaagtcaaaatattctttttggggatcaagccagcatgaattgagattctgtcatttacagccaatggattcataattctcatagccaaaagggagagggatacttttggttctctgctattttatgagctgaatttatggtccacagaagcattttctactcaaaataactagagttatgtaaagacaaataatcattggtctactctcattatgggaaataagagccataataaccctatgtgtgttttatgaatttcaaatgggaaaaattttgaaaactactaaaaattcataactctacattataaacataagaactcttactttttctatttttactttttaatttccacttttgttactatttttacttattttccttgtttacatttttgcacatgaggaaatcatattgtaagaataattttatgaaattttattctcatttttagaattaaaaatgccttggatttatagtttgaattggctactatttcacaccgtagatatacaatactttataattttcctgattggggatatttttattatttatttccaatttttattattttaaatagcattgtggtaaacatctttaaatatacattttattttatttatatatatatttttattatactttaagttctagggtacatgtgcacacgtgcaggtttgttacatatgtgtacatgtgccatgttgttgtgatgcacccattaactcatcatttacattaggtatatctcctaatgctatccctcccccctccccccaccccacaacaggccgtggtgtgtgaacttccccttcctgtgtccaagtgttctcattgttcaattcccacctatgagtgagaacatgcggtctttgggttttttgtccttgtgatagtttgctgagaatgatggtttccagcttcatccatgctacaaaggacatgaactcatcattttttatggctgcatagtattccatggtgtatatgtgccacattttcttaatccagtctatcattgacggacatttgggttggttccaagtctttgctattgtgaatagtgccacaataaacatacgtgtgcatgtgtctttatagcagcatgatttataatcctttgggtacctacccagtaataggatggctgggtcaaatggtgttgctagttctagatccctgaggagttgccacactgtcttccacaatggttgaactagtttacagtcccaccaacagtgtaaaagtgttcctatttctccacatcctctccagcatctattgtttcctgactttttaatgatcgccattctaactggtgtgagatggcatctcattgtggttttcatttgcatttctctgatggccagtgatgattagcatttaattttcatgtgtctgttggctgcatgaatgtcttcttttgagaagtgtctgttcatatccttcgcccactttttgatggggttctttgtttttttcttgtaaatttgtttgagttctttgtagattctggatattagccctttgtcagatgagtagattgcaaaaattttctccaattctgtaggttgcctgttcactctgatggtagtttcttttgctgtgcagaagctcttgagtttaattagatcccatttgtcaattttggcttttgttgtcattgcttttggtgttttagacatgaagtccttgctcatgcctatgtcctgaatagtattgcctaggttttcttctagggtttttatgattttaggtctaacatttaagtctttaatccatcttgaattaatttttgtataaggtgtaaggaagggatccagtttcagctttctacatatggctagccagttttcccagcaccatttattaaatagggaatcatttccccattgcttgtttttgtcaggtttgtcaaagatcagatggttgtagatgtgtggtattatttctgagggctctgttctgttcaattggtctatatctctgttttggtaccagtaccatgctgttttggttactgtagccttgtagtatagtttgaatacaggtagaatgatgcctccagctttgttcttttggtttaggattgacttggcaatgtgggctcttttttggttccatatgaactttaaagtagagttttccaattctgtgaagaaagtcattggtagcttgatggagatggcattaaatctataaattaccttgggcagtatggccattttcatgatattgattattcctatccatgagcatggaatgttcttccatttgtttgtatcctcttttatttccttgagcagtggtttgtagttctccttgcagaggtccttcacatcccttataagttggattcctaggtattttattctctttgaagcaattgtgaatgggagttcactcatgatttggttctctgtttgtctgttattggtgtataggaatgcttgtgatttttgcacattgattttgtatcctgagactttgctgaagttgcttatgagcttaaggagattttgggctgagacaatggggttttctagatatacaatcatgtcatctgcaaacagggacaatttgactttcccttttcctaattgaataccctttatttctttctcctgcctgattgtcctggccagaacttccaacactatgttgaataggaatggtgagagagggcatccctgtcttgtgccagttttcaaagggaatgcttccagtttttgcccattcagtatgatattggctgtgggtttgtcatagatagctcttattattttgagatatgtcccattgatacctaatttattgagagtttttagcatgaagggttgttgaattttgtcaaaggccttttcggcatctattgaggtagtcattggtttttgtctttggttctgtttatatgttggattatgtttaatgatttgcgtatattgaaccagccttgcatcccagggatgaagcccacttgatcatggtgcataagctttcggatgtgctgctggattcggtttgccagtattttattgaggatttttgcattgatgttcatcagggatattggactaagattctcttttttttgttgtgtctctgccaggctttggtatcaggatgatgctggcctcataaaatgagttagtgaggattccctctttttctatttattggaatagcttcagaaggaatggtacaagttcctccttgtacctctggtagaattcggctgtgaatcatctcgtcctggacttttttcggttggtaagctattaattattgcctcaatttcggagcctgttattggtctattcagggattcaacttcttcctggtttagtcttgggagggtgtatgtgtcgaggaatttaaccatttcttctagattttctagtttatttgcgtagaggtgtttataatattctctgatggtagtttgtatttctgtgggatcggtggtgagatcccctttatcattttttattgcgtctatttgattcttctctcttttcttctttattagtcttgctagtggtctatccattttgttgatcttttcaaaaaaccagctcctggattcgttcattttttgaagggttttttgtgtctctatctccttcagttctgctctgatcttagttacttcttgccttctgctagcttttgaatgtgttttcccttgcttctctagttcttttaattgtgatgtcagggtgtcaattttaaatctttcctgctttctcttgtgggcatttagtgctataaatttccctctacacactgctttaaatgtgtcccagagattctggtatgttgtgtctttgttctcgttggtttcaaagaacatctttatttctgccttcatttcattatgtacccagtagtcattcaggagcaggttgttcagtttccatgtagctgagcagtttggaatgagtttcttaatcctgagttctagtttgattgctctgtggcctaagagaaagtttgttataatttctgttcttttacatttgctgaggagtgctttacttccaactatgtggtcaattttggaataagtgcaatgtgttgctgagaagaatgtatattctgttgatttggggtggagagttctgtagatatcaattaggtctgcttggtgcagagctgaattcagttcctggatatcattgttaactttctgtctcattgatctgtctattgttgacagtggggtgttaaagtctcccattattattgtgtgggagtctaagtctctttgtaggtctctaaggacttgctttatgaatctgggtgctcctgtattgggtgcatatatatttaggataggagaattgatccctttaccattatgtaatggccatctttgtctcttttgatctttgttggtttaaagtctgttttatcggagactaggattgcaacccctgcctttttttgttttccatttacttggtagatcttcctccatccctttattttgagcctatgtgtgtctctgcacgtgacatgggtttcctgaatacagcatactgatgggtcttgtctctttgtccaatttggcagtctatgtcttttaattggagcatttagcccatttacatttaaggttaatattgttatgtgtgaatttgatcctgtcattatgatgttagctggttattttgctcgttagttgatgcagtttcttcctagcatcaatggtctttacaatttggcatgtttttgccacggctggtgctggttgttcctttccctgtttagtgcttccttcaggagctcttttagggcaggcctggtggtgacaaaatctttcagcatttgcttgtctgtaaaggattttatttctccttcacttatgaagcttagtttggctgaatatgaaattctgggttgaaaattcttttctttaagaatgttgaatattggcccctactctcttctggcttgtagagtttctgccgagagatccactgttagtctgatgggcttccctctgtgggtaacccgacctttttctctggctgcccttaacattttttccttcatttcaactttggtgaatctgacagttatgtgtcttgtccactccagaccctgtttgcctgggtatcagcagcagaggctgcagaacagtgaatattgctgaacagcaaatgttgctgcctgatcattcctctggaagtttcatctcagagggatacctggccgtgtgaggtgtcagtctgcccctactggggtttgcctcccagttaggctacttggggtcagggacccacttgaggaggcagtctgtccattctcagatctcaaactctgtgctgggagaaccactattctcttcaaagctgtcagacagggacatttaagtctgcagaggtttctgctgccttttgttcagctaggccctgcctcccaaggtggagtctacagaggcaggcaggcctccttgaccttcggtgggctccacccagttcgagcttcccggctactttgtttacctactcaagcctcagcaatggtgggtgcccttcccccagcctcgctgccgccttgcagttccatctcagactgctgtgctggcaatgagcgaggctccgtgggtgtgggtccctccaagccaggcacaggatataacctcctggtatgccctttgctaagaccattggaaaagtgcagtattagggtggaagtgtcccgattttccaggtgccatctgacacagctttgcttggctaggaaagggaatttgctgacctcttgcacttcccggatgaggcgatgcctcgccctgcttcacctcatgctcagtgcgctgcacctactgtcctgcacccactgtccaacaagccccagtgagatgaacccagtacctcagctggaaatgcagaaatcacccatcttccgcgtcgctcatgctgggatctgtagactggagctgttcctatttggccatcttggatccacccctaaatatacattttaatttaactttttatcgtttcattaagacagcatcctcgaactggaattagtggttcaatgggcaaaacagctttatagcctgttggttccttgtctgtcttaatagcataacaccttttaaaagctttctaaattccttatctctactccctaacccctttcttactcaaaacccagtccaggcagatttttatccctatccttgtatcagaatcactttgttaaggtcacaatgggtttcatagcctcaaatccaatgatccattaccatgttttatcttactgaatttctcagaataatttgacaatttggttattctctccttgaaacattatctttgcttgagtttggggattccacactttcctggtttgctttcaacctcacaagccactccttttctagctcaccttcctcttgctgacctctagatactgtgttgtctcaggactcagtcctcaaacatatatgccgtctacatgcactctctaagtgatttcatccaggaatatggctttaattaccatccatacattgatgactcccaggtttatacctccatccaacccctctctgttgaaagccaggctcatatatactataatctatataacatctttgccagatgtctgtctggcatctaaaatctaagatatccacaacataccttattccctcccttacgctcatccctcactcttccccatctcaagaaaacagtgatataattcacccactcgctatagccaaaaatactggaatcttctttaattcttctctttcccccataccccacattgtcaacaaactggccacataagatgtgttttctgtcagaaaaaaaagcctgacttcattttttaattcaaataagaatgttacatgatgggttccaatgacaacccagtcatttcataattctaattctaaagtaggtagatgaatatggtaaggaaccttgcattgtggctgtcgccagttgaaatatattcctgttttgcaatatttcttgcttagcttttaagggctctcccgcagattccagaagctaataaattgtctctttatttggcagcttgggaattttttttttagcaccctggaccaatgcaccattccggatggttgagatatatactttttctttaaggggtaggaggtaagggtgatgttggaaagagaaatgggaaagaagcagcagcttaacatttggaccctgaagcatgttctagagcaggctggttttaagaaagtcctcatttgcctcaaggtacgtgaccccagtttaatgactataggcctaaatgggacaggatcacaatcacatttgtcaccagcagactcatatctaggaggcatacaagttattcctgttagaacagtgacttactggaaagtcatttcccaccactgatttgagtcgctgttattatcgtacatgaatttccatatacaattaggccatattacagatttgctattccatttaactaacctgtctgcctacccttaattttcacttaagaattttctttctctttcttttcacttctgtgcaatagaaaatatactcttttcttctacattttcttctgttttttttgttttggcataagaatgacaggaattttttaaatgtttaattgtagccaatcctttgctagtggtctttgtcctcttttaggttttctgatgtacagtcattttatctacttacatgcagatgatgttttatctcttcctttccaattcttatgcttcttattgtttctctgggctgactgcattagcaagtagcttcaacacaatcttagatagcagtagtggtaatgaacatctttttccttcacctactttaataggaaagcctctagcactttcccataagttggtgctggtttgggattacggtgtatgcaagttttatgtgatatgttaaagaattagttattagtttttatttttcaatgttttaacatgaatctgtgttgtattttgtcaaattccttttctgcatcaataaagataatcatatgattttttttcttggctcttgtatcagttattaagctactaactcttacctacaattgcttagctcctatacctcgcttctagagtagtaactgctgatgtcaatcatacactggcccctagagctagttgactttttaggtgtgtttttcttctctctccaactggataattagcatattctattttgtacattttattaaatgtctccacagggttaagtgaatttgttgaggtagtgacactcaacatttattgtttacctgccacaacccctgtccatcattgctcagtaaaatcgttaatcatctatagctagacatatacctgctagtacctacctagaatgttgaaatcacatacctgagataagagagaagaaaaattccaaggagaactctcatgtaaatgctacttcctccaagcatctaaaacagctcctctattctttctaggaaaaaaaatcccttctttgaggacattcctggtaagtatcctcataaatagaaaaaaaattttacaaagagaactaaagttttgctagcatttctgtggtttcagacttaatgtgatgtggggatgctctgattgggaaaaagaaagatcataaggtttctagggaagtgtaccagtttacaaatagccagattctccagtgaccacctcatgtgtctattgtttttttctcaagcagaaatgtgaaaacaggagaaggtagagtccagtcttacccaaaccctgcatgtccaggagaaagctaactctagtctaagctacaaaaaacgaaaaaaaaaaaaattctccttgttttacataatttcatacacaaaaaagaatggaagagtaatatccacaattaacatcaaagatcctcttattcttcatagactcagtgtagaggctcagacacttatgtcatgaccacagaaagaaatgaaggaagaaaagaatgaggatagatttgctagggccagggctttacccaagaaatatagctgagaaaatgtgggagggtaataggtaggcacctatgctccacaggatgagacctggatgcaaagaacagatgagagctttcttccctatcctctcctcatcttgagtccctagtcattgctgcaagtacaggaaaccataaaacagagtttcagaaaactaatatgtaaaacatgagaaattaccagtgtgcacaggtgcccagagctaaatataaagcacttggatatttgcaaaagcactagcatgctcagagttagccagttactagactgctttctcacacctgaaaacatcctaaaagaaaggatactacattttcctcctttgtctttttaacgagaatttggaaaaggtctaactcttttaacttatttaaagctgctgagattgagacatataatacagctctggtagaaaaataatcaattaagggaaataatcagatcttctctcaacctattcctacccccctcagaatgtactacagtgccatagaggcaaaaagcctgcataattctttaaaggtgaggggagtgagggagtttcaggtgtaaaggattttcagacagtcataactggagaaactttccttttaacactgtttgctttctttcttttttgtttgctcctcacctctctgtatgttccgtctacctttcatttcaacataacgagttactttatattaagggggaaatgaaaaaacaatttttttgagttcagaccacctgggggcagtgcttcctttgacagaggcactgccagaaactagaacaaggggaagggaacagcaggaggagggcattcaatgatgtgtgtgatgtaacagtgaggttttgattatccgtaaaaacaatgaagattccccaaaggctacccaaccaacagaaccagaagactctagaacagtgaactaggcccagtgaacacggccaaatctaggtctccaaactgaatccacagaggctccaggaaaaggaaagaatggaaactccactgagcactctgctgctgctcctctgtgtgcagctgacctgtgagtcaggcgagtcatgaggaggggaggaatcaagtaggggcggccagggcattgaaatttagaaagatcccggggacaatcttgggtctagtctcaggaatgtaaaacaaataatgaaactgatgaacaaacacactatatatatgaaaatgtttcattcctcctaagcagggtcaaatggacaactgccagtggaacagaatgctccttccctgaaagtcaaggaaggtgacagcgtcacactgaactgcagttacagagacagcccttcagatttcttcagtggttcaggcaggatcctgaggaaggcctcatttccctgatacaaatgctatcaactgtgagagagaagatcagtggaagattcacagccaggcttaaaaaaggagaccagcacatttccctgcacatacaggattcccagctccatgactcaaccacattcttctgcgcagcaagcacacagtgcccacagtcacctgcacccggtacctaaagcttgctgaggggcctgggcacacctccttttataagggccctggggcactgactataactctgctgcatacaaagggaaatatgagggactgttttataacataatatcaaacatttcatttgaagaccatgtgaggaaggatagtgttttcaaataccatctaaagtactttgtttctcagtgtgaggcccttcctttgtgaaaactagcccaaaaactagaggctaaatatcaaaaaggagagagcactaaagaacaaagaaagaacagggtaaaattcttgtctttgagcttctttgtagacttttacaaagatatagaaaatacaaaatcttgaaagccatgaccatcaaattcagtagtgaaaggaaaaatattttgacatgccaaaaagattggcttagaagatcaagtaccaaaatctgagggaaaattgtacaaagcatttaaaggaaaagagaacacaacatggtagaaaagctgtcttctccttaaaagggataaaatgccaaccagctagctagaaaggaagtcaatgatgtgaggagaggtcataaacagtgagtccagcatcctgctcttttctagggtcagagctctgagcaggtagggtgggaggagggtgagtcacatttagcaatgactctgaactgaaggaacagtgaattttggaaaaaactgttttgatcattgtgtcttatatcaatactcacaagaaaacgcccattacagaggaagcattcaacaaccatgtggacaagacggtcggtccaaagcatgtcagccagccagagaatgtctgtgcttgtcaatttcttgaacaatagacccatgaatagattagctgaggtgacagattgagtttctttataagcccagaagcatgggttttctcccaccaagacagattcagctacttctgctgctgtcacaggacttttccttagttcaaagacagggttcttttcccatgggcacgaaaattcaggctcgcaaacaatttgaatggtgagtaagacacggttttattgggtgaagaggaagaaaagggggaaacagggactcttacaaggccagagtccctgctagagcacttcccaccccgcagttcgaatcccaggttccacacaggaagaggaggagcctggctcctccccactgcaaaggatgccaacttctgcggctccaccccagtgcacaggctgcttggaatttctctagggaccccctcccacctggctgtctcactaccaaatgtccaccctgtcagcagtaaatacaacactgagccttcgatgtggaatcatccttcaaaggaaccagccacacactagttggcaagttgattacattggaccacttccaacctggaggtattaggaattttttttcttcttaatacatattctgggtgtgaatctgtggtctcctccaaagtgccacacatagttgcatgaactgatggctcagagtgtctcattgatcattctgatcatcaaaggatttcacatcccttgcatcaacagacccactttatatcaagggcgtgtgacagtagtcatgtcatatagcatatagcttcatcatacagcattagccatgaaccactagcctgatagaactttggaatgaccacttaagggcccagctaaagcaccagcttagggacagcaccctgaggggctgaaaagctattctttgagatagtgttgtgtccctgttacataaaatacatggacctgggtagcaagggatggaagtaggactatcaccccatcaaccaccactttcagtaacccacttttgtgcttcctgttcttataactataggttctgctggactagggattctgtttccctttgagggggaaaagggaggatgctgcttctacgagggaaataggtttttaccaaacccaagataatatatactacctcataatttggggatcttcatgccagtcctggaggccaagaaaggagttactactgtcatggacaagttgatcctgattatcatgaagctaaaccccatagcggaactggggatatatgtctacaactcagggaattcactgtgatgacttttagcactttcatgtcagtgattatcgtaaataggcaactgtagcaactacagcctgacaagagcagactaaccaggggcttatacccctcggtgatgaaggtctaggttacctccctggaaaagaaatctagagcagtagaaaaaaatgctagccgaaggtggggagaatcaagaataagtagtatagaaggtagatggaggagataataaatatgagttgcagtcatgcaactaactataacaaacgtaacttgtcccagtaaccctcttgttgtcaaaacaacatcaacaacaaaaactagtgatctatatgaatttaacacacagcacaagtggatctgagcaaggcaaggagtgaactgtatagatactgttggttccctacctatatctcctaggcagtcacgccaacatgctggacaccactcgctgaaaatcccagcaaccctgaagatgactttgactttctggccatgaatgtggaggctgtggaggacaagccagaaatgcaaaagagttaatgccccaaaagcagttcttaatcagtgatagacagggagtttaggcatgattactccagtttcttcatgactcatttggcatagctccaaagagtatgctatgctgtctcttagagttattgtgacaggtagttagacaggcatgaatggggcacaagagagctctcccctccacccaccaggagtcatcaggcgattgttcggcagttatcacattacctctctaaaaatgataattggcagcaaattatcactggcaacttccccaacagataaagacacttaagattggtaatcagcttccaataaaatctcaggaattggtgagtgaacccagcatgtacattaagagacaaaacagcagagtatgaccttctgtgggcactccaccagaaaaaggaagaaagcctcagatgtgcatgagtacaacttcctaaacacactgctcatgcccacgtcccaagcaggaaggagggcactgcacatgcgggcagcccatcctaagggaagaatcatgggaaaggggcacaagatgctggaggtaggtcagtgtataaaatcttaggattaaggttaaaggctgcacttgtccttccagttgtccgcttgggtctcttccaagtgtactttcctttctctcctgctctaaagctttttaataaaattccactcctgttctgaaatttgccttggtctttcattctgccttatttccctcagtcaaattctttctgctaaagagacaagaattgaggttgctgcagacccatatggattcaccaccagtaactcagaaccttctacctctaacattatccagctgcagaaagctgcaattgcccatcgtggtaactgccttgatggcacattctgtattggcttccttccttccctgatttacctcttacccatgttttgccaacaaaaaagagttaaactctgtaaaatagttaaagaggttgattctgagccaaatatgagtgaccatggcccatgacacagccctcaggaggttccgagaacatgtgcccaaggtggtcgcagtgcagcttggcttatacattttagggaggcatgggacttcaatcaaatacatttaaaaaatacattggtttgatccaggaaggtgggacaactcaaagcaaggggcaagggggtcagtgggagtgaggagcttccagcttataagtagatttaatatttttctggttgacaattggttgagtttatctaaagacctggaattaataggaaacgtctgtattgcgataagaggttataaagaccagagtttgatcaggcagatgaagcttccaagtagcaggtttcagagagaatggattgtaaatgcttcttatcagacttcaggtctgtgttgatgttaatgccagagaggtatgatgaagcatgtctgacccccacttcccattctggcctgaaccaatctctcaagttgaattttaagagagccctggccaagaaggaagtccactcagatggttgcggggggctggggggccttagaattttatttttgatctacagtttcctagaatcacctataataaactatttacacacaaattattgtgtcgaagctgacttttagggatccaaaaccaagatacaggaattcaaatcatgagacaagggtgaagattatccagaagaaatgttggtgccccttctcttattgctaccaagctgagctttgcagcacaagggattttagcagtctcattcaggatgggccccagtgcttacaaactccttaagcatctctctgagaggggacactcagccacctacctctgtgacagagaactcatgctcctcacacagcacccagtacataacagggcccccattcataatgcccagtttggggaccccaactcaggaattacataaggatccctgatgctccctctggaaatgcaaaattctaaagaatcagagtaaggtatttaaaaagagtttttttcacaatattttttcaaaatggaatgaaaatgataagagcaattcttgatataaatataaattaagctgaggcaatttagtgctgatgagaacttctgcaatagttatttcagagcttcttgatatagcataaacaaggtggttttgtttatttgtttgtttgcgtttgttttttgagatggagtttcactcttgtcgcccaggctggagtgtggtggcacaaactcagctcactgcaacctttgcctctcaggttcaagcgattctctgacctcagcctcctaagtagctgggattacaggcatgtactaccatgcccagctaatttttgtatttttaatagagatggagtttaaccatgttgcccgggatggtctcgaactcctgacctcaagtgatctgcccacctcggcctcccaaagtgctgggattacaggtgtgagccaccatgcctggccaacaagattatttttttaatccatgtaaaatgtgaacacaattacacactacatattctgcttttacttatctctgaatttagtcgatgctcttttcagccacaagcatatatcttttttctcattctttattttgagaaattataaaaatgtaaaaaaattgaatataaataggcatattcttatcactcaaaattaagtgtccttatttcataagatttgctttgtaattttttttaataagaagaaaaataaaatcacagtttgccatttgttgtgaatggagtcagaggcttctgctcaccattctggatcacgctctcctctccaagattaggtcgtattaaaaacaaatttgccagctccattttctctttatttttcttctaggctaactaaaagcactccagaaacattttttattttcatttgaaattataaccagaggcctattttctgagagaccaaaaagtattcagaaatgtttccctccttgaaacctagtcacccacccacctatcatagcatttcctgccctgaaggagaattctcaccaagcacagaggagaacccatcagagcaggagacttttcactctgcaggggagcgctgtcagcatgacacgagttagcttgctgtgggcagtcgtggtctccacctgtcttggtaaggaagatgtggttctttctttataaaggcatctaatggggctgtgaagcaggagggattaacagaacagcaactgcattgcctcttagagcccagctacctggaggcagaaatatgctgcctgaggctagaatcacaaagaaaggtgtgtgggaatggggaatgggaatcagcttgtgagtctgtttctcactcacacgtgatatcccagtgaagtcctttctctcctattttccacagaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctttcatgaagcacacaatgagatgagcagcagggagaggcttacagaaacctcagacctcagcatctgtgcaaaggtcacagggtgagagggaagtggtagggtaataggtatagaaaatcattgacttctcttggaaatgaaagcttctcctatttcttctcctgtaagaaactcagagagatggctgtctgcaagcttcaatccttaaagttacataaagataatgacgtgtgcagtgcattccagttttacaaggtgccttcactaaggtacttattacaggtcagatttcctaagcattttctctgtccagaaaatttttataatttgcctgggcattcttacctccaggaattttaaaccttttccatttgttaattgttgcttgtccttttatttgtccatctggtccaaaactgcatctcctccgaataaggtacccattttagaacacaacaggtgtgacaacggtggcataaccacgaaggggacttgctgggcccaccagactcaagagatgacctaggtccactgcagtagaacctagaagaatgatgaaaaggctttaaaatgctccgctgaagggccagctcgtgggcaacacctcagtggttggaatgctatgcttcagaaaatgataatattcgttaaaccactggctgattcatggtgtcgtggcaaaagtttagaaaccaagaaatagacatagaatagagtcttctcctatcactccctataagtcattttcagaattcgtgtttccctttcccacaaccctaggttctgctagattagaggtcctagttcccaaagaaggatgctcccttcggggattcagtaacctgcagctatggctgccacttttaggtcactctgaactctctgtgccaatagcccagcaggcaaagagaggagctattagaccagaaggggtcattgaccctgactgtcatggagcaccaggttgttgtgacacaaggagggtgaggaggaatgtggctataatgtaagtatttcacattggtgtctcctgatgtttccgtgcccaatacaaacagcaagcggcagttcttgtagcagcaaggcctgaaaagggcaacgtgaccaagaactgagactcttcagcaatgaagttttcaagaacagaagctcatgtcatgcaaccttcctgtattaagggcgttgaagagattgcagtcagaggcaaccttgaagacacagtgacacagtggaaataatatagggcaagcatgcatctgagtagtgcaaagaaaggactgtaactgatatatgcgccctgttgccccatccgaatgtctgtctgattttagctggagttatagtagacaatcacactcacgtcatgctggtaacatccagcgttaagcacactctgtgttttgttatgttatgttttgttttgttttgttgctttctatcccaaagtcttctctaatgtctcaggagatcccttagtttaagggcaagcacagcctgaaattatagggaaactaccacccctgttggcaaacaccaaccaatggggaaaaagagccagggaataaacgcactagctttgcgtcccttaaatagacaattctgagcggcaacctgtgtgcttcttgggagatcctaccagaaccgagtcccacttgagtcagttattgctcgacccactttcttcttttataacttatttttatagatcaagggagtacaagtgccacttttgatacatggatatattgtgtagtggtgaagtatgggttttcagtgtaaccatcacctgaatagtgtacattgtactcattaggtacttttcattcctcattctcctcccacactcccaccttttcaagtctcaatgtctgttatctttgtccatgtctatgcattatttagctcccatttataagtaagaaatgtagtatttgaatttctgtttctgagttacttcacttaagataatggcctccagttccatccatgttgctataaaagacatgagtttattctttttatggctgagtagtattccatggtgtgtgtgtgtgacattttctttatttaatcatccatccattgatggacacttaggttgattccatatcttttctattgtgaatagtgctgtgataaacataacagtgaagttatatttttgatataataatttctttttgtgggggtagatacccagtagtgagatgctgggttgaagagtagttctatttttagttctttgagaaatccctatactgttttccacacaggttgtactgatttacattcccaccaacagtgtatatgtgttaccaaacatctgttgttttctgacttcttattaatagccattctaactgatgtgagatggtatctcattgtgcttttaatttgcatttatctgatgattagtcgtgttgagcattttctcatgtttgctgaccatttgtacgtcttctttgagaaatgtctgttcatgtcctttgcacacttttcaatgggcttatttgtttcttgcttgttgagttgtgtgagttccttgtagattctggatattagtcctttgttggatgcatggtttgcaaatgttttctctcattctgtaggttgtctctttactctcttgattatatattgtgtggtacagaagctatttagtttaattaagtcccattagtctattttttgtttcgttgcatttgttttaagatctcagtcataaattctttgcctaagccaagatccagaagagtttttcccaggttttcttacagaatttttatagtttcaggttttatatttaagtctttaatccatcttgactttatagtaagagaaatggatccagtttcattcttctgtgtatggctaactaattttcccagcactatttattgaatagggtgtcctttccccagtgtatgtctttgtctactttgtcaaagatcagttagttgtaggtatgtggctttatttctgggttccatattctgttccattgatctgtgtgtctatttttcatacaagtaccatgctatattgatactatagccttgtagtatcatttgaagtcaggtgatatgatgcatcaagatttttctctttgcttaggattgctttggcattcaggctgtttttttgtttcatattgattttagcattttttcctaattctgtgaaaagtaatattggtattttgataggcattgcattgaatctacatattgctttgggcaatatggtcattttaataatattgctttttccagtttataagcatgagaggttttttcatttatttgggttatccacaatttctttcatcagtgttttgtagttttcctagtagagatcgtttacctttttgtttaagtgtatttctaggtattattttgtggctattataaatgggattatttattttgtggctattataaatttagtttgtagcttggttgttactgatgtatagaaatattactgatttcatacattgattttgtatcttgaaactttactgaattcacttatcaaatctgggagtcttttggaggagccttgagggttttccaggtataagacatatcatcagcaaacagatagttggactttttcttttccagtttggatgccttttatttctttctcttaccaattgctctggctaggacttctagcactattttgaataaaagtggtgagagtgggtatcctgctttacccattttctcactcctgcttcctgagatcacttcctaaataaactacctgcacccaaggtagtttcaggctctgtcttggggggaaatcaaactaatacagggaatctttggaaatccaaagattctttgaaaatttaacaaagaaagaacagaggagagttcaaggtgaaccttactgggctaagctaataaaggtaagtgtgtacttgagtgagaaattgtaaaaaaaagatgatgaggcagatcgcatttactaaactccaatctctgcagatatgtgattacgtcttttcagtgttcaaaaactttactttccaagtttaagctctttcaactgtctctcatttccccttcccaaatcttctgaccctttactatttaaacttcattcctagttattcccaaaatacgtctctcttctagtcagtttattccccttactggctcataaggacttaaagctcattgctggctctagcatttctctactggttgctccacccacccaaatttcccttttgtgtatatttcagactgcttaaaccatattaatcttataatgaccaccagaaatctctcttccctctaagatttcttctctaataatcaaacaatcctttaattccttctcttccaaatgtcatacagtaccaactgtggaccaaacaatccgactcttactgacataccttcctaagacatttgctgttgtttcaaggtactcatctttcctccccaaatacattatattctctatgtagatagagtttgccttgtacccttcacaattcctcactgctcttagcacagtactaagcacataataagtgctgataaggcacaaatatgcttaaggtttaaattataatcatgctatatttctgaaagaatatgaaggaaaagaaacaggtttctctgaggaggtaagatgtgatagaaggtagaatttaagaaagcagtgataaaggaaaggacagatacatttcaaacatccaagtcttttgatttagtggaaacataaatctgaaactggtaaaaagattacttttagaatacatttcttactaaaccaagttctttccatacagaaaatcctagaaactgcctctgtaattatctctttgatctgaagagggcactgtttgctcctgttgatagcagttacttacaaaaaaccgatctcattttgaagaatccgctattcctaatacatacaaaataactagaacaaatcctatgttatccgtagagtctaggtcagatttccacattctggaatcaagttttccaccaattaaaaaggtcaaaccatggaggagcttttaggaactgtatttgtgatctggtggctttggcctgggtgagagctgagtgaattcatttcatcagggacacagaggactcagaaggttctgagaactagtctctatattttacagaagggattcaaagaataaataaaacatttaatttaccctttatttaatttacccttaattcatcttttttaagaaaatttgctatcaaatgaaggaagaggaatgctcttctgaccatctgtccagagagacacaaccaatctctgttctccagagagacagagccaataggatgaatatatagatatatgagaggggatttattagaagaattggctcatgcaattatggaggctgaggagtcccatgacagactgtctgcaagctggagaacctgggatgctggtagtagtgtgactagtccaaatccaaaagcctgagaacccagggggccactggcataaatcctacagtccataggccagagatcccagagttcttgtgtctaagggcaagagaaaaagagtgtatcccagctccaggcaagagaaagaccaagttgcttttcctaggtttctgttctatccaggcctctagcagattggatgcccacactgaagatggatcttccccatgtattccactaagactcacaagccaatgtcctctagaaacaccctcataaacacacccaaaaataatgctttaccagttctctaggtattccttaattccgtcaagttgacgcctaaaattaactatcacaccatccatgaaggaaagatgttttgtcatctactataattatttgaacaatgtttcagatccatgggacagaatgaaaaagatctagaataaatctgatgtctttgtttctgttcttgttaactagggttttgtagtgcaggggaagataagcagcctccttcagtgctagtaccagctccctctccctgaaccacaagaccacccagtcgagggacttagccatctatgtctgtgctgcagggaacctacatgcccctgaaagcacctaaatgcaccaccccctccaccctgcattgggacctccactcaggggttagtaaaccatcttcatcacctcctctgaccaaaagaatattgtaaatgaatgtaacaaatcagagaaaatcttttctaaaagacttttagaaagctttttgttcactgtattatcagataaggaattcagagtcatgagaaccctgatcatgagctgtctgaggtgattaggaccagggaccctgagtgttctttcgtcaagacccactcatctaagaggggctgtctcaatgattggagcggcttctcccacttgtgccattaattgctggtatgcctcagtttttgcatctgtaaaaattctcccacgagaacctgagagtaggcgtgtgatactcacatatttttctcctagtttttactttttatagtctaactagctaactccagtaagaaatcccatgatggtagttgccagatagggttgatatcccaagggagcacagtaaaatttctcagactgcccagaaggggttctgcttccacaaaaaagcagccgtctgcccaccccacccgtatttgcccacttgcaagttcttttatatacatcgctttatttggtcttcaatgttcaataatttgattaactgtggaagttggaactgattgaatgataaatacaagatactaaagttctgattgcataggtcccagaggatcacaaaaaagatctaaagtggcaagatctatctatggccacaccaccccaaatgtgcccaatctcatctaaaatggcaagatccattcagcattgcagcactggaatccccagtcagcattgcagttgcaggcccagtgagcccaggcaagaggcggaaaacatttactcttgagaccctaattagtgaactcatagatagctgcagctggcctgagactgggagagaagacagcccaatcgtctggagcttcctatacagactagagagtggtggcacatgcctgtagtcccagctactcggaaagctgtggtgggagcatcacttgagcccaggaggttgaggttgcataattgcgccactgcactccaacctgggtgacagagtgagaccctgtctcaaaagaaaaaaaaagagaggagaagggggtaaattgtaaaataatagcatatttgccaatttcctgtgaatttgtccagaaaatagtaggtagtgcagaaatttaacaccacgcaaacaagaaaagtagaccacctatggaagaaactcaacatgctgtactttaagaagtcctccggagttaagaacggctgtggcaaaatgcccactgttagcaccatttccaagtggaaataataaatgggaagggagagttaagaccaccactccctatacggcaagtcagcttttaatttagtcttttattctccttcttgttttacagggggaaaagtttacataaagctgaactatacagaagccttatctaagattggatgacacaaattaaatagggagagaaaattaatgcaaatgaaactagtagttctctgtattgtgagttttcatttttgctctgttgcctcttctataaaatgcagactaattcctgacctttcctccctcaaagaagaatgtgtgcatgaggaaaaaatcagatgccaatgaaaagctgtcagatgtgcaacacagaatgttcccaaatgaattttatgttgattgttctgagtcttctttcacaaagtcattaacagaagctcacaaaagcccttgccaccagtattgtagagctccttgacacagccaaaatcaggtattctttttttaaaaaagaaagtcttcagcaaattacagtataattagatatcaaaagtctggtttcaattttctctagactatctgaatgttattgttgttgtcattatttttcatcatttctcaaagtattaaaatacaatttggtcaaacaataatataaccaatacctgtattatcataacccagagataattttctgatattggcttcaagacagaggagggaaagaaaaaaaggaaagaaggaaggaagaaaaaaaaaaggaaaaaagaggagtaaggggaagggaaagagaaggaaagacgggaaggaaagagagagaaagagagagagaaaggaaagacaataaaagcttatagagaaaactgaagtcacagcattagcttggcctgtcttttccccacccatctcattctcctatccaaattatgtctttaaaaaacaatgtatcagctccctttcctcttcatgtttattcccaaataaattacagttccaacaacatcttttttcgttaaatattatggtccaagttttattctctgaagcaaaagacaaaaagtatcgaagagctttccctaagggagacatcataaacagcccacctgacatcccatttcctgttctgaagcagctacggcaccagtgcagctgatactcaaggttcagatcagaagaggaggcttctcaccctgcagcagggacctgtgagcatggcatgccctggcttcctgtgggcacttgtgatctccacctgtcttggtaaggaaggcgcatgtattcaccttaactagtattcaatagaacagagaagtgggaagaaagattaatagtgcaagaatctaatctcttcactgggcccagctattaggggcaagaaagctgatggattttgtcagaggtttggatcaagaggaagaaaggcgggtggcaatgggaacaggcttgtgagtctgtttctgtctctcacatggtatcccagtgaagtcctttctctcctctttcccacagaatttagcatggctcagacagtcactcagtctcaaccagagatgtctgtgcaggaggcagagaccgtgaccctgagctgcacatatgacaccagtgagagtgattattatttattctggtacaagcagcctcccagcaggcagatgattctcgttattcgccaagaagcttataagcaacagaatgcaacagagaatcgtttctctgtgaacttccagaaagcagccaaatccttcagtctcaagatctcagactcacagctgggggatgccgcgatgtatttctgtgcttataggagcgcacagtgagacaagcaacagggagaggcttacagaaacctcagacctcagcatctgtgcaaaggtcagggggaagtgttcagggttataggaacataaagaggaaataattgtcttccctaaagaaaaaaaaatgtatctgactataggaaacacagaggggatgtctataagctgtaatttttgaaatagtaataaaataatgaatccacacatgccttatagattttcaaagtaccttcacatgttaatccattaaacctgcataagcctgtgtgttacataggtcagatcagatattctaaggatcactgctatccagagaatcttagagcttgacctaaagctatattcttttagaattatatatttttgctttattattttaattactatctatctgtacatcccatgatcatatcaaagtcaatatatccaaaactgaatttcttaccatctccacaaacctttattttttcttcatttttttctcctcagccttgctcaagattcaggaacacaataaaagtttgctattgctgggtttccagtttggggaatttcttcaccctcgactttccagcctgggctatcagatttttatgcataccttattacattctaattataaaatggtgcaaaaaaaaacactacatcatgtcagtctcactgtttcccctctatccgtcattctttctgactttaacctggcttaatcctgtatttcttaacgttctttaaagcatcatttgtcttgacataagaaagtaaggaaagaaagcaaacgactgtcaagtaggatttcatgtactgctagtactcaccagcaaacgctaaaaaaaaaaaaaaaagaggaagttaacttctggtaatgctataattgcttctggtaaggcaacctagcaggtggtgacaattttgataaacctggtccaacagggagaccaagcagctgccatggtccaagtctccacccctatgtcttctgagaattgggagatgcctggaccgtgagaggattctcccttatgctaagggaaaaattaaaataaatgaaaaaaataatgccaacatttctttttatgcccacaattcccccaatacatctccttcactattaagccccttgtggagcattttattccatctgctcactgtgggtggcgagaggaagtttggaatgacaaacagccgaaataattaagtccaataagcaggctccagagcttaggctgggggtctgtttggaatgagtggtgagagtgactggatgtggaagagggtaaggggaggccaagaccaaactgcagaatcataattcagattgccgagtcatttcccaaacacagcagcttcagtaacgccacaccctagcccagcttagcacccaggcttctgcttgtctgaaaaagtggggtaggcaccaatcaaaatgaaaacctttctctcacacgaggaagacaccttcaggctattcaggttttgtcctcccttttacccctgaggcccatgagtcacccagacttagattcgggctagttaccaagtttcatatcaaagctcacttctttctatccttgcttctagtgctttcacgcagctcctctcatttgaattaataaataatcattaatctactctctctaccttcgattgtgtcctcttttaatatggtttagctgtgtccccactcatatctcaacttgaattgtatctcccagaattcccacatgttgtgggagggaaccagggggaggtaatggaaacatgggggctggtctttcccatgctattctcatgatagtgaattaagtctcacaagatctgataggtttattgtgggtttctgcttttgcttcttcctcatttttctcttgccgccgccatgtaagaaatgcctttcacctcccaccatgattctgaggcctccccagccatgtgtaactctaagtccaattaaacctctttttcttcccagtctcaggtatgtctttattggcagggtgaaaacagactaaaatacacccttcaaacattgcttcacatagctgtcccagtgagcatcctataataaaaatcagatcatgtacacacacctctgcctcaataaagcctcatttcccacagaaaggcccagtgattatttagaatataagtccatcaaagcggaggccaccactgtatctccagcacttaccatgcctaacagggtaaatggtcagggtcatctactgatggattaattagtctgtaccctgcttagcaactcagcctcatttgttgccatattcccatccccccaaactgtacacgcccatccgctcagcaaatgaaattgtttcctgcatctatgcctttgccagcattgtcccctcagcatggaatgcccatccccaattaaccacttgcctattatttgaaaggttcgcaaacctcccctcttctctgaatccttgtcctgacccttttgcactggtagaactgatcactttctcctttatctcctaactgaaaccctaagcatatttctaacgtggcaaatccaacaccttatggtgtttacaggtatttttcactgtctccccactaaaatgcaaactgttagttaccaaggacacagttttacccatttcaatagcaactgtgcctccaacaatctttaattcacagaaatgattcttaagttttttgaatgaaggtaattaattgatgggcattttcctcattaaacattatagagtaaaaatggataaattttctattttgttatctcctccatagttgtgttaactcagaattctgagctaactcataggactgtaaggcatgtcaaaaattaatagtaacaacagtatcatgctgataataaaaatattagtagtagctaacaattattgagtatatatatatatatatatatgcgccccatattctgagaggtgcatgacatgctttatttcatttagtagtcccaacaaatccatgctgtagctactattgatatcccagttttatatgaagaattaatataggttcaaagaggccaaaatgcctagaatcacacaatgtacgactccctgaccactggcctttttcccttcccaaagggtggcaaactgctatagcatctcagtcttattaatgtaatagacacatagaacataagaaagaaattcatgaaaacagtgctgcaccatacatgcacttgtagtcctcactttttctagagtagtaattgcaagatgagacttatttcaagtatccttattaatagaagttaaatgtaaaaataacactattaccattattgtttacataggaaatttttgcctttttaacattagtttataattatttgacctgggactatacaatattttaaacttcttcagtgcatttttcaatagcgtttaagtttaaaatgcagtctttggcaggggcattaataaatgtttcaaatgtcattttgtataactctttaaagaatacaagagtttagaagaaatttctaacctttccaagttatctgaatttccaagttatcataggaagatccttcctttgtaacttttaaaacttttttgtatatggttgggcgtttctatgaatgatgcttttcaattttttttgcttcagtgaaaaattatatattgtgaaagctttcccacataaacaagcagtttttctatagcatgagtttcccatggctacaagatattgtatttttgaaatacacctcattttacccaataacttgaggttttttttgttttttttttttgtttttttttttttcagatggagtctcactctgtcacccaggctggagcacagtggtgcaatctcagctcactgcaacctcccacagccaggttcaggtgattctccttcctcagcctcccaagtagcagggattacaggtgcgcaccaccatgcacagctaatttttgtatttttagtgggggtttcctcatgttggccaggctggtctcagactgctgacctcaagtgatccgcccacctcggcctcctaaagtgctgggtttgcaggcgtgagcctctgtgcccggcctaacttgagttattgatcgagtaaatcaatgaatacagtaagcatgataagtacattgtttccaaattggagctataataagtaaaactgtaattttaaaaagatacttgtacataaaatagtatgcaagtaagagagagcccagatcaaagtaaccgaagcaaaacaaaacaaaacaaaaatctgttggctaataaaactgaaaaatctgggttaactactttaggaaggactgaccaaatgctcaaataatgtcaccacagcgtgtctctatcgtttggctcttgtttatattggctttactctgaagaaagctcaggcccacatgatggcaaagatggccgccaggagcctcagacttgtgtcctactgtgttagtttcctcctgctgctgtaacaaattatcacaaacatggtggcttgaacaatattactttattatcctacagtttgggagctcataagtctcactgcactaacacaaaggtgttggcagggctgtgttccttctataggctctaggggagactgagtgaaatcctgagcatccctggcttctagaggctgctgcgtgccttggctcatggccctcttccatcttcaaaactagaaatcgcagcactgtgacctctaccaccattgtctcatctcctgtcaccctcatggccctcctgagccttgatccttgagattacattgagatcccccacatattccagaataatcttcccatcttaagattcttggtgaatcccattttctaaatcacattttcaaggacatttgccacataaagtaacatattcacaggttctgaggataggtggtggacattcctatagactgaatgtttgcgtcctctcaaaatttgtatgttgaagtcctaatccccaaggtcatggtattaagtggtaggacctctgaaaggtgattaggtcatgagggtggagttctcatgagtgagattagtgcttttataaaagaggccccagagagctgccttgctctttccaccgtgtgagagcacagcaagaaggtaccatctatgaaccaggaaatggccctcaccagacactgagtctgctgctatcttgatcttagatttcccagccttaattgtcagaaataaatgttggttgttaaagccacccagtctatggcatttggagtataactgccccagtggatgagagagacatctttggaaagctacttctctccttaccatacctgccaaattaacaactccagcagaagaaacaggcttcttttgtgatatttccagaaaatatcctggactgactttgcttagactgatttcttcagatttgggaaacaggcagaggtggttcctcaaggcaaagccaagatgctactagaagaggaatgaataaggatacgtaaaaataacagatgaccccaatgctattaatttatttcaaactcctttttgccatcagaaagcagtaataagctcacatatcaattccaataaaataattttttaaatcgcccaaacttacatttcaacatagcaagcaaaaagcaatgaataaaattgcttcaccaaaatatagaagctctgttgaccagaaattcagcatagacagttgttcaagataatttcaatgtgttcagcagataaagggacaaataaggactctttaagggcaaatttagctgagggatgtgttaaattgtatatttggcagactgaaactaaagaataaaaaaagagacagcttgatataactttctatgccaaacccaatgttatactctaaatctaaaactccagaaaaagtttgaaagcaacaaatatgaagtcaggaaaatcattctaaattaccaactatttaggtataatcttgagcattttagctgtagatgaaagtcctatttattcatatagattctcatatgctatgaataatagttcatttggatgtctctttaaatcaaggagggataaagacaggaaggaagaaagctggcaggcaataagagccaaagtaaagatattattttgattaaaatatactcattgttgaggtatccacaaatatttgagaacacattgaagaagtaagacaggtcagaaaatataagtatatgatcagcacttagtgaaaacagttaaagagaaagaaagagcaaaagaaaaattgcttaaagcaacatagatattcaaagataaggaattaaagctgagataaatgtgacagaaatggaaaggaaggaaaatgaagttatgaaacattggcaaaaatagctaaagaatgcagaataaaatgtcctagaaaacatttatcaaagggttatattttattagcattcagtagtcacaaggcaagaaatatgatagctataaataaatacatgagaatgtttaaggttttatgatgatcgtggctttactgttcaatatatattaaataaaccacaagttatctataacacagttctgaataaaatttaggaaacgtagagtcaggtacctcaatatagaaaaatacagaaataattaaccataatgcagacaaagtgacacccagttgtagagagcattacaagcattgaaatattcagaatattatttgattaaaaaaaagctcatgtaaagataccctaagcaataccaaagatacacacacacaaacacacacacacacacacacacacgacacatacatgctatatataggaaggaagaaagcttctttattggggacacagtttacatattacctcttgtttctatgagatgctataagaaaaaatctcttaagatttactacatgggtaatatatttatatagtgtctgtgtgtatgtatagcaaactcttatatatatatatggatatcttacagtcttatagacttatatgagagtgacagtaaaagagagagagagagaggagtgtatacctatttcctctcaaaaaggccatattctggcaactcccttattccccattccctactatgcagtttgatctagccttagatttcccaggaggttctcttccagaaaagtgcctgtagctataaaataatcttcatcttggctgtttcaatgcaggattcctattgagccaataccttaccattttctttccttcgtggaactgtgctttgtcataatgcaataagttttctatgaagtatatcataaacaacagtcctacagaattcatcattggacataatatagcttctttattggggacacagtttacatattacctcatgttctatgagatgctataagaaaaatttctcttaagatttcctacatggataatttgtacctacacttgtagtttgtttttatcatatggatgaggtaattatcacaggactgattgttttccttctttacattgactgctaataagttcagagccaatgttagcttaactccaactatagaggctgattgcatatattttaattccaaatctaattcaaggtttatgttcctgcccttatttttttcttcttgatttttgtatttctttgctgttgtttttgtagatttttctgtgccttatacttttttcaaagataattaaaacagtgtgtgaattcagtggggtggatgaatgaatgaggcagagaaaaaggaaattgacatggtaggataacaaactcacataatatgtagatacatataaaaagacacacaaagaaaaaaatttctctaatatatctaatcttctttatgaatgatcccatctaccaaatagtcaagaaacttaaattttgtaaattgcaattaacaatgtctcattttattcaggtttaaagagttcctttcactttaaatattcagttcatttaagttcaattccatgttagggctgatgtaaattctttcttagatgactcagtctctttaggtgatatgtttggaattcaaccaccttacccttttctttccgtgatgaaatttaggtgataaggtgagacagttgagtgtcacctgaggcaaaaaaaaaaaaaaaaaaaaaaataggcttaaatccatgcattgccttctggatcttttggtctgagcagctgagcagccaatctactctgttccctgtgtaggtacctagttatatatggattttcctacctggacttttgggattatgtgttgacaccactgctgaagccaattgtttcagccgcttgactccatctcaaagaccctcatcatgggcacttctttgtacttagcccaggactttgccaggccactagctctctcaattctctgcatctacttcctggacccctggggacttctgtattccctgcacctgtaaacagaccatggggattctagaaagtagcctctgactcatgtagccaagccttgatttttctccagcgccatcttcccacgacttaagtaagacttcccccagagacatgcagcctgcccctagaacactgtgagaggtgctctactacccagtactcttgtgctgttcccatacttatctaaatgcttctagcctttcctaacccaatcagtgtccgcccatagcagaccaggggaaagaccagagtcctgacacctaagttccttgttctgcctccatttttctttaccctctaggacccaaaaaactgacctccctctctgtcctgcacctttctgtcaaactgatgtaaaactctatgatcaagtccagctggtcttacatataatatggtaaagaatacaataaataattaagaaaaagtgttacacctgaaaaaaaccttacttttaaggcagttctcttgttaagtaatcaaagatccaaatttagatgtcagagctgaatattaatgctttctatttccattcctctcagaataatctaatctctccccactcaagacagatagattcctcagaagaatatagataaggttatgtatctgaaaatataaaggagaaaagaatattaatacatttcaaaaatataatctcaattacaagtagagggaggaaatattttatatcaccaagggcactcattggaaaatcaccatagatattttcaaagaaaataaaagacttccaaaatcaaaagaaattaagaaaatgaagaaaagacaagccacagactgggagaaaatatttgcaaaatgcatatgtattttttaagtggtatccaaaatgtgcaaagtactcttaaaactcaacaataagccaggcatggtggctcacgcctgtaatcctagcactttggtaggccaaggtaggcaaatcacctgagatcaggagtttgagaccagcctggccaacatggcgaaaccctgtctgtactaaaaatagaaaaattatccaggcatggtggcgggagcctgtaatcccagctacttgggaggctgaggcaggagaatcacttgaacctgggaggtggaggttgcagtgagccgagattgagccattgcactccagcctaggcaacagagcaagactccgtctcaaaaaataaataaataaaataaaataaaacaataagaacatttaaaacccaatgaaaaaaatgggcaaatatctgaacagacacctcagatctgaactatctgaactatctgaacagactataaacaaagtatatagatggtaaagaagcacatgaaaagatgcttaacatcaaatattactagggacttgcacattaaaacagtgaaatatcactacctgcctatcagaatgactaaaatccaaaacactgaaaccatcaaattttgtgagaatatggagcaacaggaacccttattcattgctggtaggaatgccactttggaagatagtttggcagttactcataaaactaaacattctcttaccatatgattcagcaatcatgctccttagttttaactcaagtgagttgaaaacttctgtccccataaaaatctgcatgaaaatgtttgaagtacctttatttataattgctaaatcttgaaatcaaccaagatgtccttcaacaggtgaatctatcgacaaagtatggtacatccatacaatgaaatattattcaatgataaaaagacatgaccaggccgggcgcagtggctcatgtctgtaatcccagcacttcaggaggccgaggcaggcagatcacctgcagtcaggagttcgagatcaccctgggcaatacggtgaaactctgtctctaccaaaaatacaaaattagctgggtgtggtggcacatgcctgtaatcctagctactcaggaggctgaggcaggagaatcgcttgaacgaggatgtggtgagccgagatcatgccattgcactccagcctgggcaacaagagtaaatctccatctcaccaaaaaaaaaaaaaaagacatgaccacaaaaagacgtggaggaactgtaactgtatattgctaagtgaaagaaaccaatctgaaaagactatatactgtatcattccaactatataacattctgaacaaaaacaaaactatggggagtgtacactgatcaaagtctaatgtaaattatgggctttagttaataacaatatattaatattggcttatcaattgtaacacaagtatgacattaatgtaagatgtcaataataggggaaatggggaggatgagggttgagggggtgtataagagctctgtatttccactcagtagtaatacatcccatgctagtcttaatcttaaaaagggaaatatattctagttgctgtatttcacaatgctatgatcattccttgtcttacttagttcattaaagctgccatatacaatcatagactaggtagcttacgaattacagaaatttattctcagagtctggaggctgggaagccccaggtgaagacaccaatggatttggtatctggtaaaggcccatttcctggctcataggtgacattttctcatcatgtcctcacatagcggaaggacaaggcagctctctggagcctcatttataaaggcaccaatctcattcatgagggctttgccctcatgacatagtcaccgcccaatggcaccacctcctaatatcatcactttggcaattaggtttcaacatatgaattccaagggggaagacaaacattaagattgcagcagtcctttcttctctatcaaatccttgcttatccatctagatcctcagcaaatacaacttagactatatagcccataatgatctactttgctaatcaactcacatacaacttcttgactctgccatatgggggactttttaaaacattgacttatatttctacttaatcgtgtacaggtttatatgtgtcaatattcagaactatgatttacacacatagaaacatataaattaaaccaccatcatcactcccaatcatacacacacatgttcatatacagcatccaataaagcatcctattcaaatttggtaataaataaatatttacttcttgaaagatcaactggctaaagaaaataatgtattccgattcatccactttcccaaaggagggttctacacaacaatcactagtgtgtgcctttggtcacacttttaagtaacagtaagcaatgaaaaaacaaatagaaaatgccaggctgctctcatttgcactcctgcttcatgtaaatgctttcaattattcatctagcaaaccacacacacattgcaaatgcctaaaatttccttttgccaattagaggtaaacgcagtccccaatttctatccatagaagaattaaagcaattctatttgcatccaatgtaaccaaaagttgcctttctcaaaagatacctatgtggcctcaataatccagacaaaaggctcactctctcagtgtggctgctgtacttcttgcctcttgtctgtataatctactgaaattaggtaccacagcactttctctccaacaaatccatggaaagtaggaaaacatgttgaactactccaggactcccaaattcaggttgaaattttctttcaacatagaagtagaaacttctggtgaaagatggtaatagctcagcaggaagtcagcacaaacctctaaaggcaaagcaggaggccggagtcctcccctctctccctccctcataaggagccctgctctggagacttccatggggacaagagagaagaaatcgttttgctgctcagatcctaggattgagtgacataggaatggagggcccaaaaatttgagtaaaattcctagacttggtttctgaaactatcctgactctaagattaagcaacttctcttcttaaatttcttcttataaatctctccttggggaacgttcctgggtggataaaacctatggaagaggggaaacagagttgtggagattaaagttaaaataaaaaaaagtctttttgttttgttttgtttaatcctattttctcattatttatctgaggtaatcaagatccagagaagtccctcccttgccctacatgggatagcagggggttccgcaaggattctgtcctcgcactgactcccactcccagtctgtgtctgcttttcataccaaacactaaatatgttattaaacaggagaataaaagttgtgaatatcaccctggcctagacagaaacacacaatatatacaataccatactataacagatattctactagatatgagagagccaatacaggctaatgaagaaacaagaggaaaagatgaaaaaaatgacatctagaggtattcgtaaaataaaaatctaataggtaagtaggcatgagttaatctgatctttcctctaccccaaattatttttctgccccaccgtctaggctagaatgtctacttcctgcttctgtgcctatagtcatcttagtctttgtctaagaacttggtcaaaccagaacctttaggtattgtgactccatcagttaatccctatggatattttgcttcttagtaacattctgggataacatttgtagactgctttggttattaacaaaaccaacaacatggagctttaatgcactctctaacttgagttctttgtcttgtctcttttacagctgcgttttctctgtgacaccaggaatcagcatttccattcaaatacagcaaactttaaaccgctttttgacaggaggaaacactttctgcctaatgaaggggatgaagcaggtaacccagagagtatctgccacacaggcctcctctacagtagctcagaattgcactgtttgattatttcttacacgtggcatctgcaaattcagaaaggtgagtgatgtcagatctaaaggtcccttcttccatcttggttcattcaaattcaggtctaagaggaaacattgaagaagctatctgaatttcaacaggactgattactttccaccaaaggctgtaggagacacagatttaaagagtgactagggggttaaacataaacatatattgacagtaattcctgcattgtcatcaaagtgtgctcatgtttgtaggccaactcttagtggtattcagacattggaaaactgtaaaaccttcatgcatttttaagatgacttctaaaatattttattattagtttaaatgtttaaatagctacaaaggttgtaaattccactgtaatataaacattgacattttcaaataaaactcagaatagcttttaaacatatccagtgaaaccttaataccaaagtgatttgatacccatcaacacccagttaaaattcacaacaagctcttcattgacaattgaagaccttatattgctcttttctttccttggaatcatatttccattcaacttctcctgcagaacttaattttagtatatttttgtttaaaggcttttgttgatcacccaaaatgcctgcaacaaaatcacgtaaaaaattgaaattgcttttaaattttctctgaccatactgctctaattgctaaaaattatctttctagattgagttataaatataattattgttgatgtaccttttattaaaacaacaaaaatatatttcaattttagttttaaacttacaggcgaaaattttttggaaatgcatttcttaagaaaatcactggggtcggcccggcgcagtggctcatgcctgtaatcccagcactttgggaggccaaggcgggtggatcacgaggtcgggcgattgagaccatcctggctaacacggtgaaaccccgtctctactaaaaatacaaaaaattagtcgagcgtggttgcacgcgcctgtattcccagctactcgggaagctgaggcaggagaacggcgtgaacctgggaggcggagcttgcagtgagccatgatcgcgccactgcactctggcctgggcgacagagcgagacactgtctcaaaaaaaaaaaaaaaaaaaaaaaaaagaaagtgactggggtcatatttatggttaattaaaggaggcttccttgacaccaataaattgtccctttgtttaatgttccaggggtgtttaaactgcagggcaatgctgcaaaaggagattccgtcttgaataaggttggggaagagcaattatgaaatttgagacgggaaacaagaaccacagtcaagctcttgaacagatcacttttaggaaaggttacatacagaagttgaagatctggaaattgattcccttaaaatacataactgttgcctagtttgaaaaatcactgcattagattgctctccacattactgatttcattctcagccagacttcatgaagtggtgaggtttgaggaaaatcagcaagagattttaatgacagagccttgagtttcagtaaacctgataaatttcctaaaacttatttgacatttctggcttgaaagaatagctcctgatgaattagaaaattatgggagattgagttcttgcatgacacaaagtcatttaaacatatatctttatcttgggaaagacagtttaaatgtcatggccatttattaataatattgtgaaaaaaagttatcccaatcctggaaaaaagaaaaatgatggttgctagtctttttttttctctatctgcaagagcattttcaagtaagcaattatctggcattcttggggatcgtaactttgttgtcagagcatatttacctagcaatccataactgagaaaaggctcacatagtttacattcctgtgggttggaggttaacccacagaaatggaagagttttgcgttcatagcctggaaaaaaaaattaaccccagattatcgtgtcaaccctaatagcattttattttgctatctatatagttgtatctttttcctgtaaacatttgtggaattagctttttttagttaatgattaagaatagtaacaaaatgtgaacccaggctcactccctatttgtattagtattttgttttttagcacatttaaggccatcctggcactaaatcagaaaactacttcctgatacctaaactataaaatcctggtttcatatacatctgaattaggcaaaaacatagctggctattatttatttaatttgatgtcttaacatgtaaagattttcttttcagaagaaatctaatggaccagatgtcctgaaacactcttaattatttttcagtagtacgaacatagccatgaaggcaaaggaaggtagatgatcaattcatgttaagagtttcaaattccatggactaatttatatctttctccacagccacctggcacattctgcctttgaacagatgctttacaaaaacataatctgtggacatggagatcttgcataaagcaaattctctctgatccacagcttcactgaggggtttcagttttctaggccagagtgactgctggagatgaagagattctatcaaacgtcagtgtaaaattgtctcttacttaaaatgccctcattgatcttatcctgatacccttactacagaagtttatcatgactcatctaggagataccagagagttcactagccaattcaagagcatgacttctcaaaattctccatgttttcctctttccttcctagctaatcccactttctcctgcctttgaaggctatagcttctctgccaatttcttgaattatggggttcctaagccctcttctatgttatccacagattctaggcaatcttactggctcctgagcctcgaataccatttaactgctctagactgacaaacctgtatctctagccaagactctccttggcacagacacactattgggctccctatctcatcaccccataggtccaccttctctgtgtccccatcctagtaaacgaagccatcagtgcctccaacatgttctcttcagtctagccagagttattatttaaaaatacaagtgcaatctgtttgctctcttgcttaaaactaatcagtgacttccagtttcccaaaggatggaatcccaaatcattactaaggctcacaaagcctttctttctctagcttattcctctggtttcatctttcatctttattcttcacccatcttgcactctgtgcttaatatctcctgtttgcttccaggtcctctctccatccttccacaccctgctttgtgccccaggtgactgacctatagggattataccaataagctatcttgtcttttggtttccagtaggtttttgcccaagggcagtacccacagagaacagaaaaaacgaggaaagtaaggtcaggctatatattcccccaacttcctcccttcccacatactgacattaacccacaatcagctccttacggtggcctctccaaatagcctgtctttctccaggttttggtaatcactccctcctttccattcaaggcctggagtgatgctagtcccaggttgtagcactatctcttatatgttccctgctcactgcttgtatttttataactagtgtcatgtttctcaaattacacaatttcagtatgccataagtttcctaccagaacccagattgatactgtctgctttcaaatcctaaaaggtgtcaactatggcttaaatgttccttatttcgggaggccttttctagccgtcttgacttggatgtaaccgcctgctaaacctcctacagcaccctgtccatctcctgacagaacatccttcacacttagcagcaatcattgaatgagtattagtgtcgccttctctaaacaacaaacaaactgtgtcagaaaaatataaagcaaaatttgtaggaaatataaaaataacttgataacatattcattatgggacaccttaatatctttttctcagagagagaaagagagagaggatgatggaaaaaactttatattaaacatatagctacagaatatttacaaaaaaatgagcatataatatgactcaaaaaatgggaatcatataagccacattgtctgaacctaatgcaataaagctagaaactaataattaaaagatagcaaataaatgagtagaaagagaaccacttataatattctaaaacattttcaggtcaaagaactaagagttaaaattacacgtcactaaaaatgaaccctaataatggtactacataaaaaaactatatatttgttcaaagcaatattcacaagaaaatgcatccatctattaataaaaagtaaaacaaaggaggcaaatctggcaattcaagaaataaaaaagaaatgagcaaaataagccaaaacagagaaggggaaagtttaatgataaaagcaggaattaatttaaatgcaaagcaataattagaatgtacaaataaaggcaatatttctaggaaaactgataataaaaaagaaaacacaaatgtgcaatgttaagaacgcgaaaggtgctataaccccacaaaaaaaagcaatttttcaaatcactggttaatgccttgtatacatagatcttgatgaaattggtggtgtttagaaatatataactttttaatttaaacttctctactttctaaaaatttatactattttacaattccaaagtcaatatcaaattgtaaagaaaaaaatcctgaattctgcctcttcttccttcttcacatacgcagcaaataaatgctacacatataccaactactatgtctcgactctcctatgttttcatcattaaagaaaaaaacattgcattcctactatatgccaatcattgcactacacactgggaaatcaaaaatgactatgagaaattccctgctttcaaggagttcatagtctagtgcgagaaacagacagatgtgcacactgattataatactatgtggtacctgtgataatgcataataatgatagatgtctttactgagtttctgctaagtgtcaaacaccttccattcagctgagatcttgtcctttcctccaactcttacccgggcattttcacataatagctcgttatcatctcaatttcaaaacactttttgtactcagatgcttctccaatttcccagtttctgtaaatggcaccacaacatttccttattcaggcttgaaccttttgagtttatagtcaggtaccaatgcttgtcagtttttcctttgaagtgctattgaatgtatattttgtttagaattcccatgactaccaccttattcaagtccttagattgttcccaccaagttgaaaggggtgtcctccttcctcttcattattgaagtctctttcttgctcttctcccctatcctaccagctcccaaccaccctctgaccctctgcaccactgccacacctttctttttaagatatcttttcatcatatccctccactattcacaatcttacaacagtttctattttctcatgaatataagccctttgaagtagctttcagtgacttccattatctcctcctcatttcaccaatttatcctcattcccagacactattacccagactctgttttctctgttagctggaccattcttcacactttctcaaagacatgtcatcctcactcctacctctctatatttcctgaaatagcctttagtgcgtgctctctctctctctatctaaacattatgtgttttttaggccttagctcctccaaagagattgtactaaattcctatagcctttcataatttccctctcttttgacctcacgtacagcatacacaaaaaaaatgcacccaatgctatgctactgtacaaagcagtgtactgctttgcactgttaactttaactctatgtgcattattttaatctttctaactatcttacaactccattaaaaccaagactagatactgtggaattatttaatacccccacccacctcatcatttatcacattacttgatacttggtgagtacttgctgggtacatttgaatgtaatgtcttttatttcttaatgtctttcattttctcaagtgttgttaaaggcaaaaagcaatgttggatggttttatcagttatgcagagttcatgcaggaaaagagatttcagtgggaccttgcttaagacaatagagaatttagtttaggatttaacaggtctagaaattaatgtagaaagctgtcccacaaagatctattatccagaatatgtaaggaacctaaacaattgaacaagcaaaaaacaaataactccatttaaaaatgggcaaaagacctgaacagacatttctcaaaagaatacacgcaagcggccaaccaacatatgaaaaaatgctccacatcactaatcaacagagaactgcaaatcaaaaccacgatgagatatcatctcacaccagtcagaatggctattattaaaaagtcaaaaaacaacagatgctttcaaggctgtggaaagaagggaaaacttacacactgttgatgggaaggtaaattagttcagccactgtgaaaagtagtttggagatctcgcaaagaacttaaaacacaactactattcaacccagcaatcccattatggggtagatatccaaaagaaatcaaatagttctacccccaaaagacacatatactcccatgtttattgcagcactatctacaatagcaaagaaatggaatcaacttaggtgcccagcgatggtgaattggattttaaaaatgtggtacatgtacaccatgtcatactatgtagtcataaaaaagaacaaaaccatgtcctttgcagcagagtgaatgcagctggaggccattatcctaagcaaattaatgcagggacagaaaaacaaataccctgtgttctcacttagaagtgggagctaaatattgggtaaacatggtcataaacatggcaacaatagaaactgggactactagaggaagaaggaagggagtggagcaagggctgagaaactaactttcaggcgctatggtcgctgtattagtcccttttcatgctgctgataaaaacatgccaagactgggtaatttataaagaaaaagaggtttagtagactaacagttccaagtggctgggaaggcttcacaatcatggcagaaggcaaaagacacatcttaaatggtggcaggcaagagagaaatgagagccaagggaaagtggaagcctcttataaaaccatcaaatctcataagacttattcactaccaggagaacagtatgggggaagctgcccctatgattcaattatctcttactgggtctctcccacaacacatgggaattataggagctacaattcaagatatttgggtggggacacagccaaaccatatcactcactatctgggtgatgggatcatttgtgccccaactgtcagcatcatgcaatatacccagataacaaacctgcacttttttaccccctgaatctaaaataaaagttgaagggaaaaaaagaaagctgttccacattgattgcagtgagtataatgggcaaaaattactgcccccaacccgcagcccccaaatcctaacagaaatctgttacatacacacagacaagcatggattgagcattagctcagtagacaggtcggttgaatcccactttccagctgcatgatcataaacttattgtttaacctctgtaagcctgtttattcttctgtaaaatatagatcttgtgagaattaaatgagattatgcattcacttagcatagtgcctggcatacagtacagctcaatacatgttagttattattatcatcttttgtcctttcttccacaactttgtataagaagtgttggaggaactgaagaaaatgtgatgtgttcaacatggtacagaaaaggtacaccatgggcagatggtcaaggtgagtcatagactaacccagttcacaggagtagctactcatgttagaggagtcctaaagaaataaaagccttccttccctcccactctccctccatcaatggtccacagagttgagagaacacaactgtggtaggcatctaccattttgttcacttagaatggcaactcattcctggtaaaatataaattctaaccatgtgttatgaatggagactgctatcttacttatgaatgggctgatgaatccacccagaggtggatgcctgacccagctgaaccaatcatgttatgtatacaccactctagtcacaaattgcccccctggatgggaacctggctcagactgaagcaatcaaagacttacctcaatatttttaaatctgggatcagaaaggatcctcagtacttctttggtggctacactgtgagatgaatcccaaccaaaaaatgtttacaatcatgcctcctgctttgtggtggaatctggtctgaggaatgaaactaagacacgaatgaaaggaaaagtcttaaaggattaagttccctggcaccctggatgcctgaagtccagatacacttctgctcttgccaaggttattggagtcagtgcatttctcttcttgcctaagcacatttgagttacatttctgtcacttgtaacatcaatgagacgttaaagagttaattcactaggaaatttttaggaacaccttgctggcttacaagaagcatcaattctacgaattactttctcaggaatttctctaaatatcctgaagagggcactgtttccattcataacttctgtccaaacccacccccattcttttgtttttttttaatttttctttttatttcttttttttctttttttttttatgaaagggagggactgagtaaattgcaggatgtgattctaattggttggaacatcttttgaaatcgtgtttctgtagagaaagaaaaactaccatatttggatagccctggccaactttcaaggctcctaaatctgagttttcagtgaactggacagaaaaaaaaaatgaagaagctactagcaatgattctgtggcttcaactagaccgtgagctgggggttcattgaaaagggagccatgggaggaaaggaattgtccatacaatgtttgggggtagagacaaggttcaatgcgactcatttgggttccctcgggaggaacaggattattggggtaaccagtgaatgcctccttctgaaatgttctctttggacagggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgtggacacacagtgctcccctgacgccaccagtctgtacccaaacctgcagctggtgggcccactcctcctgcaggaactatgactgtgaggcttcgttcactgtctgtacatttctttctgcaaggaaaattctgagatgggtgaaaaaagatgctgttttaccttcttaactgtggaatattttttaaaaggaaaatgtgttcaggctgagggaagattcctaaccatgtatttcctgagaatatgaggtctcattctttactgcctcacagtcagaatttgttagtcttccattatggaataattttacatgtagtgcaactgtcacaaataattcctatgaaatatggaatcattatttgttttatatgtgaatgtaacatatggcatttaccaatgaaagaaagaataaatgctttataaaagaatggtctatgtgaggttccttacctagtgtttcctgctaaaatattgactacagtagtcagataatatccgtgtgatctaagtacctgtttatctcaatgtgtggagagtctctgggaaatgtatcctttggctggatttactccaaaactatctgagggtccttgccaaccagaagaatattatattttttcttgtattatttgccagtttcctcttctcctccctccattttttttttgtaattgttttgctacatggtagaatttatattaaactttatttgcccattgcagactagataaaatgaatttcactttcaggaaaattgtcttataagaaatccccaatttgaatgttatacaaaaataattgaaaataagttttcctgtcccactaatgagataatcagtaccttcagatatcaattgcatcatattttcatcccagacttctaggaaaataataaacttgattcagtcaggcttttaagtgacaatatttcagaaattaccattacaatgtaaaagctgaccttaacatttcaacatttgtaccttcctaagcaacagcacctttaaaaacatttaaaaactaaaaacacttatttctctaaattgcccctagagtctttacaagcgaatcagcttctgcagcaatttgttggcagattatgaaaagtcagccacagcagtgtacagaccaaaagctcctgctaccactcagagcctccagcagggactataataacttccgtatttagataaaataaaatttgacatgaaaaaccgactagttccatcatcctttgagtcaagcagaggtttcactctgacagagtaggctgaaaaaactttgaccttgtatttataaatactcacaacgtatcttaaatttcaagtttcttgatctgttaccaaagcaagtttccttgtcaatgactgattgtcgggaaatttttattttgcattgatgatcttatttgttgtgttgttacataatcagaaaacaggatgttacatcagattttctataacctttctggagcatttaacagcatgtcttcacacactcatttccatgctgaaaacattttcaccaggaaactattcatgacggggaaaaaaatattgttcaatccaatctaattaactgaaggaacaatattgacttaagtccccaaatctcttccttcttagagagaactcttggattctgaagatgaacttttatatcttcttcagatcaagaatataaacaaaccctaaaacaaatgaatagaactgaggatttcattaatttgatctttagaacataaaaaactaagttctttccacttctccttcccaattttcctgactccttcccaacttatgagtatatagattttttgctttcttttcctagaatcacttactgtcactgaaaatatatcattaaaccttattctcgaagaaacaatacagacattcaaaattgaaccagttgactttaagggtgtgatggtgtagtaagaaaatactatcgaaggtgacaatctccaatacattagagcatgctaagccaaatatgttttcccccagtaggacctttaggaatgtctcaggtgactccaagcttccggcacttgctgtccatgaccagagcttctactaacaagaagttccataaaatacttggatccatcctaatcagatacaccagttgccaagtccacttaccacagagattaggaaaggagacatttttctcagttgtgctattcatgtcccagaaatggcatttaagacaaataattctttgagtatttcttccaccctgtctcatctgttttggtgtgaactagtctcttttttcattgcttttaacacagctggttattttttcttttaatagtgtgtctgcttcaaggtttatctagaagttgtttcttaatatcaaaaaagttaacattttttatttttactgaattatgatcagagaatgcacctgtatgagctgtactttttaaaaactttcattaagatttacttgaaggccaagtacataatcataataattttattggaaagctatgaatttatatatatgtgtgtatctatgtattcaacttttttgatcatatcattaaatcttcctatgtccttgtttccattttctaaaatctgtcacattctgaaaaagactatcgaaatctttcacttattttgtcaagttcttgcaaattgcttttgctttatctagctgcaatgttttcggtgtatatggtttatgacttacgtctcttcagagagtctttttagcattaataatgtccaagaaattatccatctcttctagattttcatcattatataaagtccttcatcctgtgtggtgcagcctgatattttttcctcaatatccattctactgtcttccccttttttactctgccccagaataaaatctgtgttgcccagacctccttacagctaagtattggcatgaactaaattctggtcaatgaaatctaagtgtaaatatgaggtgcaccttctaggaatttatctaagactcagtatgcatgttcttccatctctcccagctacctggcctcccatcccctttcctgctggatttgttgatcctcggagactcaagtacatccttcacttagtctatgcactatataccttcttcaatgaggtccctgtgtcagggacatggttctcagtttccagctactttccatgagctccctcaagcaagcaaatatttttagaaggtatttttagaagacaacattttaaaagaccatagtgtcctttctactctactgtgtctgcaatatgttgcagtagaacatttcacaaagctagatcttctcagagctccagatgggaaccaggcaaaaagctctctttgcagcggacagtcaacctatcttgtggtttccattgtccgcattcctagctcagggttttagataggatttgtgattttttaaaactgccctgaaacctcaggctctgctcttgacatataaattatcaaaaagaaaaattaccaagtacctgtctcttgcaactcaaaaaaatgccttatttcaggatattttttcctcctaagactttttaagtccattttgaatacaaaatcaataatttgaccctttgatctcactggatcctttcacaatctccctttactggagcaataagattcatcctcaaaatttgtggcaagagatttacaggggaaaaaatgaattttaaagaaggaaattatcatatttgaaactgttagtccactccatttagactcagagattctaataacacaacagtgtgaacaccagatttggttatcagaaagaattcctgagtattcaaactcttctactgtgagctctatgcccttaggcaagtttcataatgtatttaagcctcacttttctcatcaaaaaaatatggaaaaaataataaccactttctaaagtttttatgacatttaaaatgagatggtgtatatgtaaagtaaacagcacacacaccagatcttctagaacagtgtttactagagaaaattcataaagacaagagaaagagcaggtgtgtggtttccccagaggcagcactcaccctacattctgaaacagcacacagcaacctagcatggccaatgtgagaccctaagaaagagaacccagtcttgagccatggaactttaaggctgcactggggaagcaccaggccttactgtagcatgggggctgggctccaaattatgtgattatagcaaaatcaaggaaatctgcaacctccagtcctgatctgccacctcagctctcttacaaaatttattgcctcaagtgctaggctggggctctattagaaccagttccttctctggaaggccaccctgcagggaatccattacccttacctctcagtatgtgaaattcactagcacagagcctggcatgtagttggtataaatgtggaatgaatgtgtgcagccatggaggacaatgtcttcagtccctttgtaatgcagaaagtgtgcttgttctcagatcaaataattaacttattgaacaagtgtttataggtatctactaggtaccaggctgtcttctagacacttgaactatcttcttttaaaaaatgcacgaagatatcagattttatagaaaatacattctagtaagcattaaccataagtaaattactatatggtttatgacttcagagagtctctttagcgttaatatattttgcattacaatatatgagaagataagtcggacgggcgcggtagttcacgcctgtcatcccagcactttgggaggccaaggcgggtggatcacaaggtcaggagatcgagaccatcatggctaacacggtgaaaccctgtctctactaaaaatatatatatatatatataaaattagccgggcgcggtggtgggcgcctatagtcccagctactcgggaggctaaggcaggagaatggtgtgaacccgggaggcggaggttgcagtgagccaagatcgtgccaccacactccagcttgggtgacagagagagactccgtctcaaaaaaaaaaaaaagaagataagtctatggagacaagaatcagagcaagttaggggatagggaattctggagggggccacagaagggtggttcccttgtaattttaggtaaagtgtcagagtagcctcactggaaggataacatttgagcaaaattgaagaagatgagagagtgaatcttgcatatacttggagcaagttttccaagtagaggagagtccggtcctaaattaggaaatgcctacatgttctagaactaggtggaatgagaagccataggaaggctttgagaaaggagtgataaaatctgacttccatgtaaaagtcttactctggctgccgtgctgagaatagactgcagatcatcaagatgaaagtggggaaaattgttgtattaacattaaaaccaaagatatctggtgttactctgagctcagaggcttcttccaccagaaaagctcattcaagagcagctgttgttactgctcctgctgatggaagaggggctaaagacatatttgatagcctttctgtagatctcttgactgcagatgacctgtgagtttaggggaaaatgacaggaaggagtcttaatttcagacacaagaaggtctgttgtgaaggcatcttccagaaggcaatatttgtgctttcttctgttgtgtaagactccctactcaaatttaggcagtttaaggaccttagaaaattgtgctgtggtgataaaggtaatggaagtcagagcagagggataataaaaatccatatgcctctttgaaagcctgtgtaataaagatatctgctgcctcaccgatctgaacagggttgaataagcaacaaatggacaagaatgctcagtccctgagctaccaggagacataggcctttagtgggactgcctatataatttacgggacccagtacaaaatgaaaatgcataacttcctaagaatttgaagactgcaacagcagagcattaaagcatgagttctatgagactgtacaggtttcatacccaggaagctggccctgatcactactagtttggaatgccatcattattcagatatcgatgttacaggcaggagcatgggaaagaccttaaattaatttgataacaattcaacctagtggcatacagaatgagggcaaactaactgagtagtttggtgtagaaaagaagcacctcacctcctcaaattacctctgagatggtgagatgccctgtccttttgacatctacatatttaatataaactcttcacctaggaccacagcagtggcagagatccagatgctcggagagatctatttgcacaagaaaaaatatgcataaagaggttaatagtcaaaccaaataaggggctgagttgtaccgtgagcttttttacaacttcaaagtgggaaacatttattgcccttactcatggtgctgtctaaagaataactttttactctcctgaacatttcagggttctactcttattagagaaattgtactattatcattttatttttaaaatatttttagaaatgggggtctcactgtgttggtcaaactcttgagctccagccatcctcctgcctcagcctccaggggagctgggactccaggtacgcaccaccccacccggccactgagtcactattaaaaatcatttagcatagccaggcctggtgtggtggctcacgcctgtaatcccagcactttgggaggctgaggtgggtggatcacctgaggtcaggagttcaagaccagcctgaccaatatggtgaaaccccgtctctacttaaaaaaaaaaaaattagcctggcatggtggcacccgcctgaaatcccagctactcaggaggctagggcaggagaatcacttgaacccaggaggcggaggttgcagtgagccaagatcacaccactgcactctagcctgggtgacagagtgagactccatctcagaaaaaaaaaaaaaaatcatttagcatacccagtctggggctttctactgagagcctttgttgacttctcttctaaggcaaagagcagggatataaagaagtaacacttcgaaagatggatgttctagttacatttctaggctctgaaatcaaatacttaatccacatattgactgattaatttatccaacaaatattaaacttgaccgacccttatagtgtctggagcctagtaaataactattgaataagctgtgaacagacagccaagtcctgcggactcagagaataatgagacaaatcagatattgaatcctggcttcaccacttttgagcagtgtgacctggagcaatttgtttatcctctctgatcatcaatttcctcatctataaaatgggaacaataatattaacacctattttcacaatcatgtggattaatgtatgcagagcctctggttcatcactaagcactcagtaaatattagctatcatcatcatcattactaatttctattgatttaactagacacagaaagggcagcatgtgtcttacaagccagcgcttccctcttctaaccactaattcaaaaaggattgtaagtaatgtttagaggtcactccctagcccaaaataggatgccactgtgttgtgctttgttttctttcttcctccagtgctgaagcacttgtgtgttttggttaatctaagatttaaaagattcctacatgtagtcatgcaaagtacttgtatatacctctaaggacctagcaggtctagtgatcctggagtctcatatccgaaagaggaaccagtactaaaagacaaacttcccaaaatctaaagaagggaagtgcaatcaatggtatgagttagaagcctcaatcctgggagagacagcctgtgcaagccaggagaaatcatgggttctccagtccccagcactggagcagccatgatcagtgcctccacttcaatgcttgtgaggctgttactctctggtgagcaaaatgacagtttaaaattttggctcttttataatttctcttatttctcattttgttacttagattcaatgtcgtttccattcattctaataagaactttggctttccaggaagaaccactagagactcagtgaattagacacagggctatgtgaccctttcttcaggggcacacctgacgttgaactgtacctacagaatgggtaggtaccttcctcttgtggtatgtccaatatcccaaagagatatcaaaatgccttgtctctgaggcatcatgataaatgaaaaggaagatttcaggcccattaagttaagattaaaacctctttccacttgcagaaaacctctatccaagcactaggcacaattgtgtacttttatgttcctaatgacacagtaggggagactaacagaggagttgagtgcaaattgcaaggggtatgagaggggctgggtgtgagcagtttctttttcctatccagacagggccctggagtgcaggagtgtatgtgggaagttggacaggcttcgtgatttgctatcccaggttaagtagcacatgagactgcatcttagaaatggggaaaggaaagatttgtcaaaacattgcccatatctgtcctctaattatagctcactgatcaaaactacaagcctagtaatgtaacgaaggaaagttctttgacatcagttatttaaaatatgtacaatgtgattttctgaaatacctttgtatttaaaatgtaatttaaattacccttaaaattaaaataaatcaataactgttttagtccattttgtgctgctataatagaatacctgagaatgtgtaatttatgaagaacagagacttatttcttacagttttggaagatgggaaatccaaggtccaggggcctgcatctggggagggccttcttgctgcaccatactatggccaaaggcagagggcaaaagagtgcatgcaagagggagaaacggataaagtgccaaactcattcttttatcaggaacccactcccaagatatctaacccactcccatgataatgtcattaatctattcatgaggacagagccctcatgaccttttaaaggtcccacctctcaacactgttgcattggggattaaatttccaacatatgaactttggggggcacattcaaaccataacaataataaaacattaatattcctggggaaaatgagcaattcacaaaaagtagtacaaatggccactttataaagaggtatataaattctttagtcatcaaagaaacatttaaaaaagtgattcattttttccagctatcaaaatagtgaaggttactgacacacacacacacacacacacacacacacacacacacacatatcatggaatttttttctgttactccaagaacctcctatggcaccatgagtcttgagccatttactatgtaaccagaaataaagactgcaaatactcaactgtaagccaagccacttctagtctaagtgcaagattgcatatttgaagagaaatatttccatttctgagaaaccagataaaattatgccaggactgaggaagaaaaaaagagaaaaaaaaaaagagcagtcaggaaaaaaaaagcagtcaaaaaaaaaaaaaagaacaaagttaagtagactttgcaaaatgacttcaattgaattacaccatcattatcaaataaatcttcaagtccagataaaaaaggaataagtgtaccctcagcactacccttttctagaagagagaaccaaaaatatcttgattcactaccgttttcagtgaagaatattgcaaatgtgaaagatggtaataacaggagcaatcaaacaatagacagtcctgagaggttactgctcttttactgtaaagctaaactttgaaatgtgaatgctaagtctttgttaacacaattataataataattacattttagatagaatttcatatttattcttgcattgttgaagttaattctattttttgatattcagattcagctttagcttcccccagatattgactttaacatctcaccattcggcatttggtcacaatgtgtgttcagtggaccatgttttaaggaaataattagacgtatgaagagggtttatgtaagcatagatttatcacaatgttgtttgtaaaaactgaaaatattgaaacaactgtctaaaatactgacatgttgtgatgtctaagttctagtggaaattattctcccttagaataagtgttgtagcgataacagacttaggagtgtggtgagtcccctttgcacaaaaagaccacctcacacccaacatgactcttaagaatgaggacagtagtgaggacacactgcagaacactgagaggcagatgacgtcttataacctgttcattaacttgccacttgggggtgctattcaccagtgaaatcataatttatgcatgaattctgagtacaactgtgaatcctcacttcaacagtgatgccctctgctaggccagagacactaacaatgaactcctctctggactttctaattctgatcttaatgtttggtaagtacattttattaaaattttttgtattatttcaaaataataaatacttctccaaaagatacaacaactctggccaaacccataaaatcagtacttttttccccctacaggaggaaccagcagcaattcagtcaagcagacgggccaaataaccgtctcggagggagcatctgtgactatgaactgcacatacacatccacggggtaccctacccttttctggtatgtggaataccccagcaaacctctgcagcttcttcagagagagacaatggaaaacagcaaaaacttcggaggcggaaatattaaagacaaaaactcccccattgtgaaatattcagtccaggtatcagactcagccgtgtactactgtcttctgggagacactgtgttaaaagcacagtgggagctatacaaaaacctcaaaggctcagaggaagtatgtagtgaggctggaaaacccaggttgtagagccctgttctctctttcacagacagtcctgttaagacattattagaagataaggaaaatcaaaatcagatataactgcctctaattccagggggcacaggggtttctttgacagaaaatggggtcagggaagagggtctcagatgatatccctgctctcaattaggtcagttctctcttgtccttcaggctttcttgcatgatgtgtaggaattagaatatgatgacttggatgtcagtcctggctctactacttattagctatgcaaatttggccaagttaattgatgtctcagagctttagtttttttcacttgtgaagtagaaataaaaataatcacacaaatttagcatggagataaagtggaaaaaaggtaggttaggaaggggcagattagtactcaaagcatttctggaacttgcaagtcccaccgtagcagttctgctctctcacagcaatctctctgcctagtgctgaccatcctaacagggcttggcatgcccactgctttgtcacaccacaccacaccccacgccacgcccagccccaggccattatgatcaacatatcatcttttctctcacaggctcctactgacactacacacaaaaattaactcaaagtggatcatagacctaaatgtaaaaactaaaattgtaaaacccttagaagaaaacatagcagtaaattttcatgatcttgggttaagcactgatttcttagatgtgacaccaaaagcacaagcaataaaatagaacattgataagttggacttcaacaaaattaaacttgtttatgcttcaaaggacaccatcaagaaaatgaaatgataacccacagaatgggagaaaacatttgcaaatcatatgtactatgtacccgatgataagggacttgtatttagaatatataaggaacttttacaactcaataataaaaagaaatataactcaagcagtgagcaaaatatttaaatagacatttcttcaacaaagatacaagaatgtctaatatgcatatgaaaagttactcatgattagtcatgagacaaatgcaaatcaaaatcacaagatatcacttcgcaaaagtaaaaggctatgactttttaaaaaggacaataatgagtcttatcaaggatgtgagaaattagaaccctcatacattgttggtggggatgtaaaatgatgctatcactttggcaaacagtttggcagcacctcaaaatgtgaaacatagaattagcatatgacccagcaattccagcccgatgtatctacccacaatgcatatgtccccacaaaaacctgtgcatgaatgttcataacagcattgtttatggtagtcaaaagtgtaagtaatccaaatggacaaaccagatgtggtatctctatacaatggaatattattcagccataaaaaggaataaagtactgacacctactacaacatgaagaatcttgaaaacattatgctaagtggaaaaatccagacacaaaatggccatattgtgtatttcatttatatgaaataccaagaataggcaaatccaaagtcagaaagcagtgtggctgccagaagctgaaagaagtggggagtggggagggactacttaatagatgtgtggggtttcttttggggaaaatattctgaactagatagtggtgatggttgcgcaacattgtgaatacactaaaagctaccatattatatactctaaagtgattaaaagtatgaattttatgttgtgtgacttttacctcaataaaaaagaagacaaccaaaaaatctaaatgtgattcttaatgggacaagaagctctaaaaaaattaaattcttactattccattgcaaacaattccaataagtatgtgaaatatggagccatctgataaaacctatagcagtacgggaaggtatactaactcagcttttaactaaaaattatacaaatgttgactgacacaaaggcaaaggagaatagcaaagatggcatgagcctttaaggaaatcgttaaaaagtggaaaccttttaatgaatgcagttaaggcttaaagaaaatgtgaagtggaacataaaaagcgttttagaacagtttggagaaatgaagagggtggggtggggaggaaggttaatttacatatcgaggaaaacagaataattttggtagagaataaagaagaggtagggcacttcgacccctggtttcatcctctattcttcatcaaatacaataattttgggccgggcgcagtggctcatccctgtaatcctagcactttgagaggctgaggcaggcatatcacccgaggtcaggagttcgagaccagcctggccaacatggcaaaaaccccatctctactaaaaatacacaaattagctgggggtggcagtgggcacctgtaatcccagctactctggaggctgaggcaggagaattgcttgaacctgggaggcggaggttgcagtgagccaagatcatgccattgtactccagcctgggcaacaagagcaaaactccatctcaaaaaaaaaaaaaaaagaaaagaataattttcaaactggaaatgaagaaatgaaaaattatgacagataaaaagatactaagagagaacttagatgctttgaaaatgatcaattcttctgggtcttttaaactaatccccaacatacaaaaagaatttgcaggcatggttggcaaggcattgggagaattttttgaaaacctatcaggaatgaaggaaatccccaactcaggaacacagaaatagtggatcgatacccagcaaaattctagagcagattattaacagataatgtgtgggctcttagaaaataatgcagtgatcagtaccaagccagaatgagctcactaaagacatttttaaaacaagtcctaaattcaaaggacttccgtggacttcaaacgtgtcaaatatttgcaagatatttaataatttgtttttcactatatcaatgggaaaaatatatatatattatcatttgttgagtgttgtgtttatcacaggccctgttgtactacatatgtaataagaactaacatttatttatcaagggcttaatgtgcatgaagtgttgttctaaatgctttgcatacattaattcacttaatcttcactacaacctcatgaagtaggtgcaatccttattatagataaggaaactatctttaatacagaagaattaactaacttgcccaagaacacagagttagtaagggaagacctggcatacaaatacagtttgacaagcccaaagcctgcattcttaaattctatactttgttacctcccaatgttatctgtaatccccaccacaaaactataattttggtattgttacacccattttatgaataaggagactgaggattggagtattgaatagaaaaatccagtagaatctagtaagtagtaagactaaggctcaaacctaagttcatttggatctagactgtatcctctattcactttgtcattctgcgtaatgctagacttggtgaattctcagctgaaagaacggccatgtataaatatacaatttagaaaaatgtccctattgttacacctcatgattttatccttcactttgacctgttcacattgatcttatgtaaattcacacaaggtatgcccattaaatgtacaaatagcaaattttgagatcggtatatgatgatcatgtcctaatgatctccagctaatatgtttatttacagcataaattaaagattgaaaatcatctgaacaaactggaaagatagactgaaactgtcaaaatagaatttaatggagataactatatatttatacagtagttttataaaaatgagttgtaatgtctggaagaagggatcctgaatttttagtatttgttgtgtaacgcgctcatagtaattaaggaaaagattttctgaaaggatattagaaattctcataaaatcaatttgtgcaaaatacagctaggactcacagaaagaagaaaatcaccaattggctatgctttccgaatctacttttctctggatgtatgatctgttctcctcctgggaaaccagattccactgtaagcctgtcatattctactccacaataacttcagtttgaacatacccagctctgtttgctaagagatgagtctggtttgaatagcacagggctttaaagctctagttacactgtctaactgcggtttctgtacctctagttcaaattaatgagcgtagtatcttcccagatccaataagctattgccagaaaaaggaggttatttggtacaagcatgacctctatgtcatctctttagaaaggaatcccaaaagtggaaaaggactacatgctcaaaataattcaccaatgtgataaaacaactgaaactatcatagataacaataaaacaagtggaaaccagatgagtacagtaatactctgacagggcaacaatatttgaatcacatttgaagagacgtgaacaaactgtagcaagtctaaaaataagaaagataaaactaataaagtagtctgaaataataccatgtgcagaaagaaacaaggatgtcacataaagaaaccagagatatttataaggacacctttacaaaaaagaacagatctggccttgagttttcaaaagatataatgtgaaatgcagctactctacttgatctatcatagctggctgaagtctaacaatcaacaagcttctgttctcccacactaccctcacctttcttctaggactcctagtaggaggatgctaagtttggttctctatctgtattgtgggtgagaggggctgtttgtttgttttagagacagggtcttgctctgttgcccaggctagagtggagtaacatgatcatatctcactgtatcctcaaactcctgggctcaagtatttgacctgcataataaatgtctacgcctcatgccactaggtggcaatgtgggtgttatactgaaaagatcacagatggttcactttgcaagtaaaactgtaaatgttcttaagtgtgcatttctgctgcttctgatgggctgaaaatcccctttgatttctaaagtaaatgtagagacgttttaaaaataaaggactcctttgtccaagatatattccgaaatcctccaacagagacctgtgtgagcttctgctgcagtaataatggtgaagatccggcaatttttgttggctattttgtggcttcagctaagctgtaagttggggagtttcaggacatgagatatttttcaaaattctggggaggggagagaagggactccaagtggctaatctggaggccctcctgaaaatgtgtaaagaaatgtgtataaatattgcaataattgtaatattctgtatctgatgatgtctttgagaacaggtgtaagtgccgccaaaaatgaagtggagcagagtcctcagaacctgactgcccaggaaggagaatttatcacaatcaactgcagttactcggtaggaataagtgccttacactggctgcaacagcatccaggaggaggcattgtttccttgtttatgctgagctcagggaagaagaagcatggaagattaattgccacaataaacatacaggaaaagcacagctccctgcacatcacagcctcccatcccagagactctgccgtctacatctgtgctgtcagacacagtgctccccaggcacctggagcccgtacctaaactctaaagttgaggcatcatttcttactcctgtctttcagacttgtctgtctctatccttggtcagatgatgtaaaatgtttaagtttttaaaatataatattctccccttctagaccatctctcttctctacaacatcatcaccaattatgttaaccagacagtatgtgatttttatcttgaaagtaaaatatacagggtataaaaatcccgattctgctacttattaactggatgatcttgacaaagttacttaacttctctgtgcttcagttttccctcagctataaaaaggaaacagtgttagccatggtacgtaaccccaattgtggggattacatgaggtaatatacacaaagggcttgacacatttcctggcacgtagtgttacataaggggtatcaattattagtattagttttagatgtaccatgagtttgctaatattcactatggattaataccacagatcattggagaagtatgtggaatataaataataagcaccttataataattttagtttttagattctttcctaatgatgtccagcacttggcctttttaatagtgttaagaaaaacagggagtagctgtagaaaacgtaatagaaggatgactctatggtttggtttgtggtgtggaaatgaaagactggtaagagatgtttctgaggaagctcagctgcttctttggaaaaaaggacaggttctaagttttcatgtggagatctctaatggaaacttgcatttgtggaaattcatgaagcaaaatatcaaacccagtgtatctaaatcaacggttctgtatatcccccaaggattctttacattactattcccaatcccagtggaattcttatatcaaaacaagttttatgattataattgttcttattactcaacaacatcaatcacatatattaaattacagctacattcttttttaaaatcaaaggctttttaaatcaaaatactacctgcacatatctaaaaagccaatagtattataaaggtctgttccttccttagcccatcaagaaaacagaaataccatgctctacccccaccttccaattcaaatccattctagcaatttctaattaatatgtatatactcttgatttatcattattaagcattatctattgacttccttctatggcagcatgcaaatactctcactttctcaacatagttatatatatatcataagctggggttaaatagacagtcagtgcatatatgattatgaccacatgaatattgccactgtccaaccaaaatgacaactatgagtatatatcctttctggtacaacgtattttcttagttaataattacatttttttcatttattctatgtcaatgtgctattttttctaagttcttcaacacagtcttaaaaatatttattaataatttctctcaaatgcttcaagcaccttaatttcttttttttcccctcaagattccctttcctttgacctccattgtttctctgtgtgaactgattgctctataagcataaatgtgattctagacattttagtaccactctcccaagttggcattcttgcattttggatctcatatcttcatttcccaaagacaaatactagagagaaaaaagggagaggaagaagaaggagaaagagaaaggagaaagaaacactcttgggctcacttttgaacaatgagagaaacaaatgaataaatggttcctgccctcccccatgccctgcaggaggaaaagtctgcggcatattccaaaagactcttcagaaggtcatgccaggatcaggcaccagtcatgcacatggtggccagctccattatgcaccattgcattggctctctccactacccaaatttgctctcttgatccctcactcctgctccatgagatcagttcccaaaaatgccctgcatgcaaacctttatctcagtctcagcttttaagggaatgtaagctaagacatgccttttctccctgtgaatagagaggacacggagccagaagacacaaccctgcccgtctgctctcagtagtgcctcatccccttcaaaagccctagatactggcctatgcagctgtcccagggactactgaccacagcttctctatcggtgatacatgttcctggcttcctgtttttaagaagtactggacacacctgtgtcactttcctgaaagaaagagtgctgagattggagggtccaagtggaattacaggctgagacagagagaagatacaggagatgctggccctaacagagagggaaaacaaaacaaaacaaaacaagaaactattcttatgaaataaaataaaaagtctccccatctgagagtccactggtctttcctgaaagccaagtcatttttccatcgaataaatgcacgagtaaaaatcaagaaaacataaacatggataaaagtttcctcatagagttgacaagattattcacagagacagacttcttggtctcaattttctcagcatcctcagagtttactgtgtggacactatgatcacagaaagaatctcaggtgccaaagctagcaattcaagttgtttctggtggaagtcagtgccctcctgtagtcaaatgaatgaactagtagaaaccactgctttggtcagtttcccctctcctgtatctggccttcagcacctcagtagatgcttagagagcacttaccaggcaccagctcccagttgatatgggaaccattagaactctctccagagaaactcagtctggcccagtgtttctgacttcaagcctcatttccatgaatcaggtagctggtgaaattgatagactgcaaactccatgagggcaggaaccatgccttggtcattacagtgtccccagtacttagcatagtgcctggagccaggagcgttctcaatgatctacgctgctttgtcatctgctctgataatgagagtttcttgatgtcaagggctgtgttttgttcatttttgtatccacaaagggattagcactgtatttaacaatagtagaaactgaagaaaaaaaaattgtgtggaattacatttcctctttttcatcagaagtgacttagtcttgctgactttctttctatgcccttgtgtgttgcctctttgtttgcttacttgatttttttgcctcactgagaatgtaaggtctgtgaggacatcggcttgtgtttcttcatccctgatatttcttttgcaaccagcccaattctgatatctagaaggaggtcaagaagtggtttttggaagaataagtgaatgtaatagttatttcggacttgtgttaaaaggcctctttgcacgatttagtagaaaaagcactggagtcttagtcccggttttgcagctaacagggtaatgtaattctgaagtcacatccccactttcggcttcagtttataacctggaaaattaggataataatacacactctacctttatcaaaaaaaatcacgatctaatctgaattagatcatgaaaatgaataccttttaaaaagtgaaaaattttaaacaaacaaaaattaatattattaaggaattttatatatatatatggaattaaatggacaagaaatattatcctaatatactccaagacaatagttttcactcccatacttatccgcactgctatacaattcagtcagtgccaaatcactacccacacacctggttgtccttattactgtggctttgcaaccttcccatcactcagcttatctaaatattctcctgtatctaaaaccagtttttagaatctccaaagagcttgttttccaacatcccccagaaacatgcatttctcaccttactgagccaaactattccccagtgttcatcctctctccaagaaaagtttttattcatttggtcattggtcaacatttttctcagctgtctatttctcaaaatgtatgttctattctactattttcttaaactaatgctattttcaccactggccaaactttgtatttgaatttgaatcttatttgaattttacattctactttggccatatctttgtaatcagaaataccagtgatagtactcaccattcggtgtacaaagtatataaaatagacatgctccatatctattaagtgatgaaaattttctaggtgattttattataaaattaaacatttttagaagaaaatgcttctttagtagattgagaagaaaatattccaggcaatgaccaacccagtgatgtcatcttactgtatatataaatattcatacttgattactactataatcaactacaatgtaaacatttcttttgaagtgctaatcggtatgaaatattctcttcaacctcagattaaatattcaccctcagtccccctcatttcccctgaaatacaatgacattaaattgcctgatctttgcattttctgatttattttatttttatttattttcctttgaggtgggctgggtacttgcaatggctaatagtgcagagctgcaattctaggcactatcagcaggtgttttaactaacacattatgtggattatttaaaaacttaatttaaggtatatgataatatagtactgctttgtatttttacaaactcatatttttttttttttttttttttgagacggagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatctgcccgcctcggcctcccaaagtgctgggattacaggcgtgagccaccgcgcccggcctacaagctcatattttaaagctccattcttagctcagagctgagccattaaagttcaataatgtaagacagcaagaatgctaaagcttgatgctaaacctattcagtaatatggaacagcatttgagatcaggaaggaggtggtcccacaactgggaattaaaatcaaaatggatttgagcagataaagctgcatgtccaaaggaagttggtgggaaaacttgaatctgccaggaattttctgctagatttactgcagatcctgccagattcaagccaagcatagaaaaataagcagaaaacctccttcatcactgcctgtgaaagaatgttgagtccaagagacgagtagagaaagacctctatagattaggacccattaatatacactgacttggcaaaccgagacctagaggcaagtacagaccacaggaccaccagatgatttactaccttggatcctactggtggcaaaagctgctcccagggtccacttccctgtacagaaaactacctcatagaaactgaaaattatatggcaatatacatcaaagagtccttgcactctgaccctgtaatttcacttctagaaatttcttctttcttaaaaaaacaatcaagtatgtacaaagattcattttttaaatgttggtgagagctttatttaaatgagtggagaaggaaaagaaaccccaatgtctcacaaaggagttgatttaaaaactgggggcacattggatataaccaataaaaatcattttatctaaacttctgcttccagccacgccgaaataacagggaccagatttaccattccacttgaaacaacagcaactgagaaggctgcagacaaatgacataaatcaacaatttccaaaacacggtatactaagcaataaatgaccatgatcctgagagatgggaaacaaatgaggcgagccctaacattgcaatagcttattgccttgagagagtttctaggccacagcacaaagaggggaaactgaggcagaacctggtaggctccctgaattgaggcaacagatctgagacagagaagactaaggcagctgaagttcataagacagaatacacgagaggagagaggggcacagagaggacctagagatctgccgagggtgccctcaagtattcagcagaatgctcatctgcgcacgcatgtggaatctacccgagggtgggtggcggcagcagggaataaccattcaaaaagattaaaggaaagaggacctcttcaagtatgtctagaatttagaaaagagtttattgcttagccatatatttcttaattctttaattaatatttcatacatttcattttctctggctctagtcacttatcactgtggtccattttcaaacaaagaatcatttcacatattgaggaaacaatatatgaatagcctgtctggcttagataaagagtaaaggcaagagaccaggtgcggtggctcacgtctgtaattctggtcctttaggaggcagaggtgggcagattacctgaggtcagaagtttgagaccagcttgaccaacatgatgaaaccctgtctctactaaaactacaaagaagtagttgggtgtggtggcacatgcctgtaattgcagctattccagaggctgaggcaggagaatcacttgatcatgggaggcggaagttgcagtgagtggagatcacgtcactgcactccagcctgagcaacagagcaagacttcatctcaaaaaaaaaagtaaagacaagaataagtatcacccatatggcatgaccaaagtttttggtaaacctagggttttttttctgttgtcagtaataaaattgcccttaaaaactagtttttatttctcattcctgaactcatttacatataatgtcgaagtatgataaattcaaactatgctgacacctgtacgaatgtggcttagtatgatataaagtctttatactttcaccaacttcaaacctcagtttctactgttataaagttcatttcactctctcttgtgaccatttaaatactttcacatatttcatcgcatttttcatcttctagggctgaggactcctaattcttaagaatatttctgttatccctataattactgtcgtgtctctccaggcattcttttttagtgaacagttgtcattaatcacttccagaaaggattcaaacaccatctctacatttatccttccaagtgctgtgactattgccttgcgaactacattttccaggctcccttgcagctaaggtgcagatctgtattcagccaagtatttgattgggagatgagccatatgaggaacaggttaggcaggggcatcccttttcttggtttaggggcagtggaggccatgtggtctgggttaggcagcaacagcatcttcttgattgggccaggagcagtaacttcctgtttgggcccatttggctgcatattctgttgctggcagcactggaggcagctggcatagggataggactgcagccttcttatgaggctgatggatgggtggttctgggcatcactcctggaagtcgagcctagaatctttttctccagtctgcccaatgattctatgagccttctgcctccccaaatcctgatctgcttacactaggtaaagcgatttcctttctttcttgtcccttagcacacagatatctcacagtgtttagtctgagacccaccacagctttcattccagcatcctttaagctgagtatcagacctggttcactttttcactgcagtacacttggctcattccaatgaggatgacttcatgtttatagtgatttctggttcctttgcttggaaatcctaaaagatagaaaagagtctccagttgctgcagacgcaggcatgagatataccgaaaactctccaaaattgtctcttggaatgtttcttcattacttcactaggtttctttctaaccttcagagctagtaaggaccttggattaaaagggccattgaatttctagtttagttaagaaatattttcctcatttcatgggaggggggaagcagtgcagactaaactcagagcccacatcatgttgttcttaccagttcaaatcaaatcacggtttccagtcacttggctaatatttatccttctttaaatcttgatgaaatgtctcttcctcaatgaacacttctctgcccctcaacctaaatttgttcccctcgtgttactgttttaaagaaccctgtaatttctatgtatttctgtgtgattatttgtataatatctgtccttcctattaacctctaagttccactaaatgctctgtgttcagaatagtgcctggcacaaaggagtatgacaaatagtgatgagtgaatgaatctgagccatcagacatgtatcttactttgtgctgggctgtccctcaagtgtagatgttcctagtgacaatcccattaattcaaacactgactggagaggattgaaaacatatgaagcagtgcttttggaactgaggctgtagtccaatatgactggagataaaaaatgaagactttaaaaacagaattcacataaaagcaggtatcaacatggaaaactgcagaggatgcctgtatacacagtgggcacagcagcagcattagaccaatcacctccaaacttgaggttccaggctgaggtgacagatcagagtgaaccaggcaccgtagaacaatgggaacacttagattcctgacactggaatttgctgattcttctactaacgtgtagcaagaaatttagccttacccaaagtcaggtctggtctttgtcccagttcctgggagataacctctgaaggctcggaatttcctgaattgttggcatgtctttataattgatggtggggtccttggaccacacttaatagtttctgctatcaagatgactcattgtgaggctggccacaatcaatggtctcaggatgggggctggccatgccagaaagaccaaccatataacatagggtggagggtttgtgtcacaacctagagagtgagttcaaccacacaggctatcagtcatctgatataatgaagccccaataaaaactctggacaccaaagctcagctgagttttccagactggcaatattccatgggtattgtcacgccttgatgctgggagggtaactcatccctgaggacagtggaagtttcacgtttggaaccctaccagactctgccctatgcatctcatcccttggctgcttttaatgtatcctttctctgtaataaacgaatcacaagtatactaggtttcaatgagttctatgagtctttctagtgaattatggaacctgatttaggaaatacccaaccttgccattggtgccagtagtgagagtggtcttgcatgaacttatctcccctttgtagttgagtcctagcgacttacagttgggggcagaagtcttatgtagatttagtctggaggtctatgaccttaaccttgcagtttggctaactctgggtagctacattttgtattgagcaactctatatgaataaaagaagttttgttcatataatgccttaacagtgaatcaagtatatcaagaaagttttttaaaagttaaaagtaggcaagtctactggtaataaagtaggcaagtcacaaggtaattaaatgcctacgtttcaatgattacacatgttgcttagaacatacacatatatgagatcatcacgttaaaatatttctaacacacaggctggcaacacctaacaataataataattagtaattgtctagttcttactactaactggtttctgttctgagtgttctacatatattaactaatttaattctcataagaactctggttattagccaggtttgtagaagctgaggcacaaggaggttaaatacttcgccctatggcacactcccaaaatttgaatccaaaccatccaactccatagctcatgctcttaaccaatgccccatacagcttctcagaaggcaatcacttgaaatttctctctgatcttatagaaaggtgttagtagactggttatcttaacgtccaatcccaatcatctttgtagcaaagtaatatttttatatgaacatgtcagaggcatttgaaccagagcaactccatcttgaataggggctgggtaaaatgaggctgaggcctactgggctgcattcccaggaggctaatgcattcttggtcacaggatgagataggaggttgacacaagatacaggtaataaagaccttgctgataaaacaggttgcagtaaagaagcctgctaaaatccaccaaaaccaagatggcgacaagagtgacctctggtcatccttattgctacactcccaccagtgccacgacagtttacaaataccatggcaatgtcaggaagttaccctatctaaaaaggggaggcatgaataatctaccccttgtttagcatataatcaagaaataaccataaaaatgggcaatcagcagccctcaaggatgctctgtctatggagtagccatacttttattcctctagtttcttaataaactttctttcactttactatatggactcaccctgaattctttcttgcgtgagatccaagaaccctctcttagggtctggattgggacccctttccagcaacaaagagatgtgtattttatttctgaaaatacttttttgctttgttatcattctcatgttaggccagcagctcaggaagtcctggtctccttcctatattggaaaagggagttcacaatgaacacaaaagaagaaaggataaatttgaaaattcctctggagacaatagaatggaaaaaaggggttttgagtttgggttacgacttttgagtttaaaaataaatctatgcctcaaaaagttctcttagaatatatctgaatacaaaaaccaattatgcaaccctagatttaatgcaaatttcttagtttctgggaatttctggggtgatggagacaaaagcaagaaagtaagacatcagtgaagatctctgcccatctccacataccctcccagcagtggggtgggaggaggcaatttttagcccccaaataggatgttaggaatctgaaactagaggagattgacaactaattcctctcagaaagactgagtgacagtatcctgcaaatttccaccagggcagagacagctgtgcagtagtgccaataggcccagagagcccaagacagccccattctgccagactggaattagagtagttgaatttttgcatgcacacaaaaagcatagaaattaacagagagagacttagtggacctggatgggtgtcaatattataataaaaaggatgcagagcatatagattaacagccagagacctacagggactcagacatcaggacattagaaacaataatgtcccagactggaccctaagcactgcaccccaacagatgccagtatgggccaggtgtccccaaccaatgccagaccaccagttaaggcctctacattccaccccaaggatggcgaggaggaaatctgaactgatggaagacatcctgaattgacttagaaagtcatgattttactgagaaaaccctgtatttacttaaagcaagctttctgacaccacgcaaagtggttaccagagttagaaattaggctgttatagaaaataaagctatcctggattgaacatctgagtaaattacaaaacatttacccgctacatctctattcaccagatagcgaactcaagcattcctctgcccctacataaatgacaaatgacattcacgtgtattacatatcccctcaggcctaactagggctgtgtgctgtttccaagaccaaaatgtcacaactgtaaaccactcacctggatacttgctataagaaatagcttggattagtatggaacttggtgtaaccctcaaatatgggagtttgtcactagaggtaccagaggaccacattctctgttaggggacctcgatgacagtatattacaatgaaggcagtgactggcaaacagcagcttcaaataggcatgcaaacaaacattgagaaacagtaagcacataagataactcatttagacacttttatatgcagcatgtataggatttaaaataacattcccaagttaaactgaaaccattactatgtaaatgccacagccaagtcaaatgaaatagtaaataccagccttgcaaattggtctccctcaagggcactcaaaagagttagactgcgtgctgctgccttaggaaatgtcctcctctctatcaatcatttctgctttgacatcaaacccattgaccagcatatgttttggaatttctgaacaactgactttcaaggattcacattcattctgcactttcttagaaacctcacaggagccactgttgccaataaaataaaataaaaaaacacaaacattataaatctaaccccaaaatgggattgcttcaaaagagaatggacaccccactccctacattgcttgtacacatctgtgttgattctcttggtgaactggcccatgcaagcaggagctcatcaatcagcagttgtcaccaagtgcaagtcagaattgctcaacagaaaaattgagtctttttttattccctattgtcacctactaaaatgtaagttgcttgttgatctcatcacactgagctatgtttcagggaagtgttgaaaaggcccagcctgcgcatattcttgaaattttgaaataatggctcagtgaacagatgtatactttctcccaatggctctttgtggaaatgaattttttatgagcccaaagtatctttgattcatccctgattaaaagtcaggttaaaactaaataccatatactttttgaaagacattttaggaagttattgacacaaggacttttgagactgaaaatcatgggttaacaataaacctttgtttggtgaaacaaaagaacagtacaggacagaggtgaaaagcacaggctccagggccagagtccctgggctcagattcttcacatttcagctctgtaaccttgaacaaactactccagttaatcataacttcagtcttttttaaaaaatgggatattaaataatgggtattaaataatagggttgccatagaggaaaatataaggtaatatttatatgcacataaaacagtgcctggcacagagccagtgttcaattagtactagctattttttggatacatgtagataaaagaagcatttaatgaatagttacatgcccattaacataaaatgtaagccacttccatattctgtagcttatggtgacaaagttttctgctcacgtattaactaaaaggagcgaagagcttccctataatattgaaaattttatcctaatggttccaaaggactgttttctaggaatgtttgctacagaaacctcactggttagatgtttgttggagcacactgtgattattcattgtcactgcaaactgtgtttaccacgggaggctgttctgactcaccactttgtgactcaccgattagtaaacagctaaatgtcgcattgctgatttaggtgtaatttactgcgtcaatataaaaggactctgcagattctactaaaatcaagaacatagctaaaggcattcttcatcgtaaaaacgaattttagaaaacaagatgactctaacagagttactttaaaatacaatgcaatatgtctattttaaatgacaacaatatctcctgtctgacagcattcaacttactttcagatttattcggtgttttctcaacttcacgagaaattgaaaatccataaaggagggaaatatgtcttgtttcattttcaatagttatatcaagaatacttttcaaaagtatttcatatttaccatgttttcagcaagtaactcttaacaatactctgagagtatgatcgtgatgataggtaaaaatcaggatcactcccttttcatctttacctgtgtagagcaatgtaatgtgcccttttcccaaaccctctgactccatgagggatgagacacagagggtgtggctgagggctcctaggaccgggactccttggctgatgtcctgtggcctgcagtccagggcttgcaggtgatcaaacaggaaaggagaaatgagggaggcacagtgctacgagcaggcctgtgttttcactgggaatggtggttagcagatgctcagatgtgtctcttctccctcacactcacctttggcttggctcttaactcctgcccacccctccctaaactctctgtggaggtccggaactaagcgagtcacagacacccagcaagcagtctccagagaggcctctgtgcatgaagacttccccagaaggatgcccactcttcctacctggcctgggaactcaaaatggacacaaaaactgaagactgtgagagagggtcagcttacaggccagaaactgacaataagattgatgttcaaatagctgaattattgattcttatcctgagatccactcctcattttcagtcttgcgataaaccttagtgaggggtgttttgtcttgtgttctatctattggtggatggattccaacttttctgaatatggggacgtaatttttaaagccaaaaattttgcagatagtaatggatttttaacatccattgattaacaaagtactatgaaaacagtaacacttttaaataaatttgctttcagtttttttaactaaacataatacatgcatgtatatatttaaacttatcacactgcctggcacagtgaaagcactcaaaaaatattagctataattactcctattgctgttgtttactcaatcataggtaatgcctggtatacatgtggattcttagagtccttatagaacacagcagcacataaactatactaggctctaaatcttctctcccaagaacttcatctgatgcatatttcaccagcaacagcagcatttagcactgtcttgctgtagaaaaattcttgataaattaattgaattaaatttatgtcacataaaatgtcatgaagagatggaagtgtcttggtcctgtatcttagcattttcaaacctctccattgtttttttttaatgtatagatttcacctgtgtaaaaattaaaaataagaaaactgatcctaatgctcttcatgaaaggcaagaaaagccttcttggaaagcaatagttatgggagagttctgccagaatttgttctcagaatgacatgagaacaattttattctaggaaatagaggtgctgaggactcagcttctgacctaccctagatcataaacatcactgcactaacagccaattaagaataatctaagctcttgtccttttataacagacctggttatgtcctaaaaaataagagcatttataaataaagaagaaagtttaacagttcaatagatcaacgtgactttccagctcctctctgaacaggtgacatctatttccccatcccttgaatctcagttggccttgtaacttatgtggatcaatagaatgtggccgaagtgacagctgtgcaagttctgagccctcacctcaagagcctttgcactctgtcacctgctctctcagacctcggcttttttccacgtgaataaaccgaggctaaccttctggaagaaaagagaccatatgaaacagaaccacatcagcctgaggccctggacatgtgcgaaaactgaagatcagcaaagctgacctgaaactgagtcacagttgacctcagatgcatgagaatctaaccaaggctgaaaacatttggttgaatcccacctcaatttctgacccagagatagcaactaatgtacaatatcatgattgttatgcagtcattagaaagaatatattagataaatgtgtattggcctggaaaaggtatcatctaagtatgcttaatgattatccatcttaaaaaaaaaaatacagaaatagggttgtagaacaagggtcctggtcatactgagcttacacttctgttgatgaaataaaacacatatgagatgatgaggaaataattcaaccaacaagaaaatactttacaaccaagagacttattaaataaaatgggtgcaccttttataataccaataagtataatagtaccctaacacagtagacacatttctgttgtctgtagttatctttcagaaagccgtcttgggagaacctttaaatgacctcagagagcgaaggtttatgtaaataaagaattaagtcagtgtgggtagaggttcagcaccagggtgcaggaagttatgtgaagattgtggtatggggctcatgtctagaaacagagagtggccccatgtcagcctatgagggaggagccaggccccacctcaagggtctccttcaggaagatctctgtgggaaaggagcaggggttccaggttttcagcaaagcctgtgcttgggcaatccatcaacacggttagtccagggcccacatataacctctgacccttctcacatttattttctctgtctggtacttcctctaaggagcatcctgccactcaccagcccctaccaaacacacacacacacacacacacacacacacacactcatactctatttgctcataatctcataatcatccatcaggttttaactgagatagtacttcttctgggaactttctctggtgagagatcctcttatgtggctcttgacctaccaaaccagaagcagttgtgcaattagtgatcattattctcttatttattatagtatctccagcacttagcacaatatctgcagacagtgggcacgcactgaaaaaaaaatactttttgaatcaatgaattaaatagctagttttcattcaccctaagaaaataccaaacattggtcttaagaatgtcacaggcctgaaggtataaaggaggaagcaaggaaacaaaatcaacagacagagccttggcaaaatctgctgttcaccagtcctcccagcaaatccatttcccattctggggaagcaatgccaaacagctccaggaactctgtacatggtctgtcaagtatccaagacagaagggagacttttcaagagtggaagcccagcctgcttgctccagtctggactgtgctggtctgtattttcctagtcagggatggccccaacctgggactgtgtctcctctcaggctctgaggccttgggaatggaggaatgtcgtatctgccagtggtttaggtctgtattgtgaagaattaactttcccaaacagagatctggccttcaccctcagctgctgggtggtgattcctaggctcctggattgtcctgccagataggagaatctttgtttgcctgagggctttggccaccagtcagtctaataacgtgatatatgatggggctttggaacatgccatgtgaattctgacctctggaggaaccagagatcattagctagaacctccaggaggggctggaggttaaaggtcagccacgtgggcagcgtgtgataaagctccaggaaaaactctggacaccaaaggctcagttgagctcctatcttctgcaacactccatgagttctgtcacacaacatggctgggaggaggtaacacacccaggtctccctgggagaggacaaccagaagcttcatgtttagaaccctcccagatttcacccaatgcttctctccctttggttggttctgatttgtacccttttgctctaataaactatgatcatgatcactttcctgagttttgtgtgttgtttcatggaactatcaagcctgagggagcatgggaactcccagatttgtagccagctagccaggagtaaaggcagcctggggacccggaacttgtggctgatgtttgcattgagggcagtcctgtggaggactgtgcccttaacctgtgaagcatggccacctcccggcagttgctgtgagaactcattgcagggccactcagggaagtgtgggaaattgaaccaatgatgcctgacaccacggcttcctgactatcctctaggaagtctatcaggagatgcccctgttcacttccctgtaggttccagcgaggctcagagggtcatcagttctaccaacaatatctgcgcagaagagagtagctgtgattttattttagtctgaaagaacactgtttgttgttgattaacacctaaatattacaaacagtctctcagtgtgagaagatttatcttattctcctgtgtaattagaatgattattcaacaaatggatgttatctagcgaacttccagaaagaagccaaatttatcaacctcaccaactcacacatacagccagggatctatattcttgtgctctcagagaaggcatggagcttggactgacagcaaaagaccaacaaaacacccagaagccagtcaaaaatggcccaggctgcaggatccttgaaagacctgaaaacacacgaggaaaaggctgggaaatagtaatggtgagtggacctctgcggtctggagaggaaactactggttattttaggaaaaacattcccataatggggctcagggaaaaaagaaagtaatggtatccaggccttattctcagaagcattctcctccctgaatccagtatctgaggtaactgagcagcagataaaaatagcattttctcgaaacaaagcaaaacattaaaaaaaaaatagcctactgtctaagcttgtctcccagtggaactcaggaaccaagccagcttctccagctgtgcaccttggctgtgtgtctcagatggaacatttctgacttcattccctcctcctcccacgtcactcggtaaggagggtgggccaggacaagcagctcagacagctgttcctacagctggccttaccacaatcccccaggcctcacatacatgcacctctgggccctgcctgcctgcactaaaccatccggcccagtgcaacagaccattctttcaagctgtctctctcctactcacaaccatcccaggagtcctcttaaaactattttttcggagaacacattgtgctttgccacactgttccatttatctcttggtggccattccatttgcctcagcaactctctatcccattttttagtactacccctgaacgagaaggcaatcttgttcatcttgccaactctaaatccttatcgcaatcgtgttgctttagattgcattcatgtgtgaataggtgtggataggtgtttggcactgtgttagatgccaaagatacagtgctaaggaaaaaacatacctgacaacagattttattatattccaacgggaaagataggataaacagatacataaacaatgtatatgcagattaggatgagtatcatgaaagcaataaataagaggctgacgggttcaatttaagtggggtggccagaaaatgcttttccttcttctgagagaagtgagcgaggggcacagagaagtccgaattgttacactaatgaatatttctgagcttgaaaacacaaaacaaggggagatgaggttccactcaacagaggtatatacacatcaattacatgacccagaaaacctgattcagacacaccttgctgacactactccatagggaaggtcattttcacttgtccacatctaccacacctccattttcactctccctgagataaaaggatgtgcatttacactgtgtctgcctagcgaaattgtaccccccgctgaataaagcacagttagttgagattcacgaacaccaagcctctctttataatgactttagagagctgtgctaactgaccagcactctggatacttatgagcagatgtctggtagcaatggaacctctcatgaccacccaggctctaaatgactgttcagctcagcagctcattatcaccttcctggagttagagctccaacataagaataaatatctccatctagtattatcactttttaaatcaaaatctatattcagcttgagagtataaatatcaaaatttcagggcattttttctaacttttcttgggagattttagtaaaattccagggcagattgctgaaagtacaatctgggaacagaaactaatatagtgtcacatcatatgaagttaacctctttttcttatgcaattctatcaaacttcaaggaaattctttggaaatctgagccccactacatttaaaacaaaataggtctatcatgaaatgcctaataaaggttgatcttacagtgtgatcgaggtgctatgcagatctgagacaggtggattattccagaatgagaaagaaacacaggatgaataagtcgcactaatggcaatagcaacttctgggaaacaccaatttctggcagctgttgctttcgtcaacactttctcagcaaaattgccacagccatttctgagagcttagaagcactgctaggaatctctaataggagtctgtttaatgggaattcctattgactacagccgcttttgcatataggagataatgttgagctaagggaatctttcaatgattcattcaaaacatgtttatccaccatgtgataaacattatagtcagtgccatagtataaacttgaataatgcataatccctgcccccagggaactcacatccttctcgacatgcctagcacaaacacacagaattataataaaagttgtcaagaagaagatatgggtggcgcattatgcaagcagagaaaaagggactgccttattcatttagaagctactggccctctctagagattgttggtcttccagtacatctaaatattcttcaatcgtaaaatgccatgaagctagaagtacaaaatgctgtattatcagttaagccccctatttttttctttttttttttttttttgagacagagtctcattctgtcacccaggctggagtgcagtggcacgatctcacctcactgcaacctccacctcccaggttcaagcagttctcctgtcttagcctcccgagtagctaggtttacaggtgcatgccaccatacccagctaatttttgtatgattagtagagactgggtttcaccatgttggccaggctggtcttgaggtcttgaactcctgacctcaggtgatccgcccaccttggcctcccaaagtgctgggattatgggattacaggtgtgagccaccatgcccagccagttaagcctcttaaagaatgtcttgaattataacaaacacatgatgcctatcttcccccatatctttatactgacaaaattaggttcaaaatcaaggcatggtcaccagaaatcaggtcagagggatcaagaaaacatggacagtgaagtgatttcacttccatacaggtgataaatatttcctaaaatacaggtagatgtgtggcacaaaacctccagactctgagcatcaaagtccctcctaataccagaaaggaaggacccagcatttgtcatctcagtctcagacaaatacatactcagagggcctcaggaacatatgtaaactaaaaaaaaaaacatgagaaattgagcaggagcctgagtttgggcttccttgggtgggtactgtattaatttcccataacaaaatactatggaatagtacacagatgtttctttcctcacatttttggaggcaggaagtccatgattgaggtgtcagcaggcttggattctcctgaggcttctctccttggcttgtgaatggtcatcttctctctctctctcttcacttggtcttttctctgtgcacaggcatcctttgtatttctccctcttcttataaggacataaatcctactggattaggaccttacccttatgacctcatttaacctcagttaccactttaaaagccatatcttcaaatacagtcacattgggggctagggcttcagcatatgaattttaggaggacagaattcaatccataatagatggggacagggcaattctcttcctaggtaagccttcccttagggccatttacggggagataaacaaaccccaatttctactgagcaaaagctcagagaccctgaagtaactgcagttagtaaatgagaaagacagaatattttcaatatcttcaagtctaatacctagaagtgatagaggtttattcacattttctcccagtcattttcttattctgtgtttatacagcatttctgttaatgacaccattattttcagaaatcaaaatgaaatcttaatgttatcattgactctccccccttccttgccttcacttcaatcataattttccatgtctatgtaagtattcttttggctatttacatattcatcagaaacctatttcagctcttattaattttcatgaagatcactaatggaagccacctattgttcatgcttctagttcaggtgctcctaatatgggaactgtatagtttcagttgatctataacctttcaccccccaggttttgtggttgtttttatatacactttcacacatataagtggtaatgtgttcattgctattatcagttgttcaaagtgggtccctcacccacgaacaggttaaaagccagagctctcctctctcctactacacttgctccttgtaaaaaaaatttaatctttgtgattaacacaattgtttatattcttccccctactcaaatactcccagttacaaacattttaacttgtagtttaaaatcgttcctggtcagcaatcccttctgtagactcttccaaaaattaccatggttcttataatcaatctcacacccaaaagaggagattttagaaaggcatagacaccagaaggcagggatatatctgtctaccacagtccaccgtctggccaccaatgactcacattaccctcacttgcaaaaatacattcacatacatccccaaaggtctcaagaatcttatctcacagagcttcagctcaaagtcaaacttttatgctttaaatcatggctaagttcaaacacagctcctgggcataatatatgaagtacagctcctggggtataacttctctccttctgtcaacctgtaaaactaaagaggcaagtgatctgcccccagtacacccgtcatacaattttgaaacaggcataactggtaggcatgggataacagctatagacatattggttcaaagggaggaggggaaaaagataacaaagagtcgttggtccatagcagttctaaaatctagctgggcaaatgttgggagttcaatgattaggttttagagcctaagattaatctcggctattggggaaaccagcccccagtatttcaacgtaggttcttttctattttccctaagtgtcggccagtctgagaaataaagagaaagagaacaaaaaaaagaaattttacagctgggtctccggggttgacatcacatgtcggcaggttccatgatgccccctgagcctcaaaaccagcacgtttttattatggatttcaaaaggaggggggggtgtatgaatagggtgtgtgtcacagagatcacatatgatcacatgcttcaagggcaataaaatagcacaaggcaaatgggcaggacaaggtcacaaggccagggcaaaattagaattacagatgaggttccctgtcccactgtgcacgtattgtcattgataaacatcttaacaggaaacggggttcaagagcagagaacaggtctgactagaatttcatcaggctggaatttcccaatcctaacaagcctaggggcgctgcaggagaccagggcttatttcataccttatctacaactgcataagacagacactcccagagcagccattttagaggcctccccctgggagtgcattcttttcccagggctgttccttgctgagaaaaagaattcagtgatatttctcttatttgcttttgcaagaagagaaatatgactctgttccacctggccccgcaggcagtcagactttatggttatcttccttgtttcctgaaaatcactgttatcctgttccttttctaggtgcccagatttcatatttttcaaacacacatgctctacaaacaagctgggcagataacacaatcattacaggatcctgaggcgacatacatcctcagtttatgaagatgatgggattaagagattaaagtaaagacaggcataggaaattgtaagagtattgattggggaagtgaaaaatgtccttgaaattgtcaccatttatgttcttctgccatggcttcagccggtccctccgtctggggtccctgacttcccacaacacttggctctaccctcttgcctcttagcaccaccctctatcatccttcttctttaatgtttgcagttgagtagttttatcagcctgcttcctgccagtagaaatgttggggtctgacagcctcctttcatttcattttgtagtctttctatccctttcagtccaagccagtagtgtttctgctgaaataattttctcaagatctttgtgcatctaccatagatttcaatgatgttctgaccatcagaaaaaaacacacccacagatcttttccagacagcatatatttttggctcctgctcggatggctgaggggctacagtttgattgagtggatctaaaaggcacattcttaatctccttaaggagtcctttgtgccattgaatattctcaccttttagtctttgaggtttttttaacttttattttgagttcaggagtacatgtgtaggtttgttataaaggtaaacttgtgtcatggggtttgttgttcagattttttcatcacccaggtattaagcctgggtgtacacattagttatttttcacgatcctctccctcctctcaccctccaccctcaagtaggctccagtgtctgttgttcccctctatgtccatgtgttctgtgttatcatttcgctcccacatataagtgagaaaatgctgtatttggttttctctttctgtgttaatttgctaaggataatgacctccagcttcatcaatgtccctgcaaagggcatgatctcattattttttatggctgtatagtatttcatggtttatatctatcacattttctttatccaatctgccattcctggccatttaggttgattccatgtctttgctattgtgaatagtgctgcaatgaacatatgcatacatgtgtctttatgatagaacgattattattcctttgggtatatacccagtaatgggattgctaagtcaaatggtagttctgtttttaggtctttgaggaacagccatgctgttgctcctaatggttgaactaacttacactcccaccaacagtgtaagtgttcctttttctccacaacctcaccagcacattattttttgactttttaacaatagccattctgactggtgtgagatggtagctcattgtggtttttatttgcatttctctaataatcaggaatgttgagctttttttcatatgcttggtggctgtatgtgtgtcttcttttgaaaagtgtctgttcgtgtcctttgcccactttttaatggatttttttcttgtaaatttgtttaagttccttatagatgctgcatattagacctttgtcagatgcatagtttgcaaatattttctcccattctgtaagttgtctttttagtctgctgatagtttcttttgctgtgcagaagttctttagtttaattagatcccatttgtcaaattttgcttttgttgcaattgcttttgatgtctttgccataaaatctttgcctattcctatgtacagagtggtattgcctaggttgtcttccagggttttttttataattttgggtctttaatccagcttgagttgattttttttgtacatgatgtaaggaaggagtccagtttcaatcatctgtatatggctagccagttatcccagcaccatttattgaatagagagtcttccccattgcttgtttttgccagctttgttgaagatcaggtagttgtagccttatttctgggctctctattctgtttcattggtctatgtgtctgtttctgtaccagtaccacgctgtttttgttagtgtagccctgcagtatactttgaagtcaggtagcatgatgcctccagctttgttctttttgcttaggattgccttggctatttgggctctttttttttccatatcagttttaaaatagtttttctctaattctgtgaagagtgtcattggtagtttgataggaatagcattgaatctataaattgctttgggccgtatggccattttaacaatattgattcttcctgtccctgagcacgggatatttttccatttgtctgtgtcatctctcgtttctttgagcagtgttttgcagttctgcttggagagatctttcacctccctggttagttgcattcctaggtattttattctttttgtggccattgtgaatgggattgggttcctgatttggctctcagcttgactgttattgctgtatagaaatggcagtgatttttttatgttgattttgtatcctgagattttgctgaagttgtttatcagttgaaggagctttggggccaagtctatgggtttttctagatatagaatcatgtcgtctgcaaagaaggataatttgactttctctcttcctatttggatgcaatttaatactttctcttgcttgattgctctagcaatctctttggcctgaaagccccctgaggacaaatacatcagtcaactgtttctttgtttgttgtttgttgtttcttttaaattattctcattacttagcacagatcatgtacaccatgagtgtttaataatatcaatagaatatttgggagcaggaggttattttgcttagttttatgctttcactgttgttatagaacagctgggctagaagacattattaaacataaatacaactggtaaaatatcccagcagaagaaatgctttaaaaatatctccaatcactgcaggagtgcagagaggcaacaactcctccagcttttgcacatcgaataattggtttagttcactccttccacatcacttggagcagcggggagggtggggaaagcttaatgaccaggaaagcctttcataaagtcatcatcaatgttctttataacctaatgtcacttcaatagtccatggttttcaaataaatgtcctacctgcccacagactgaaattttagccaaataaatccataaatttaaacatattgacaatcaaaatggtaaaaagaacttttatttttaacttgtaaaaatggttttagaggtcatcaggaagaataaatgagatacatagccaaaaaaaatttaaatacttgccacatcagatattagaatgtgttctaaagctacgctaattaaaataatgaggtaccaatacaggaataggtaggtagagcaatagaagcattaagtataaacttataagagactcaagttataagttacaagaatttgacatatgttaaagttagcatctcaagccagaacagcatgtcaataaattgttgaaagacacctggataaccatcaggaaaacaattaaattagatccctacctcaacaactaaattccaaaggaaaaagactcataacatttttaattaaaaagcactggaagaatatatagatgaccttttacataactttgaaaaaggagaattatgttataaaaatcacaacaaaggcagaaattataaaagataaaattgacagatttgactaaatacatctttaaacatgtgaatattaaaacgctgtaaaaaattaaaagacaaataaagtagaaattatctaaaatatatatcaaagcaaaaactgcatttctatatgccactggtatataaaaatacttccaaatcagtaaatacaaattgcacacaaatagaaaatgatagaagaagctaacaggcatttcacaaaagaagattataaatgactgataaacacattaaaatgtctattactacataattaaagtaattctgaaaccaataaagtacttttttctgcataattctagggatttatgcttaggaaagaatttgtaataaagatccacacacaaggatatctatcagaatgtagtatataacaccacaaatcataaatgagtcaggtatggtggctcatgcctgtaatcctagaactttgggaggccgaggtgggaggaccacttgcagacaggagcgcaagacctgcctgggcaacataatgagatgctgtctcaaaaattttttaaaaagaaacaatttaggggggcggttccaagatggccaaataggaacagctccagtctgcagctcccagcatgagcgatgcagaagacaggtgatttctgcatttccaactgaggtatcgggttcatctcactggggcttgtaggacactgggtgcaggacagtgggtgcagcctatcgagcatgagccaaagaagggcgaggcattgcctcacccaggaagtgcaaggggtcagggaattcccgttcctagccaagggaagatgtgacagatggcacctggaaaattgggtcactcccaccctaatactgcacttctccaatggtctcagcaaatggcaccccaggagattacatcccgcacctggctcagagggtcccacgcccacggagccttgctcattgctagcacagcagtctgagatcaaactgcaaggctgcagtgaggctgggggaggggtgcctgccattgctgaggcttgagtaggtaaacaaagcagccaggaagcttgatctgggtggagcccaccccagctcaaggaggcctgcctgcctctgtagactccaccttggggggcagggcatagcaaaacaaaaggcagcagaaacctctgcagacttaaatgtccctgtctgacagctttgaagaggatagtggttctcccagcaaggagtttcagatccgagaatggacagactgcctcctcaagtgggtccctgacccccgagtagcctaactgggaggcatccaccagtaggggcagactgacacctcacatggccgggtacccctctgagatgaagcttccagaggaacaagcagcagcaacatttgctgttcagcaatattcactgttctgcagcctccgctgcagatacccaggaaaacagagtatggaatggacctccagcaaagtccaacagacctgcagctgaggatcctcacgttagaaggaaaactaacaaacagaaaggacgtccacaccaaaaccccatctgtacatcaccatcatcaaagaccaaaggtagataaaaccacaaagatggggaaaaaacagagtagaaaagctgaaaattctaaaaatcggagggcctctccccctccaaaggaatgcagctccttgccagcaacagagcaaagctggatggagaatgactttgacgagttgagagaagaaggtttcagatgatcaaacttctctgagctaaaggaggaagtgtgaacccattgtaaagaagctaaaaaccttgaaaaaagattagatgaatggctaactagaataaccagtgtagagaagtccttaaatgacctgatggaactgaaaaccatagcacgagaactacgtgacaaatgcactagcttcagtagccaatttgatcaagtggaagaaagggtatcagtgattgaagatcatgaagtgaagcaagaagagaagtttagagaaaaaagagtaaaaagaaatgaacaaagcctccaagaaatatgggactatgtgaaaagacaaaatctacgtctgattggtgtacgtgaaagtgacagggagaatggaaccaagttggaaaacactctgcaggatactatccaggagaacttccccaacctagcaaggcaggccaacattcaaattcaggaaatacagagaatgccacagagatactcctcaagaagagcaactccaagacacataattgtcagattcaccaaattgaaatgaaggaaaaaatattaagggcagccagagagaaacgtcaggttacccacaaagggaagcccatcagactaacagcagatctctcagcagcaactctacaagccagaagagagtgggggccaatattcaacattcttaaagaaaggaattttcaacccagaatttcatatccagacaaaccaagcttcacaagtgaaggagaaataaaatcctttacagacaagcaaatgctgagagattttgtcaccactagtcctgccctacaagagctcctgaaggaagcactaaacatggaaaggaacaaccagtaccagccactacaaaaacatgccaaatcgtaaagaccatagatgctaggaagaaactgcatcaactaatgagcaaaataaccagctaagaacataatgacaggatcaaattcacacaatattaaccttaaatgtaaatggactaaatgctcaaattaaaagacacagactgtattcaggagacccatgtcacgtgcagagacacacataggctcaaaataaaggaatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcagccagattcataaagcaagtccttagagacctacaaagagacttggattcccacccaataataatgggagactttaacaccccactgtcaacattagactgatcaatgagacagaaagttaacaaggatatccaggaattgaactcagctctgcaccaagtggacctaatagacatctacagaactctccaccccaaatcaacagaatatacattcttctcagcaacacattgcacttattccaaaattgaccacatagttggaagtaaagcactcctcagcaaatgtaaaagaacagaaattatagcaaactgtctcttagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacatgccagaatctttgggacacacttaaagcagtgtaaagcagtgtgtagagggaaatttatagcaataaatgtccacaagaaaaagcagaaagatctaaaattgacaccctaacatcacaattaaaagaactagaaaagcaagagcaaacacattcaaaagctagcagaaggcaagaaataactaagatcagagcaaaactgaaggagatagagacacaaaaaacccttcaaaaaatcaatgaatccaggagctggttttttgaaaagatcaacaaaattgatagactgctagcaagactaataaagaaaaaaagagagaagaatcaaatagatgcaataaaaaatgataaagaggataccaccaccaatcccacagaaatacaaactaccgtcagagaatactataaacacctctacgcaaataaactagaaaatctagaagaaattgataaattccttgacacatacaccctcccaagactaaaccaggaagaagttgaatccctgaatagaccaataacaggctctgaaattgaggcaataattaatagcctaccaaccaaaaaaagtccaggaccagatggattcacagccaaattctaccagaggcacaaggaggaactggtaccattccttctgaaactattccaataaatagaaaaagaaggaatcctccctaactcattttatgaggccagcgtcatcctgataccaaagcctgacagagacacaacaaaaaaagagaattttagaccaatatccctgatgaacatcgatgcaaaaatcctcaataaaatactggcaaaccgaatccagcagcacatcaaaagcttatccaccatgatcaagtgggcttcatccctgggatgcaaggctggttcaacatacacaaatcaataaatgtaatccagcatataaacagaaccaaagacaaaaaccacatgatttttgtctcaatagatgcagaaaaggcccttgacaaaattcaacagcgcttcatgctaaaaactctcagtaaattaggtattgatgggacatatctcaaaataataagagctatttatgacaaacccacagccagtatcatactgaatgggcaaaaactggaagcattccctttgaaaactggcacaagacagggatgccctctctcaccactcctattcaacacagtgttggaagttctggccagggcaatcaggcaggagaaagaaataaagcatattcaattagaacaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaaacattcttatacaccaataacagacaaacagagagccaaatcatgagtggactcccattcacaattgcttcaaagagaataaaatacctaggaatccaacttacaagggatgtgaaggacctctgcaaggacaactacaaaccactgctcaatgaaataaaagaggacacaaacaaatggaagaacattccgtgctcatggataggaagaatcaatattgtgaaaatggccatactgcccaaggtaatttatagatataatgccattcacatcaagctaccaatgactttcttcacagaattggaaaaaactactttaaagttcatatggaaccaaaaaagagcccacattgccaagacaatcctaagccaaaagaacaaagctggaggcatcacgctacctgacttgaaactatactacaaggctacagtaaccaaaacagcatggtactggtactaaaacagagatatagaccaataacagaacagagccctcagaaataataccacatatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatattagatctaaaaccataaaaaccctagaagaaaacctaggcaataccattcagggcataggcatgggcaaggacttcatgtctaaaatgccaaaagcaatggcaacaaaaggcaaaattgacaaatgggatctaattaaactaaagagcttctgcacagcaaaagaaactaccatcagagtgaacaggcaacctacagaatgggagaaaatttttgcaatctactcatctgacaaggtctaatatccagaatctacaatgaactcaaacaaatttacaagaaaaaagaacaaacaaccccatcaaaaagtgggcaaaggatatgaacagacatttctcaaaagaagacatttatgcagccaatagacacatgaaagaatgctcatcatcactggccatctgagaaatgcaaatcaaaaccacaatgagataccatctcacaccaattagaatggcgatcattaaaaagtcaggaaaaaacaggtgctggagaggatgtgcactgttggcgggactgtaaactgattcaaccattggggaagacagtgtggcgattcctcaaggatctagaactagaaataccatttgactcagtcatcccattactgggtatatacccaaagcattataaatcatgatgctataaagacacatgcacatgtatgtttattgtggcactattcacaatagcaaaggtttggaaccaacccaaatgtccatcaatgatagactggattaagaaaatgtggcacatatacaccatggaatactatgcagccataaaaaacgatgagttcgtgtgctttttagggacatggatgaagctggaaaccatcattctcagcaaactatcgcagggacaaaaaaccaaagaccgcatgtcctcactcataggtgggaattgaacaatgagaacacttggacacaggaaggggaaggggaacatcacacactgtggcctgttgtggggtggggggaggggagagggatagcattaggagatatacctaatgtaaatgatgagttaatgggtgcagcacaccaacatggcacatgtattcatatgtaacaaacctgcacattgtgcacatgtaccctagaacttaaagtataaaaaaaaatgaaggaaggaaaacaaaaaacgcaaataaataaataaataaataaacagtttaggccgggcacagttgctcacacctgtaatcccagcactctgggaggccgaggtggccagatctcctgaggtcaagagttggagaccagcctggacaacatggcgaaacgctgtctctactaaaaaatacaaaaattagctgggcatggtgtcatgtgcctgtaatcccagctattcaggaggctgaggctggagaatcacttgaactctggaggtagaggttgcagtgagctgagatcatgccactgcactccagcttgggtgacagagcaggaatccatctcaaaaaattaaaatagaaaaataaaaataaaattaaaattaaaaataaacagtttaaacgtccaacactagtgacttggtaaaataaaatttagtacatccacataatgtaatgctattgtcaaatgaagttatttatggatatttgttgacatgaagaaatgtttgtgaatcataatatattagtcagttgaaagaaagttgctgacattataaactgatgtttggctaaattataagtacagatgcacgcatatagtactatgggtatataacagggttagtatatatatatggatatatgtgtatgtgtgtgtgtatatatatatatagtgtgtgtgtatatgtatatatatagtgtatatatatacacacatatatgtgtgtatatatagtgtatatatatagtgtatatatgtgtatatatagtgtatatatatacacacatatgtgtatatatatgtgtatatatatacacatatatgagtgtgtgtgtgtgtgtgtgtgtgtatatatatatatatgctttcttgctctgccagctgaaaagcaataacaccccagtagcaacaagcatggctaggtaccagaactagctttgtaatcccattttccaagaaaataaatcagagctctctggagaaatgtctgattctagggctgggacaaggaatatacaagataggtctggagaaagttacagtgccagaaagtaagcaagtgctcaaaaacaaaggaaaaaactcacaatgatgggagtatgtaaaaaggaggtaagagccaattggaaacgttccgtttggctaaagccaggacaattggagcaataaaataaagtagtactgagtaataatccaaggtgtaaaacaaatatcgtgtgtcaatactgatataaataaatgattgaataaataaatggggagaatagacaaatctcccatgcagaagaattccaaataatttacttggagcataaagtgatagaatgtaactccctcctcaagtgtgggccatacacagtgatgtccttccaaagagcacagtatggaaaggggtaagaaagagcaactttacagtggtaaaatctgacaaacatggcctcagtcaagtgatcaaggttgacgtcaacagtagtaagtcacgttgacagtatgaaccttgatatggtgtgaggagaaatggcatgctacctatggcgtcttcttcccaaaaatgtataacctcagtgtaatcatgaggacatcatcagacaaatcccaattgagggaaattctacaaaatactgaaagggagctctttaaactgttaaggtcatcaaaaacaaggaaactctgagaaattgttacaaccaaaaggagtctaaaaagacaggattaaatgtaatgtggtatcctggctagaattctggaacaaaaaaaaaattaggtaaaattgaagtaaatctaataaagtatgaactttagttaataacaatgtatcgatattggtccattaactatggcatgtgctgctgtaagaagttaataagaagccacactggatagggatttatgagaactctgtgtactctcttcacaacctgcccacaaatccaaactattccaaaattaaatttcttcttttaaaactaagtttcatatgacttgatttttgttaagggaggattacaattttatgtatagctgtgtcattatagatatagctatagacatggatatagatatatagatatatagaaatatagaaaagcatttagctgtgctgtctaatacacagccattacctagatatagctattgaacacttggattgtggctaatccaaattgagaagtgctgtaagtgtgaaatgtacaacagatttcaaagacgtaatatgaagaaaagaatataaacaatatcattaatgttgtgttttgagacagggtctcattcttttgtccaggctgaagtgaagtagtgcgatcacagatcactacagcctcgacctcccaggctcaagcaatcctcccacctcagtctcccaagtagatggaactaaaagtgtgcactgccacacctaatttttccatttttatttattttttatttctaggtttactcaaaaacattattactcaattcataaaatagtaattcagttagctggtgcctaaagactgaaaaaattgtaattttccaggcatttacagtttggggaacaaaaaacatgagacctacttgaaaaaatagaggctaataaataattaaggataaggctctaaaaaataacagtattgcaagctatttttaaagagaaaaatttgatagcaaaatgtttctctgactttgtaaatgcacaagaaagatcaacagttttatcacttgcagaaaaggcaattaatgtaatagaaaatgtgatgataaacttctaagaaactaagtgcttatgtctatttaacaatagaagttttacctattaccatttactattcatgtgtcgacagcaatccccttctctcccaactaggcctttcacaattatggaatatagacataaaatattattcctagatacattttacaaaataaaaatgagtaaatggaaaaaaggcaagttaaagtagttatatatatatattgaaaagtgggtgaataaactgaattactttcactaaaatgactatacaatagttaatgaatttcttatttatacaaggggaaaactggatataatatatctttaacattacacagtcatagaaaaatgttaactttaacctgataaaatcctttccccacatgttttacactttggattttctttcaatgtttattttggatccagagggtacatgttcatgtttgttacatggatgtattgcatggtgctgaggattggggtatggataatcccatcacccaggtagtgagcatagtacccaatgagtaaattgttaccccatgacccaccccaccctctaggagtccccaatgtctattattcccatctttttatccatatgtactcagtgtgtagctctcacttgtaggtgagaacatgtggtatttggttttccattcctgcatatattcacttaggatgataacctccagctgcatccatgttactgattttgttctttttaatggatgtgtagtattccatggtgtatatgtaccacttttttctatccagtgtaccattgatgggcccctaggttgattccatgtcttagctattgtgaacagtgctgcaataagcatatgagtacatgtctctttttggtataatggtttcttttccttggggcatgtacctaggaatgggactgctgggtggaatggtagttctgttacaaattatccaagcagagatctccagactgctttccacagtggctgaactaacttgcattcccaccaacagtgtataaacataccattttctatgtagccttaccagcagttgttatttcttgactttttaataatagccattctgactggtgtgagatggtatctcattgtggttttgatttgtgtttctcttatgattagcaatgatgagcattttttcacatgtttgttgactgcttgtatgtcttcttctaagaggtgtctgttcatgtcttttgcccatttcttaattggattgtttgggttttccttgctgatttgtttaagttatttttcctattcagatgccttttaatttctttctctagcctgattgctctggctaagacattcagtactgaatgttgaataggagtggcaagagtaggcacccttatcttgttccagttctcaaggggaatggttccagcttttaaacattgagtatattgctggctataagtttgtcatagatggctcttgttattttgaagtatgtaccttcaacgcttagttttttgaggatttttatcatgaagcaatgttggattttatcaaaagcttcttctgcatcaactgagatgacatatggttcttgtttttaattatgtttatgtggtgaatcacatttattatttatatatgttgaatgttgaaccaaccttgcagcccatcaataaagcctacttgatcatagcgaattaacttttttatgtcacgctggcttcggtttgctattaacagtattttttttttagatggagtctcactctgttggccaggctggagtgcagtgttgcaatctcagctcactacaacctcagcctcctgggttcaagagattctcctgcctcatggagtacagtggtgcaatctcagctcactacaacctctgcctcctgggttcaagcaattctcccacctcagcctcctgggtagctgggattacaggtgcacaccaccctgcatggctaacttttgtatttttaatagagacagggtttcaccatgttggccaggctagtctcgaacatctgacctcatatgatccacccatctcagcctcccaaagtgctgagattacaggtgtgagccacctcacccagccagcagtttgctagtattttgttcaggatttttgtgtctattttcatcagggatattggcccgaagttttctttttttgttatgtctctgccagattttgttatcaaattaatgctaccttcatagaatgagttaaggagaagcccttcctccttggttttttggaataacttcagtgggattggtaccagttctttatatatctggtagaattcaggggtgaatccatctaatcaagggctttttttgttggtggtggtggttttttttttattactaattcaattttggtacttgttattggtctattcaggctttcactttcttcctggttcaatcttgggagtttgtgtgtttccaggaatttatcgatttcctctaaattttctaatttgtgggcatagaggtgtttgtaatagtctctaaagatcttttgtatttctgtgggatgagctgtaatgtcatctttgtcatttctgattgcacttatttggatcttcacccttttacaaatttcttaatctacctagaagtttatcaatctttgtttattctttcagaaaatcaactctcagtttcattgttcttttgtatagattgtatgtctcaatttccttatgttcttctcagattttagttatttctattcttctgctagctttactgttggtttgttcttatttttccagttcctctaggtgcaatgttagattgtaaatttgggatatttctagcttcttgatgaagacgtttagcactagaaactttcctcttaacactgctttagccgcatcccaaagattttggtaagttgtatctcttattttcactaatttcaaagattttttaaatttctgtcttaatttcatttttcacccaagagttattcaggaaaaagttgtttgattttcatgtttatgtgtagttttaagagatcttcttggtattgatttctatttttattgcattgcaatctaagagtgtgctcggtatgattttgatttttttaaatttattgagactcgctttgcaaccaagcatgtggttgatcttagaatatgtacctgtgtggatgagaagaatgtctattctgtggttgttaggtggagcattctatagatgtctactaggtccaattggtttagtgtcacgtttaaatccagaatttctttatcagttttctgccttgatgatctgtctagtggtgtcagtaaggtgttaaaataccccactattagggtgtagctgtctacaccttgatcttttcatagatcaagaagaacttgttttatgaatttgggtgctccaatgatgagtgcttatatatatttaagatagctaagtattcttgtttaattgaaccttttatcattatgtaatgcccttctttatctttcctgaatgtttttggtttaaactctgttttatctgatataagaatagtgactcctgctcttttctgttctccatttgtgtggtacattttttcccatccctttactttgagcatgtgagtgtagttacacgtgagcttggtctcttgaagacatcagaaaattgggtcttgagtttttatctagcttgtcactctgtgtctattaagtggggcacttagaccattttacatactgaattagtattgatatgtgggattttaatcctgtcattgggttgataattggttgttttataaacttgattgtgtaattcctttatattgtctgtgagctatgtgcttagtatgtttttgtcataacaggtattaatctctcatttccatgtttagcattcccttaaggacttctcataaggttggtctggtggtaacaaattcccttagagtttccttctgtgttaaggattttacttcttcttcacttatgaagcttagtttggtgagatatgaaattcttggttggaatttatttgctttgaggatgctgaaaataggtctccaatttcttttggcttgtaaactttctgctgaaaagtctgctgatagtgttgtgggattccagttataagtgacctgacctttctctctagttgtctataatatttttccttttgcattgaccttggtgaatctgatgactatgtgccttggggatgatcatcttgtatagtattttgctgggttctctgtgtttcttgaatttgtatgtcaatctctctaacaagattggggaaattttcatagattatgtcctcaaatatgttttccaagttgcttactctctctctttctctctcaagaatgccaataaattgtagacttgatctctttacacaatcccatatctctcagaggttttgttctttttttaacattcttttttctttatttttttctgactgagttgatttaaagaacaagtcttcaaactctgagattctctactcagtttggtctattctgctgttaatgcttctgattgtatgtggaaactcttgtagtaaatttttcaattccaggagttcagtttagttctttcttaaaatggctattttgtctttcagctcttagatcattttaccggattctttggatttcttggattgcatttcaactttttcctggatctcagtgagcttctcaccatccaggttctaaattctatacctatcacttcagtcatttcagtctggttaagaaccattgctgggggctactgtgctcatttggaggtaaggagacatcctggctttttgaattgccagagttcttatgctgattctttctcatctgagagggctagtgtttctttaagttgagtatagtcagttggcttcatttctgggtgctttcagagggccaaggctctgtacaggatctttatttgtagctgaattcttgtcttaggtttcacaggcactgtacattggcaaaatattttggcagttgtaatttggactgtgatgcagtagatggtgtttaagagtgatgaccaacagataggctcttattcagccatgcagctcttttgtatttcaccatgttctcaatagtgctctgtggtggggtaaggcagagagataactccctcaccaggttcactcctgggccttggaggagccccctccaatcactggggtcatgcccaagtttcctttgttaggtgttctgggctgtggggctccctcagatagaggtcatggctggcagacaggccacttccttcccagaccagccctgtggagagaggcaccccactttcatgctggtccatgaaccagggcatctcaaccctctcagtgttttgagagtgagaacatttcccccactcaggcaccaccaagccagtgagtcttgcctatctaagtacagaaggaccatggaggtcgcatggtcagccatcagggtctccattttttgtggggacagaatcttactatggtgctcaggctgactgtatgttgaaatgacaatattttaggtatattgggttaagtgaaaataattttatatatttatttatgatttcctttaatgtagtcactaaacattgttaaattatatatgtggttcatattgtatttctactgatagcagttgtttaaaaggatagacatgagaatgttaacaatagctattcctagtagtaaagtgtaatttttagcttttcttttttctaatttttcttgaataaatatgtgttccttgtgtaattttaaaagtaataaaggtaaaaatacacaatgaactactgctgtgaaatataccactaacagaagtactaagcagaaatgtcaagtcttagagtcctaattatttattcatttaaatacatatatattaagtgtctcatgtgcaaggcatttggacagttgctaggaaaataaacacaaaaaaagatgagctataattattttcttcaaggggttcacagtccattttggaagttaggctcatgaatagaatattagagtacaatgcggtcagtgatactatggtgatttgtattaactctcctccccttctgctttaaatgttgctgtttttctggctctaaccttagtctacttctctgcccacaacacaattgcaactaacacctatatactaatggctatggctttaactttgactttgcttcagatctctacatccaactgtcttttggtcagatggccattgggcaacctaaactgtatgcctaaaacccatcatctcttcacctcccctgctccagactcttctacctccgtaattcttgtctttgttaatgatgccaccatttaaccagttgcctcatgactctgtaaaaaggaaatttagttactttacttcacttctcaaaattcttcaggcttggcagtgcacaagcctacatatgcccttagctaccaatccaacttcatctcctggaacacttctcatcagcattgacactctagaaataccaaactaccaaactcaggaaacatcacaagttatcacctctcttcctttcattgttgcgtgtgtccttccctctgcttgaagtgtccaacctcatcaccacctcttcttcatggttcctagacattcctctctgttacctcccttgatcttccaggcaaattaggctctcttctctctggctccccttgaactttgtacatacctccaacatagtgattttcccattatattataataccagctttctgtatgatactctattccctaaggacagagattgtatctcattaaccttggtatcctcagcgtcacacggaatgtgacagacagaaaactttcaagtttactgaatatttcctatctttctttaccttttccactctattgtggtcactcttaccctagaataatgtagatgttccttgaataccaaccaggcttcacttctgggtctttgttcttgaatggccttaccccagatggttccctctgataaaccaattagtcactgctcagaagtcacctcatcagagaggtttttccttcaatcctgtataatatagtgcctggcaagaaaaggatgccctctctcaccactcctattcaacatagtattggaagttctcaatcaggcaagagaaagaataaagggtattcaaacaggaaaagagtaagtcaaattgtctctgtttgcagatgacatgattgtatatttagaaaaccccatcgtctcagcccaaaatctccttaagctgataagcaacttcagcaaagactcaggatagaaaatcaatgtgcaaaaatcacaagaattcctatacaccaattatagacaaacagagagccaaatcatgagtgaactcccattcacaattgctacaaagagaataaaatacctaggaatacaacttacaagggatgtgaaggacctcttcaaggagaactacaaaccactgctcaaagaaataagagaggacacaaacaaatggaaaaacattccatgctcatggataggaagaatcaatatcataaaaatgaccatactgcccaaagtaatttatagattcaatgctattcccatcaagctaccattgactttcttcacagaattagaaaaaactactttaaatttcatatagaaccaaaacagagcccatatagccaagacaatcctaagcaaaaaaaaaaaaaaaaaaaaagaaacaaagctggaggcatcacactacctgacttcaaactacactacaagcccacagttaccaaaacagcatggtactggtacaaaaacagatatagagaccaatggaacagaacggaggcctcagaaataacaccacacatctgcaaacatctttgacaaacctgacaagaacaagcaatggggaaaggattccctatttaataaatggtgttgggaaaactggctagccatatgtagaaagctgaaactggaccccttccttacaacttatacaaaaattaactcaagatggattaaagacttaaatgtaagacctaaaaccataaaaccctagaagaaaacctaggcaataccattcaggacataggcatgggcaaagacttcatgactaaaacaccaaaagcaagggcaacagaagccaaaattgacaaatgggatctaactaagctaaagagcttctgcacagcaaaagaaactatcatcagagtgaacaggcaacctacagaatgggagaaagtttttgcaatctatccatctgacaaagggctaatatccagaatctacaaagaacttaaacaaatttacaagaaaaaaacaaccccatcaaaaagtggacgaaggatataaacagacacttttcaaaataagacatctatgcagccaacaaacatgaaaaaaagctcatcatcactggtcattagagaaatgcaaatcagccagagtgagataccatctcccacaagttagaatggtgatcattaaaaagtcaggaaacaacagatgctggagaggatgtggagaaacaggaatgcttttacactgttggtaggagtgtaaattagttcaaccattgtggaagacagtgtggcaactcctcaaggatctagaactagaagtaccatttgacccagcaatcccattactgggtatacacccaaaggattataaatcattctactataaagacacatgaacacatatgtgtattgtggcactattcacaatagcaaagatttggaaccaacccaaatgtccatccatgatagactggataaagaaaatttgcacatatacacgatggaatactgcgcagctataaaaaaggatgagctcatgtcctttgcagggacatgaatgaagctggaaaccatcattctcagcaaattatcacaagaacagaaaaccaaatactacatgttctcactcataagtgggagttgaacaaggagaacacatggacacagggagcggaacatcacacaccggggcctgtctgggggtcagtggactaggggagggatggcattaggagaaatacctaatgtaggtgacgggttgatgggtgcagcaaacaatcatggcacgtgtatacctatgtaacaaaactgcacgttctgcacacgtaccccagaacttaaagtatatatatatatatatatatatatatatatatatatatatatatatatatatatatatagtgtgtgtgtgtgtgtgtgtgtgtgtgtatttaaaaaaagatactttcctaattaaagatagtttcctaccttgaaaaatctctaatgccagctactaaagtaacaatttctcacttatccacaggggttatttctggccagtgagatgatgaatgactgttttatgttaatttttaattttatagtattctcatgggattaaaataattccgctaacctcaaaaaaaaaaaatcaggaaacaacagatgctggagagaatgtggagaaacaggaacagttttacactgttggtgggagtgtaaattagttcaaccattgtggaagacggtgtggcaattcttcaaggatctagaaccagaaataccatttgacccagtaatcccattattgggtagatatccaaaggattataaatcattgtactataaagacacatgcacgcgtaagtttattacagcactattcacaatagcaaagacttggaaccaactcaaatgcccatcagtgatagactggataaagataatgtgccatatatacatcatggaatactatgcagccataaaaaggaatgagttaatgtcctttgcagggacatggatgaagctggaaaccatcattctcagcaaactaacacaagaacagaaaaccaaacaccacatgttctcactcataagtgagagttgaacaatgagaatatattggcacacggagggaatatcacacaccagggcctgtcggggggttgggggctggggagggatagcattaggagaaatacctaatgtagacaaggggttgatgggtgcagcaaaccaccgtggcacacctatacctatgtaacaaacctgcatgttctgcacatgtatccaataacaaagtataatataaaaataaattaaaatgtatattttatatatattgaaattatttatatattttgaaatatattatatatatttatatataaatatatattatatatatttatatataaatatatattatatatatttatatataaaatatatattttatatattccaccagaatataagcatcaactgggatctaattaaactaaaaacttctgcacagccaaagaaataatcagcagagtaaacagacaacccacagagtgggagaaaatatttacaaactatgcatctgacaaaggactaacatccaaaatctacagggaactcaaacaaatcagcaagaaaaaacaaataattccaaccaaaagtgggttaaggacatgaatagacaattctcaaaagaagatatacaaatggccaacaaacatatgaaaaaaaatgctcaatataactaattatcagggaaatgcaaatcaaaaccataatgtgataccaccttactcctcctacaatatggctataatttttttaaaaatccaaaaatcaaagatgttggcatggatgtggtgaaagagaacaattttacactgttggtgggaatggaaacctatggaaaacagtgtggagattcctcaaagaactaaaagtagatctaccatttgatccagcaagcctgctcctcagtatctacccagaggaaaacaggtcattatacaaaaaatacacttgtgcatgcatgtttatagcagcacaattcacaactgcaaaaatatgggaccagcctaaatgcccatcaaccaacgagtggataaagaaaatgtatacacacatataccatggaatactactcagccataaaaaagaatgaaataatggcattcacagcaacctggatgaagctggagaccatcattctaagtgaattaactcaggaatggaaaaccaaatattgtatattctcacctataaaagtgggatttaagctatgaggatacaaaggcataaaaatgatataatggactctggagactcaggggagaacgggtgcaccaaaatctcagaaatcaccctaaagaatggacccatgtaacaaaaacctcttgttccccaaaaaattattgaactaaaataaaataaaagtcattttttataaaagaatctaagtatcaaaaagcccaggactttgtctgaattattcaacaaatgaataaagatctgatacatgtataaataagtaaatgatgttatttatcacctaaatatgacactgtctctctgactttaattttcctttcatctgcttatttttcttcccaagccatgaatatgggacaaaaaaaagggattaagacacaaacaccaagaattggcaagtataatgaggctgaacttgaaaaataacaatagttcaggtaaccatatattaaatttgtctcaagaatttattttattttctcattcatttattcaacaaatatttacatcacgcctattatgagttctttttgaaaatgcaataactgtctcttacatttgtaccattgtttatagtttacaaggtcctttctgatacttattttaacgtatcctcataaacaattctttgaggtaagcaggtcttatgaggaatgagtcttatgaggaatgagttaccagattaaggatcattgggttgtaaaaatcttgagctagaaagcattccatcgttttattgttgatacaactatatacagaagcccattatcaatctatttatttcaccacagagagctataatacacccattgaccatcagtaccagtatattaattttcacttctgggatttccagcctactcttagcttcaatgttagtgtgaatatttcatggtagaatgcacaaactttgaggaaggtgcaatgctttccctgtttcttccacttatgttcaggttctgcacatactgtatgttctccataaatatttattggtgaagagaacagttattaatgtaagaatctctctattcagaaaatatccaaggaaactgtgatagctgctggtttccaaagatggtcttccaatgaactatgtctctcagtattcggaattttgcataattccttccccttgatctggactggctctgtgacttggttataaccaacagaacatggtggtgggttaagcaatactcatttcatagggggcatttctggtcacatgatacttaatggtccatggtcaaatactaggatccagcaaagagccaagagctgtttctcaaaaaaaaaaaaaaaaaaaaagaaaaagaaaaagaaaaaaaaagaaaaaagaaaaaaaaagttatctgcagagtatggcatggctttgctcccagattctaaaagtctgttctggaatttacctaagaggcctgccaaaagctcagtaggcactttaagcaccactgaatcagatgtgtcatatgaccaaagtggcagggaagcttgccaccctctcacaagggcttgtctttcgccaggccttattcaaaactggaagcctttcagattactcattcagcaaataggtttagactataacaacacacccaaataagatatgttgcctccaaaatccaatgaggcacaccagaaattgggactctttctttatggtaggagagaccagatgtagcattgaacttcaccttgaaagagatatctcaactttccccagaccatgaaaccccaagaaagttcctgaaggagcaaacttctaaatttttctgggatttatttcacaacctcttgcctctatgggtcttaccaaggtgtctaaagtagttgcgatttcctggtccaccagtgtagaggatccatgtggtgtgttgtgaaatgaagaggcaatcaatttcctgtggaatagaataggccagggttggagagttgatataaccctgaggtgaaacaaggagggtaccttgtttcacccttccagatgaaagaaaaatgcttctgatagtctctactaacatgtatatagaggaaaaaatgacttcccatatcagtattcatatattagatgtacatatattgatttactatagcaatgaaaccacatctggaacagcagctgtgattgtactcaccacctgattaagtttacaataatcctttgtcattcttcaagatccatctgtcttctgcacaggccagatagttgagttgaatggaggtgtggtgaaaatcaccagccctgcatcttttaaatcttttatagaggcactaatctctacaagtctctacagaatgcagtgctgctgtggatttactagtttggaatacaaaggcagttctaatgccttctacttgtcctcactcctcagatcagataatcaatgtagttattctgcctttcctgagtgtgcctccttcagttaagcattctagaacttgggaaataaccatggggtaagttcagagctaactggatgcaatatgagatggacctgagccaaaataccattaatcattcagcttcaataaacccctactctggtaaataggcaatagtagcatattgtgtctccaaggactggtatcatttcagagccaatgtccagaaatcccccaaaggtctggttatttacccttcccaaatgcactatgaccttggcaaatggctttaggtcttttcagggaaggaaagaaagagaaattacagtctaaacttttggaatgtaaatataaattagaaaaaatcctgcagtccttttggcaggcagggtacctcatcattttgttcctgccctgatatgggttgccaggagttgagtctagctataggcatacaaacagtgaaagatgttgggggtgagtcttgaggggtctcagcaattttccacagagtaagtccttacagccttttcaatcaagggaggactaaactcctcagagggaaaggctgcttctgctgggaaaggagacagggctttcaaggttctcagcttccaaagaatctgcctacatgttgccatctcaattttcaggggaggaaagaaggagaaattacagtctaaacttttggaatgtaaatataaattagaaaaatcctgcagcccttttggcaggcatggtacctcatcattttgttcctgccctgatacagcctgccagctctgtcccaatcaaagccctaattttaactgtaagaccttcaattgaattgatgttctaatctagctagctgcaggatcagtctttgggcttggttttttgaaatatcagatcttgcagctatgagagataagagtttctttcagagtagtcacaaagacttttcagtcccttgcctgcatcttgaactgaacattcaacactctgagtttatttctttttctccatattctctgtgacactttgaagcaacccacaaactccagtcctcatactccttacttccactacattggtctatggcagcatctacctggtaatctaacaccttgccttctataagcacttgatatcaaggactactgtgtcccatttaccattggcagtatagtcactaatgcttcatcgaatcagagaatcaacaccaaattcccatccttaaaattctatctctggattcacttccaacaccaatagttgtatcagttaagagtcagtcagggaagcagaaccactgtgaatgatacagaatataggaatagtggattcgttgtggaatcagaccttacaaatgtgagagaagctagagaaggaaaggtctggaagaaggagtcagaagatcagaaaaagggtcattaacctgtctatcttatgcagtagcacagatggaccagacaggctggggcttgggggaaatctaggaagctaaacactttcaaccaccaaagtgggactgtgaaggggagctcatgaagaactgtatggagagtggttacctgtctgtagcaaccacttctgtgggtccacagccaagtagttggtgatgggtctcgagtcactgttgttcagcagagccaagagtcagaaagattcgctggatgcagagtgaaggaaagcaaggactatatgggacctaccaagcatctctccctctgtccatcactgtatgtgaccacagtgacttcctaagagtaatagttaccacttctgtgttctaactcttttcccatttcatctcttagccaatgctaatacagagcgatacatgaaaggggattctgagaaatgcagttgtctgcttaagcaagttgaccagcataatccagcacaacttctaaatctcagaagatagcaaatgtgggcagaaagaaaagtacagatgctccacgggttcactggtgatctttatggctgcaactgacctaggatttgggagatgcttggagagggacagaggggcacacaggaactttcctctcaaatatgaggatatcaatctagatctacgaggagtccttttggagataaaaagaaatttataggagatgatgaacaaaaggcccaatttctatattagactgtctccctgaatgagggtgaataccaagaggagactgagccaaggcctcagccctctgaattctaaaatgtagagaatttcattctgatctattttatacaaatggtgctggtctctcagacagtaccttttccgatgaaagaaagagagaaacgaagtagaagattcgtaacccagctcagtaaagaggcttacctttgctctttgctcaccatcattcccccgctcaaagtctcagctacctgcctctgtgcaatagctacacagtgctcctcaagtatctgcctcctgaacacagaattataactaacaagtatttaaaatttatgtatttggtgcacatctttcagtatgagctttttggcaccaactcttactgaatgccaatataaaagtaaacaatttgaaattattttaagtgattatcaaaaataacagcataaattctatgatgtggacttcagccacagtcccttccagggactcttccaggcagaccaaaagagaaaagctgtctgcaaaagaaactcaaagttcccaggaccaatagcatacttgagtcagatacagctccttaaaagacaagtaattttcagaggccctagggtaaactaaattagttttaacataatactatttaaacatgtagaaacataatatgatttataaactctatatgcttattgctcttatgccaacaatttaaaaatataaattaaacattcacaaagcttcaaaaccactacaacttcaataaataattttaatttaatgtaatgataatacttggctaaaactaaatcaccaggtttttttctttccaccttttatattaggtttaggtggtacaggtgcaggtttgtggaatgggtaaatatatgtcatgggggtttgacaagatacagattatttcgtcacccaagtaataagcatagtacccaataggtaatttttcaatcttcactctcctcctaccttccaccctcaactgggccctggtgtctattgttcccttctttgtgtccatgtgtactcaatgtttaactcccacttataagtaagaacatgcagcctttggttttctgttcctgcattaattcacttaggataagaacttccagctccatccatgttgctgcaaaggatgtgacttttttcttttttatggctgagtagtatttcatggtgtatatgtaccacatttcctttatccagttcatcatttaagtcaccagttttgagtttaatagatgaaagatatatacgtggtgctgggttttgcttattaacttgattcttctcattttgtacataattttcatgcttgttttcctttgtttgaaacaaattcatattgaattgttaattaattcacttgatgggccaatcaatttactgtgcaccaatagtacaatactgaaagaaatatttttaacttttaatgaagcattctttactattgctaatcaactgtagtacagtgatttatacaaaagatgagctctacacagtacagccatgtgaatggggaatttagcaccaatcattcattgagttccccatgcttacagcatctaacttgttatgattctattttccaatgactgttttatattcaaattacttgacattattaggccttcacttagtattaaagtaactattagtattagcaaagcagggcatcaaaatattgtgacagtgtttgcttatagttgttcagccccaacgtgagttagttgtgttttatgaggggtatgtactccttataattttgcataatttaaggcttatgtttccgtggggaactggttcacagagcccaaatacctacaactttgtagcacatttctgttttaatgccgctctttattttcttagcattatctaccatatttagcaactgctcttttctaaattagtggtaaaacacatcaagggagttgtttggctttttctgtgggagtgaattatagctaacatctgtgaaaagttatgtatctgaatgcacattttccagcatgagctttagtaccaactcctaatgaatgctactataaaaagaagtaaaacaatttgaaattatttaagtgattattaaacataatagcataaaataaccaagatctcttatagaaattctcataaagcaacaggtggaacataccatactaacaatggctggttctttccattaaagctgaagtagctccaccatgtggcaggagtaaaaacaatctacgattcctttagcttgttcaccaactgaaattacacaaatctcatttaagtttgatgagaaccacaaaattacccattcttctcagaatatatgggctattaatttttatatcacattacttaaatttcacataatttatgctgcccaactacatgttttagactaccattccattgaaaacacatttttaactccataaaattatgaagacccatgaaaattctagagatgcatatattccaagtataataaatatcacaaataacttttaaattcaatttttaaataattcttgttactattataatttccatacaggtctcagaagcatcttaaaagtaatgataactttttgtctctgtaaaaagaatactattcaaaaaaggacaaaaagttcataaatgtggaatactaactttgtaactaatatataaaatacatgagttttttgattcctaaattcttccaacagaaattcaaataatgtaaaatattggtatctttaagccgtaacttattaccttgttaatttcaaaacagcatactagtaacctgatctttaacattagttgttaccaaattatagtttttaaaaaatttcctaggaaagtacgccattttttgggtatcgaacatctcacctcataggaatacggggattgttttccttccactcttttgtattttccaaattttcaatgtaataagcacatattaattttatgatgaaatgaaatttgtaaaagaataaatgttaacattagaagataattaacaagttatctatctcgagtcaatatacaatacaaggaaattaatataccactttacctggtggcaaggaaaataggtgagatatctttcccatcacaacataaaaatatatgttagtaaatattcatattggaaggaatgtattctatgacctagcaattacctgcgtcccagtcttggcattactcttattgtaaaagaaagcatgaacaagcagcaattttggggccataacaagttggaaataacataatcatatagtaaaaagtgatatcacaggttataataagtctatgttccatatattaaaaataatgacacgaatctacatataatgaaaagagaagattgccaaaatgcattattgattgagaatgcaagttgcagaataatatatacagtattatgctatttatgttgataaaaatattgtacagtataaaccctaaatattgcacagcaaaaggactgtaagtacattgatgaattccctgttattagtacctgtggaagagggaattatattgtgggatgggagaacagtcagtggagagtttggttttaattgcaatgcttttatttttataataaggatgtattagcatattacttgcataattaaactttgttttttaggttttcttcttcaccatcgtatatttgcatgcatatacctatgcaaataacaaagtccacctttattggggatttgtgactggcatttttctaagcactttgtcatgtgtcatatattgtatcatgtaaacttattattaaccttatgatgctaataatatttttcccatttcacagatgacgaaaccaagcctcagaggaactgagtacattgcccaaattcaccaagcccgtaagggttacaatcaaactttgaatccagatatctgtctcagagtccacaatcttaaccaaaattttttttacaaattcccatgtagaagtgtgtacatccacatacagacgtgcacacacacacatccctgctgtccagccttttctccccctgacacttgagtgcacaggtcattggcatcttctctccataactttccaccattgacagaaatgtgtttgctcaagggatgaattgaggtgaaaaccttacaacattagctcttttgtaaaaaatctgagcagattttttattttgtattttgttttcctggttacgcctctccttttaaagttttgaaaggtggcattaatatctatttctttcctgactgctccatttattagtttcattaggattagtgaattctacttggtctttccccaatccattaatattttttcccttcacttaaaaacaaacaaacaaaaaaaaaaaacacttgttttccaaatggctttggggtggtagtaggatttcctgatggctagaggaaactcctcatggcagtatcttggttgagtaattggtcctcgtctgtatgttcaagaaggtgaatgttcttagtaaacccagaggggatcagcccatcagaggtaagcttctgctatgtaaattgagacgagattcaggcttaacctcaaataccaatgcatttgctcttctggtctctcccttctcctccttattatcatgatactttaaaagccaaattactgataagaaatttgcttgctgagaacatagaaaggtaaacggctcgagagagggggttgtacatttttctttaaatctaaaaaaccactatgaagaatcccaacctcccaacaaaaattgcctctctgttaactggattttacctgcatccagttttaacacctctctcctctggacagtgctgacactgtcctcctgggaattatgacttccttagacacataatgctagagtcaagttggaacttagattctttttcttgcggaagtgggaggcattgtgtcttctcccttcatgcattaatttaattagaaaaacattcactgtctctcactatcagcctacagattctctatcttctcagcccggtaagagccttatcacactgagataaatggttctctttgttgtaccaaggtggttcctgaagcatggtaatggggaggagacacctagagatcaaagcaactaatacaatcaactccaatccagccccaaaccaagtctttccaccagctattcctttcatatctaaatgttgtcctcttcctctgcagcaggatagaaaatcaatttctaagtgtaaaggcagtaaacaaaatttcagagatatatagtatatgtaagtttgagtgcataaagttaaaagattcccaaatatctaaaaatgtttgaattaaaaaatcagtatcaaattagtaaaaaaaaaaaaaattaaaaaggtacgtgagctgtataacagtcaaatgttaatatgcttaatatattaaaagtgtatataaaaggataaggacaacactagcctgatggatatataggcaaaattcggatacaaaaattgtgtataaattactaatgaatatttgaaaaaaaacactgaaaattttaaaatgcaatgaagacagctataattcatatcaagttaacaactatttttaaacaatcacaatctaatgctgatgaaattcggcatattaagagcaattacatttttactgctatgattgcaaattgatacagtataacagtagattatttggcattaggtatcaacagcttttaaaatagtcatcctcttgacccaaatattggaaatctatcattaaaagggtcttctgagcagattttatataaggaaaatgttcattaaatatttttcatactttcacgtaatttgaaataacataactatccaacactagagaaacagttaagcaaattgagcaacatctacccagtagaatactatgccaccattaaaaattagattttcaagagttttaaattacatgggggaaaataaagttaacagaaaattgaatgtacaaaacggcctcaacaatgtcagaaaatatacttaagaccaaagactaaaaggaaatatgccaaaatgatgtagttattgtctctgggtagtgagataatagattatttccttcttcctcttctttttataattgtatgtaaaccacaatttcttcttcaatgaaaacatatttttataatgagaaaaaatgatctaataacagtatcttttaaatacaaggttatgtgccctgaaaacattcctagtttcccttaaagtcatttgtctaacataagtgaatttgtctgaatctctctagaatacacattcatatgctctaccccaggagcaaggagttcctaaaatctactccctactatgtaaaataaaactgcctttaattttttcctgaatttgtttcagacttcaagtagagttctttattatttctgttcaacagcacaaactacaaacataatctgtttggcaaaccatttttattcaaaagtataataatgccttgtttttcatccttccagaggacctagtggaagaaaatgcctaacatcagggaacagtaggagcagcctaaattgaccacagaattgtatttggccactgtcctcaaaaaattcaagtggattcagtaatcctgaatacttatgtacaacaagcattcctactataatagatcatgaggattaaaatgaggtgagttcattggtgagcatgacatgtagccatagcaattaatcttaggttccttctcccttaaaaatggctaataaaacagaagaaatgctgtatgaataatttcagaataacatggaataattgtagatatttctataagatttgtaccagatccactagaacaaatctaccagtagctaaacactgtagagtctctaaaaatggacaaggaggagatgtgacaaagatactctttaggggaataaagtcatcctaaaaactgaagatattttctgctctgccaatcaaggaatcactgttctttccccagcaagaaggagagtgaaaagaggaccaaattggaggccccaaatttgcattttaatcataacctttcatagctaattatgagatttgagcattctctggatctcagtttgccacccataaaatgatgggtggactgaaagatttctaagttttccagttctgacattgcatgggtctataaggagctccatcttggttggcccctgaaggcacctggagactttggttttagggaaccaaggagtctcagtgctgaatgaggatatagttccccggtgtagaattttagaaactatgcaagcacttggatctttaaaaaaaaaatagttggtccctgggctgtctcttacaactttaatatttacactatgacaaagtgaaagtgctcattcgtgttcgagccaaagtaataccattctctttattcattccaatgagctaattttacatgagcaagaaagcactggagaggtacagacccatgggatatttgcctagcctaagtgagtctcagatggaaataaatatgaaaagcgttagcatgggacctgtgagaaattgattcttacatctggcctccaaagggtcaagccacaaataagtgacctttgacatgccccttctctagttcagcctggagctgcccacatttcccagtggtgcccagtcaactcattctcctgatgcaggatcatcagagagaatctggagtaatggcagctgcgggtaaggggctgccaaataatagtggaacaaagatctcttccaagtttctatttcctccgaatagctcaaatacttcaacagtccaggtccccctaaagactgcattttcttagctgcattctctctagttgtgatgagtgtctcaaaaaggaacacctctcctcctgagtttatgatagtttatgacctgccacttcatttccagcagtgtgtcccagttcctcttgcaatccacaaaggacactttttctttcagtagcctggtgtgagctcttgcctctcaggattagctgtgatcttactgctggggtgggagcacacttagccacagggcccaaaagaaatactgtcactgaaaagagcactttcctgtatttgagggctcttcctctcttctggtacacccggggaaaaacctggcagagtccacccacagtctttgaggattaattctgtaagaacttcttacactgaagggaatcctcctccaggggatgattctgctctgtgcttctgagctctgatggcaatcacatcaacatcgctggggactgtggcagaagaggaacatcacccactggaaaccggggcaagttgctcctctgtagttccaggaaatggccagaggcacagctctgctgttccaatttgcagttttctctaacatcaaaaataaaatgtgatttgcatttgaaattttacagaattcctcattttaggtcaagactggccttacccataggttagtgacttatgtggtaggatttaacacacacacacacatacacacacaaatattatccataaaaagaattatattcccaccaacctgctgtggcattcatcagtgaccctttgaagttcagccattgaaggggcaggttaaaatgcaaatttgtttcttggagaggtagcacatagagctattatcaactgttaatgctccggtattgctggaatgtcagactaagaagtttgggttaaaaattaacatatcagtaagtgaagactggctttatatattacatatttaatttataaaaatggtgacattaaaaggtggcaccaaaatgtaaatagaatcaagatcactttggataaattaacgcatgacacaagcctttgacatgttattaatggaaatgagtttgggggatctaatttagcctttgagattagtgtcaacaaagaaaggtatctcctctggtgcccatggcagaagcagaacattagtacaattcaccatagatcagtttcactttgtaattcagtgtaagtggtttatatgatagagagggcaggaagatctggttttgactctgtctctactacttacaagatgcatgaagctgctcaagtcacttaagcaaggtgagcctcaggttcttcatctacaaaagtgggatgtagaaaagaagagtaaatgtaaaattcctgttcagtagttgtctattaaagaatctctccttccttcctctattcacatccatcagggagaggagtaggctgatggtgccagctaaggacctcggcactcctagacctattcctgaaccattaatggctctgaatttgggacaggaatgttactctcatggttaattccttgctcacttgtctgctggtgcttgttcacaatgtcaaagatatggcaacttcatgggaaggcaggtttaactttttggtgtttttgcactagcctgtatatctgtctacctttcatttgagaaccaccttgctgattcagactggaagcttcaagagagaagtttctttccatttaatgcactggggatggtgctcaacagagaaccacactcaaatcggggctaaataatatggcaatatcatggttgcaaaagaaacacctccctttctcaccaaatcactgaatcccttattctataaaaatgaaattgaactgcaaacatcaccaccatgacaagaggatttaggcacactgatcaactgattaaattctatttgtcatccagagtgatcctggaggccttcagagcctggaggaaacctctctgtgactctactcacatctttacacacggaaaatccaattaggctgagtatctacagcagcttccagaagtaaactgattgcagaagggcagcctgctgcctgaggactgcaggggacgaggaaggggtgggccacctggaagggacctctgccttctcagcacctagagttggtttccagatgatcacatagtttaacccttttcttttatagacaaggaaattgaggcccagaaaggttaacagtcttgcccaagacctaagattagaaggcagagtcggggttgagaattgcttatgtgagactcagacccaaagcagacgaccatattttcaaattcagtgaaaactggaaaactcgtatgggcctacccagcccggaaaatccccatgtattaccaatacatagtaaacgaatcaaagattgaaaagtttacttgaaaaccaatcagaagtcctctcccacatgcaaaaatcccaccctaatagaacactcatcacccgtcagactgtcttaacacttcttcctttttctttctttgcaaacccctttgagcctgtgccagaagtgacggtgcctgccaccctctctgcagtcagtcctgaccagttctctggggtttacacctgtcctctggccactcgtcagctgcacttcctgcatctgcttgtttcaccttggccccagctttacctgaggggtgcttggcctgtgccttgagttccagggcctatgtttacttcaaaaatattaatgtcaattccttcaacttgttccaaagacaacagagcctctcacaagcaggcaagccctgccacttgttacgtagttgaggctgaggagcctgcaggtcccagccaactttatcacctccctcttctgaggggtggaagtccccaacatctcagggtcccctgagagtatggggattcccacatcggcaagtacctgcttcagagaagcccatgagaaactggcccagagcaagcgggtccaccctcccattgtgggaaagtgaagggcagaaggagtctggctggaggtcactcctgccactgatcttcctcactcgggtccagcctgtcagaggataaagcacagtggtgggtgggggtatctggctctcccccaccctccttctcaggggttcagtagtccctgggaacaagattcagctcaggaatttctgggatgctggtcagttctggccctaaggacactgggagtgacagcgggctgctaaggatgtgacagtgactgggctgttcccttcacatgactaccagggcaagccctggccaaatcccagcacctgctgaaagttgaagctgaccactggagtgattagattcatgacatgtggtggaggcctggggagtggagctactgggaaaggacacagctaaggaatctcctccctcccagcattgcttgaccctttcacaaagacagtggtaggtagaggaagaaggagaattggcctactccttccttttcgctgtatatggtcatagaaattgtcagaactttatatctagattcaagttctatctctagcacaattagctctaaaactttgcgaacgttacttaacctcctaggtcctctttgttcataaaacgagaacgtaatacataccttggttggctgtgaaagttatatgagtcagtgttgtggggaagttgaaggcatgcagtagatgcacaaggaaaattaaattccgttccccagttcctggcttgcaagttgggggttaaactcagttaagctcagagaagacatgacatgacgggggatcaagggagatgtgggaagctcacgggctgtggttcccactgatccacattagactccaaatgacaacaccctcacaatcccatgaaattgagcagaatttctcttctttcttgtgatgtttccagaaatgaagagagagggaaggaagacacagactctgatctttggcttcactttggttccaagacctggagctgatagtgtatggagggttgcctgtttgtccaggcactatgaataagaccaaggtaatccagcccaactctacgacacagctaagccaacaagcagctggatcttgtgtctcagcactcacagaaatgtataaatcatctgataccaactgctccccggaagcctctgtctccagaatataaatgtccaactacaggactggcaaagaaaccaagccctgggcaatgcctactatggacccttatttcttgtggtttgctaagaaaaaagtaggcccaagggagaggagggggaaaaccaggagggtctaaagttcttctgactgaaagaaaagaccacatcagagagaaagaaaggaatcagttaagtaataaaaggttgtgagttgatttatcattcaactaaacaaattatcttcctacacaaacattctgaggattaagtgaacaatataatacttttctgagctctttttgatcaaatgctttgctgttaaaggttatattcctagggagttgatactgaagcttcttgttccttgtcagtaaacacaaggagaggccaaccctctgtaaatttaaattacataaaacctttccccaaactgtctggtctcctaacagccccttttcactgaactctgtggttatggaatgtaagtatctttatcacagcagcacagacttttgaaaatttgacataatagaatttcttcctcacaaggcatatcaaacaccattgcaaactagtgggatttttaatcaagactaaagcagaggtcttttatttgtttgtttgtgcttagattatttccacatgaccaataaaatgttctctctgaccatcatccctgctgactagaagtaccaggaaccttgtctcaccctcacctccagaggtaagggtatgaacggactgtgaaaaaacacagcagaacactggggtcagcagagagaaagcgaaagaaccccatgggcagataatctaaaagcagcagagaatcaacgggaaactaacacaagtgcctgaagatggagacagcaatttttagtgattttggcttgtctctgttctatgaagctccaactcagtggcaacctagtgtgaaaatttatgaaatacttttggatttatctctgtaattccaggtctggcacaatataggtttcttgaatgaataaatggatgaacatgtcaatcaatgaatgaacagtaatattaaggaggggaagaaaaccattacaggtcaatgaatgggttcctagaagattcccctgtctcccattgtcttccgactcagggagacaacagctggagcagagtgcctagacttcgggggcttaggaggccacacatcttagagagcatttcaccatcaactgcaattcctttggcagtttgaattataatatttacttccatgatacagtcttcagctgttgtaactgctagtgacccttctctgaatccctacttcgtatgttagacattttttatatggagaattaatacagccttgactgctatgcttcttttttacttccatctctaataataagatcctcaagggtcgagactgtcatactcttgttttttgtgtttacttcactgcatatcctagagctgagtacatatggaagaatgaatcaattgatgaaatttatgaacacatgctgaggtttaaagagaatatcaactgcttggtttgatgacaaaaagcaacatcactctgtgtctagcacgtagcccagaggtgcgggccccatcctctcgtgtgaggagcccacggtgatgcataggcacctgcaccccgtgcctaaaccctgcagctggcacgggccctgtctgctcttcattcaccgttctcacgagttgcaataagttcagccctccatgtcacactgtgttttccatcctggggagtgtttcacagctatcccaagccccacgctgacgaatcacggccgaaaacacactctgatgccagcacagaccacggagcaaatgtcagacaagatcagcctcggaaaagtgagtcctgaattgcgatggaagtgggcttcctctcacaaggactttgtgtggagatgcgcaggtgggctgttggaaaagacccatggaattcccttcctctgggtgccttttctgtcccaacctctggggattcctcaagaatcggggggatttcagcacggagtgtgggactctgtctgccccaagatcagaggattcaccttggcttttggaaagaactgcccagtgtatcaggtttttatgagtcagttttagagttgggaatgcggacagatttgtaagaaagtccacagagcatatctctccacagcggagaaggctctcgagccccagaaggcaatatcacggtggcctaggtggatgtcacggggtgagaatcaaccctcagttgccacgaggaatctgaggagatccaggattacggtttttatgtaactgtcttacctctgtttcacaagggccaaaacttcagccccgttataaaatcaacagatgcagaaaagagacaagtggccactagatggcagcagatggtaagaaacgtgagttgcaggcgggctgggcaagagttaggctggaagcccctccattttgctttacatctttaatgagatatgtgaagaaaattagtcccttacatgccagacgcagatgccacagcatatggagagatgccgcacagcaatatttctctggttattaaacaggaggcacctaaccagtcattcactgcatcatcatgcagagttatcctttaggtctccggatactgttgttgacaaggtaataacagaagaaagcagttgagaagactgatgtcgggacgtgggcctctgggctcgtgggacttcaccatgccaggggatggggcacattgccagaaaatgaggagcagcccactggggccacttttccgtggccagggggacactgtggcttctgctgccaggcttagtcccagcaggcgtctgctgctctctggtccccctggcagccctcgggggctcatttattcagaagccccattaccgcgagacaattctgcggtctgacctttcaccacaaatcccaaatgggaaagggagctctgggaattttaaagagcaaaccacacttgcttctccagcaaaattgaaaagatacagcataactagagtgcattcaggtgcacatagatagggaaacacggtttccatgctgccccaaacaaaaggagggagtccagtcctgccgactgcaggaaacagcctcactcggaagacacactttttcttgggagagtgttcccaggtccagagcaggcagggattgcgcccacttccccacttctcacacttttctccaaccccaccactcagtctgactattcctttatttaattcttccacactcccaaacccaggggcttcataaggccttcagggtagctgaggaacagagaacagattattcagtccaggcaactagtccctgtctcaggcccaacaagaaactgttatcttattaacctgaaagcccagaactctcaggacttctcagagtcactcatgaagccccttaacagtcctgaaatgaagataaataatacagccatttttcgtacagagaaactgaggtataaaactgagatcagctgcagctctcctggtccccattgctttcccacagattcaaccctctgaagcatcctccagtgaaaatgtagtagcaagattcaccctaccaggatttctctccccctcttagaaaattacttcctgcgctagaaatcctcacttgtctgtgtgactttagacaactcgcttaacctctctgtgcctcacttatcatctgtaatttgagggactagaaccagatgatgactaaggcccattccagctcacagtcttgtggctaatttcccagtcctctgccagccctcaaagagagtcgtatgggacactttttccagcaacagccaaactcaacaggagcaagcagaatttccttctccaattgagaagcaatggggtggtggttggagtcttgttgatgtcctttgtccttggagtgaggcaaacagtgaggcttcagatgttattggcactaacagcagggcctggaggtggccacactcttgtggaaggaccatgcagagctgtccctgtgggcagtgtaggtgcatagccaagactgagggatgttttaataactacttctcaataagaagacctattttattctgcacaggggtgtggacccaatccaggtctcccaggaggaatctactctcacccataataggggattggttcagctcagctgcgctcacaaagggctatacagcatgcagcagtacaggcagctccccgcagctccatgtgaaaatgactcacagcagttatgaacatcaaacctcctttgatgtgttcccagacatgaagaacagccacgggaggaggagacggactctggttgctagctctgtggggtggcgcacagagggcctggacacatctggtaccatcctgaagctccaggagaaattcaggctgggtaattacctaggacttcctaggataacagagcttcctttcatctatctctctccctccctctcactgtctttctgtctccagctacaagggaattagattctccaaggaattacaacctgtttctgtaccttcacctttcccgaggagataacaattcacatccctgaataaaagttgttttattgagcacaaaatgaatgcacccccctcgctcagcatctgtgccaattgccttaaagctatagacctggcctccatcagccaagtgaaaggattttcctctgtcatggccatttccagactctcagccttttgagtagccacatggtaccttgtcctcctaataggctctcaatgatgattgaatacaaaggctctaattctctgttgcattggcagctcccaagactgggtcgatcacaatcgtccacagcagaagacagcggtgctgacggtcaaatgagcatcagggcacacagcagaaggggagggtcagccactgtcccttcatgcccatttcaacagaaagcttatttatatgcaagaggtgttccccttccagacagggttcaagagcacattggtccctggaaacttgagcaaagtcttcacggttatagaagggagtggcaaaggacatgtaggagagaatcagttccaccccatgcctgcacatttcattttctgaaatgaaaagctctcatacactcacagagatctgcacatacccacacatggaaatagcataaacagctactctttactgagcagtgaccacgtgtcaggcacaatgcctcgggcttcacatgcatcatctctaatcctcatcgacgttctgggtgtgggagtgagggcatccctgttttatggatgaggaacctaaggtcagaaaggctaagaaactttcttaagattgaacaactatggtagaagagctacaattctagatggttggattccaaagcatcatctcttaaccactgtactatggggcaatatgcttataagcaagtgcttactctgttggaggcactggggttatgagatagtgcaggaaagacatagttattcacttcgcaaagcttcatttttaccgcacactcatgcacacagtgctacacacacacatgcagagttactataactgtggtgtcttccaagagccctgtcactaaggtatcctcagtgtcgtactctcagtcctcctgcacttgaaccacagtttgaattgtgcatagggtaaagactgaggtcttctacagaaaggcctaagctgcttgaactttacagacaattatgtgagcaattcaaccttttatacattatgctgtagttacccagctcctgaactagtcatcaggtattttatttgttttttaacgtgatcaggaagtttctctgactcatttctctatctttgcagaggaacaaggtaggagagcaacaggggcaggaacagagaggatgtcaagcttgatgaaggttcagtaagtcaagtcataggtcaactagaagaaataaagcaggggaagatttggggtggggctgaagctccattgtttccatgacaccataagataagtggtgatctaggtgatctaggtgtgcaaaggtgaaacaaaacgaaagacgcaaacattgtactagtttcaggttttgccaagagcagattggctgccaaggctacttcagccttgactcatatagatccatgatctgggaggcaagacagcgtcctgctgtgctggacatctcagtgacattgacccaactgggggaactccctgaggttaagaaaacctccctccaaggctgagttaatgaactacctagatgtaagacaggagactgaaaccatttaagtcccaggaaaaatgcagacttaccttcttatgacctagatctctttgcaaatctaatgaaaaaggtttgttatgcacaaatgtttccctccaattttatttcaggagatttgtgctctttcctggactgcccctgaacctggaggtaataattctagatcaaagtctccctagaaccttgtaaagggtggactgagaagactggatatacagctctaggcaaccagtcctccactgccaccaccatgctttctaatctccaggggagcctggtcatcttgctggacaattgctgtttctcctgacaaaatccaagttaggaaactgacagggtctttgtttctatttctctctatgcctatctctcaaggtgccctgtcattaatgaatcttaatcctcacttttatttctcaactctggctcccaatttctgttttcccacccctcatctgggggagccaccggaaccccctcattaatccacagacagccatctcaggacttcatgctaagaattcattgtttcccactttcctgcatttgaacactggagggcaatgctggaccagccaaagcactctaggtgctccgctccatctttgtctcaaccttgcctgtcatttcaggaagcagcctctggttggaagccaaaaccaaggaccagtggagcgcccataggctagcagaacagctaggtctattacagcatctcccccacacgggatcataggaataaaaggtagctcacggaaaagcacatctggtttcatgggtgacacaatcccctgggaaagaaactgagcggggtgcttgcctaactgtgtcattaaccagaaacaatctgtgtctctgactaggggatgcagattcctacctgtcttcactcactcagatgtaagcccctggagggtaatgtcttagtaaggtctgcattcctgtagcaagcacagtgtttggcaacaaatacttgctggatgaataaatggatgaatgcgtgtatggatacatatgtataaaatggaactggccattttcagatttgttgttgttttctagctcttatgacacccaaagtttaaatcattaatcagttgctgagcattcttagtcttaaagacaactaaggatggtcaggtggttaattaaatcagtggttgtcattgtacaaatgttatttcaaacaccacttcaagagtttcaggtctcttatttttaggaagtccttcattgtgtcatccatgtgtcctcagacctcaccagcctgtggattacaaaatacagacactatttcattaatattcaatttacaagaacctgcgggctcatcatgtggaatattgagtatccgtgatgtccccaagtgatttgtgggcatttcatgtgccacagtgggtccccacggggcttgacagttccatggagccagagctcttcttcaggccatctttcatcatcttgtgagacttttctccaggctgctctcccctctaccttcaccacaatggatcccatgtcaggtggacatggtctactctcttaatcattcaaagcactgctaaatgtttgaggaagaaagaagagcacattttgagacccaaaacccaacttgagactctttctacctccaggcaggcttacgcatagcaaagaccagctcaaggcgcccggtagaagtctgcaggcatctccatatctccaagtgcagagagcagaggagattttttcttctcagttcaagactagttcttttcctgccctgggatgattgacagtgagaaaaaacatttcctccagggaagcgctctacctgcccctccaccttctcagacggggcccgaccttcatgaccctgacaaagcaaacctggtgctcaactgtcttattagatcttctaacactatgtgtgtgacatcaacagccctaactaaattcacacttgggaaaaatatgcccctcattctaactaaacagacaccatttaattttcctaacagaacacttactattttgacgcacgacacctgttttcagttttatgataacttcataatctccaatacaatgagtgagtgtttatttgaaatgagaataacctcattctcaactagttttctcaacagaagaagagtgctcaaagttcatctagggtctttacctacagaaattcaatgctgtcagcaatcttcaaggagcagctctgccaaaggaaaaagaaagaaagaaaaaaggaaatcctgcttttataagttatccctattattaaaatttctaacaaatctctccctacagttcaaacctaggtccccagagtatatgggcctcatccttctcataaaaatgctgttaaaaaaaaaaggtgtcctttgacacctttcctgagtgcaaacagagattgaaaaaaatcattctaaaataacatttttctgtcactgcccaatgggaggtgagttgatcataggtgaagcatgtcctattagtatgtcttgctcaggatgcctttggtgtgagtaagggatgggtttctagggcaaaatctctgttctatacccgcaaaaaacaatgtacagaaatttccctaagagaggagattggcagtcaatacataagactccataggcaggaagtgtccagggtcagctccctgcattcaaatacagacctgcatcagggctgtgatttccaggtccaaggctcggtgagtggataatgcctaaggcctgatgccaggcctgatgtccaggtttaacactgatggcaggccacagaccctcctgtcttgggattccaaaaagcccagaatctttcccagttcctactgacactaacttttgcccgggcaagaagtgtctgagattgcttcccttgagaccatagtcctttcttataattccaaaactaagcagccctgtttatgctgctgtggcagagcatggaatcttggttagtccttccaaactgcacccattgggttatccctggggaaatgatcacattacgttactttgttgaacactgaggactccaataaggactgtgaatcccaactatttctggtgtgggagccagggctttcaggtcattcaccagaaattatccaaccagaaaactttctttcaagttctgttcaaagtccagcagtttgcatacaggattcagatgagacttctaagaatcatctgtgtcttggatagagcaccctggcagcctcttgaaaatcaattccctaagaaacctatcttttagaagtggaccttcacaaagccagtgagagaatgggaggagtatgtggtttccaatgggagacatatatagacttttatgtcatgaatttctgaagtcagaccgtgacaaatgttggtcagagtacaatgcacagttgcccaaaggaggggaaattagcttggttcaggaggactaggaaatcctccccatggaagttttagttaaagtgacttaaaggatgaatgattttgacaaatgagggattggagaaggacatggcgggcagagggagtacagcttgagcaatgtccaggagggatatagaactgtgcttggggaacagtgatcacttggtgagagttgagtctgcctgagttggggcagtggagtggtgggagtggtgggctgtggcttgactgagaaagcttttgtgaatcacattaagggactagattctgttatatgggaaatgggcagaaatcacaggcatataagaggaaatgtgcttcgaagagtgcttggaaagattactatgggtgggaagactggttccaagaccggaaacaatgagatcagatgtaaagttaatacgaaactgaggtagacattgagaaggatcagaaggacttggaaagagaaaacagatttaagaaacacctcaaaaatagataaatgatatgtgggaatgaaagaaaagggagagattgtctcttcccgacatcctggctatgtactggaagattccctagttcccaagccccaaggtcttaccattagaaatcagtccttactcatttgtccattaaggcttaaggtgtcaatccttccaggaatgcttttatgtttctatggtccaaaggcttaatctccagtggcagaatgccaggtaccaatagaggagatttgggggcagtggtcttctcgggaccctcaaaaatcattacatagttgcccactcctcttatttataaagctgttcgtgtgaataagcacccaactactttgtctgtgcccatttgatcactgattgaataagaaataaaagccaaacatctatattctttttcttctctgaataatcttttcccctgtcttcagatttggaacaaggaaacccagatccagggaaaatattctaaatccttgacctccctatccagttggcactccagcccagtaaaatggcttcaagtacaacattcccccaacagcgaagacagccttcctgggagtcttgggtaggcctgtccagggccaccgtgcagcacacatacatcttcccaaccagctccactgtcacaaacaccatccacactgccatgggcaagcctctggccaccaatgccaccccacctgctctggtgtgggcacacctacagccatgccaccaacactcctcgtgcacatgtctatggtgtatctgtgcagtcacagttgtcaccagctcaattctgtgtaaccctaagtccaggcatcttggggtgaatgtctccttattcctttgtccattgtcctgctctccctttaaaattgttcatgagtgtattttgcagaaagatatgtgatcttgaaagacagagaaggaaagagatgaagtaggagagtggcaggggtgggggtacagattttgagaaaggcaagaaaaaagaaaggttccttgacctccatcagtcccaactcccaaaataagactggccctaaagatagcttattatttatcccaaattaaaattttatggctctgcaatcattgtgtacacagtgaaaagaaaaccatcacacaaaagatgcagttatcctcacagtgggaacaatagcagccaagctgattctgctccaagaatagaataacagtgctaagtcaggaactccaaaactttgtcaacaaatagaataatttcttggtgggaaaatggctatgaaagaaggtgggcaggaaagcaaccttctgactcttgaactgggcatgggttgccagggaaaattccagccttggtccctccatagtgagctcacaaccagctctgctgactggggaaaagtcctgcctgaatatgcacagactccagaaggccctcaccttacccttgcccagaatcatatacagaatctaacaggctgtacctgcttctcttgcctaaagttatgcatcattaccagatttccagctccatgatggcagaaatttcagctgatttttttttccattgtatcctcagcattcagcagaaggtttgtatatacttggcactcaataaacacttgctgaatgaacggttgattgattaatcaattaattgattaatttaaaatgagcaaaatactttctccctgtctggcttctgaagagtgagtctgagtactagaaactgtcagataggcaatagaagccacagtccacttggaaaaatgactgtttctacctttgctcatccttctgggcatcttagattcctgaaattcaggaacaaggacccaagagatcatgacccaccaagtgtctttcaacaaaagactattttcctggctgtttcctttcagagaataagcctcctggggctgataagcgaatggcaccatatgctgaaaacacaggccctgagtggcagagggcaccagagcctcctctgaggagcctgttggattgcagcctttcaacaaatctgagtgtgtcttttgatagcatcagcatcaaccacccccaaggacctctttcttttattgcttcagcaatgaagcaaccacatggctgttgtagataaggtggctcaagtgcattgtgcatgcaatgtaggctgctggtgcacagcactgagaatcgcagacacgccgtgtaccagcttctctacactgcgttgcccttcctctgtaagtggcccccaggtaaacgggtgtgattccccaccacttctcatttctcattttctatcatttttttctttgccagatggctcctgcaagactgaaatcacacagccttccaacatggccacaatgattgggacagatgtcaagttccaacgctaatataacattcctgatgggaattatgattctttgtgctggcatctgcaaagagctaaccaaaggtttacctatatctgctatcctttcaaggcaccctggaatcagagcactgctagttgtctgtggacagaaaattgttctccagaacccgaatccttaagcatgtgcagccaagagactgagccatttactgctgtgcactgtgggcaccattatgcatgctggatatcacactgaacaaacactgtaagcctcaagcagcctcaacacagaaaattcaaaagatccaccaacaacacacagggtgtttagtgtcatcttaaacttgcatcttgaatgcatcatcgattcattcattccaaactaaaagtcccttaaggctttcaaattgatgtactgagtattgtgaaggataccaacatatataacaaacacttctcaaataataaaatgtattcagcaggtacaatctcctcacttttatgttgctaaaccatgagaaattaaaattaaatcctgtataattacttgaatcttccagctgacaaataaaagtagtctttgatacacagaaggacaaatgaattgcacacacatacaaaattaaggccagcaattaacatcttaatgacatacccttaacttaccaacatttctaaaagcctggaaaaatattaaatatctatgtatacatgatatgtacagtaaatttatagatagatgatagatgaatggatacatagacaggcaagctgtaagaagcatcataaaaggactgagctcaagttcagactttaaagccagacttcttgagttttgaattccagaccttccatttactgactcaatagctatgtgaccttgggcaatttactttttgccttgctttcctcatctataaaataatgattacaataacacctacctcaggggattgttgcaggaattaagtgacctatagcacatgttactgtattcagagcaaagcttggaacatgaaaagcactcagtgagtattaactacttttgcttttgagtgtgataatatcctgaggatgattactaaatttcccctgtgttgggctgggttgagcctttaggaagttgttgataagaaatgtcagtctcttgaacaattaaacattattttctacattagtatcctatctagtaagaagtaaatatcaatggaaattcagagaaatacaattcaaaaggccttcaggacctttttcctggatggcaataaattattgagggcttcctatgtagaaaaaaaaaaaacagaggaaagtaatttctgcttgaccatcataaaataagcaaatataggctttgcgagatattaaaatacaacagtaaccccactcattaaatgaatagaatagtggaataatgtataaatttaaagccaaaagtaaaattaaagttgtttatgcacatatttttgaagtaaaatatttgtcctatcaacataaaaggcatagtagatgacctgaaaaagtttccacctccaagaagataacaaatcaagtcaaagtcacagtatgcctgacgttgtgtcatcctcaaaaactgggaagtcaggatcagtccaagactccagaagtgaggaggctctaaaagacacctccacttcagcctctgcttattcaaggccccagccatggaaactcgatggtgtgaactgctgagctgagaactgggggtaagtgaggactgtcttctctgttttcttttctgaagatgcagggtctcctgctaattcggattctgtgttttattcattagtgggaacacaaatcccctgctatcttgctagctttctcatttgcagccaacatatgggtttatcagcacggttagccccccaagaacagcccttcagggacatgggataacacaaaatgggaaattcttcttggaataaagagttggggaaggatcctttgtaaaatttggttttggggtcagatttcaaagtcttaaccctcatgggacaggcagagactcggggatatttggtgagtgactgagtccctattcctcctgagcttgcccttccccagggcacctcagagccagaactgctgaatgttaacatggggcactcaggtttcctacaggacacttacaactctggtaaccctgctgtatactctgccagtaaggaactacttagtaattcctccgagagccaacattcaaagactaatgccacgtcacatgcaatagggaaatgcagctctatctgtcattcacatctctgattctgtcattcattactccatgctaaaagtcccagtgggagaaattgtctttcttctttttcaaaaccagcttctactgaaggtaaagaaaagtttaggggtagaagaacaaagtcattacagaaccatgcattgattggtgagcactgcccaggggcaggttttgtggtaatgatccataagaagcaagcaaaattatggtggagtcgatggaatatttgagagtctctgccccaaccatctcataatcgaactgggagccctccaatctccccatgcaagccttggaggacagtcatagaagaaaaagtgagcaagaaggtttaactagctaacaagtgttcatcaagtatccataaatctcagggtacagaagtggcatttttgtattcaatcatgtatatattagtgtttgctatgtgctgtatcccatgccaagaaccaagccttcttccactgtgtaactcataccgtagcagggcttacagtctaatagaggacccaaatcagatgcttgtggaaacaagagaaatacttggttgtaataattatgggggtgttccaggaggaaagtacagattgaaattagaatatttcaatttcaggatgagttaggtgatgggagccaagaagacatgctaaaggaattaaatcctgagctgagactagatatgaaaaagtttgtttatttacatcccaagttcccaagtcagtaacagaagcagaattacaactcgagaaaggccccacttgcttctatgctgttttgctcagcagctgcttcctttggtggcacacagctgggaaagtgagtcacagatggactattggcagccaaaatttttttagagacaaatgacactgtgatttttcctgacacccattgaaattcctcactaatttccaaaaatatcttatgttgttttaaaacatccagtgaggcccagacatttcagtagaacaaatcagagaaacgaagttaattccagccatctgagcattctgagcccaaatcagctagactgagaagaagaatcgtttacttaccgaaggcagtcccaggacacccagcagctaaggtcctgactcacagcattctaaccaagagaaaacacaaacacagcatcttctcttttcattcacttctgttcctgttcttcagttgcttgtccaaccagctggagacacagcagagaaaccagaaagcaaagaaagcaattaggaacaggagaaacagctgataagcactctgcctaggtagaggtgaatcctgggcacccatcagggaaagactttgccattactaaggctttaggtgaggagtttgagggttacgaataagagataaagcaaggaaagggcttttctttgccaaatttatctttttttcacccataaaactcaaagaggatagggaaagaatgaatgtattctcaaatcaaaggaaaaatagttctaaaacttccaatgagtgagaaaatcagaagttctggcactgactcccatttatattgaagtaatactatgggtaaatattttatatcaaagaccccagagtggcagagaccatcagagaatggcattaaactgggcacgcatagtagccgatatggggttaatttgatttgaccttggcatcttttctcttcttaaagtcctcccatcctttctttatcctgtatagacaaagaagactggggtctaacttttatgtgtcttccatcctaagctgccagagacagtcctttgccaaagggcacagtagattgatactgcccatatgtctctgacacggctccactcagctcattcatttatctacccaagtcctacggcagcctaacatggctcaacagactgctgtttccctcagaggaatgttctgtgccagccttgaaataacaagttctgtgtctctcctggtaactatggctcaggcagggggctatgaccaggtcactaaccccaccatggcaaagaagaaaagacaaggcaaagaagccaatatctgtggagggcttacaaatgagtacctggcacaggaataagcccttcacaagtgttctctcatttcaacctcacagcatccctgcaaggtaactataattaccccatttgcaaataaggaaatcaagactcagagttgtaatttgtcccgctactggtaagtcacaaagcaagattcaaaaccatgggctagtagacctgcaaagtcagtgctccatttacatgtaggtaatatgggcactgataccacctaggcagtgagccacaagctattacaagcaggttctatccaagtgggaggaaccttgctctaggtacctagcaggttctatccaagtgggaggtaccacctgctgcagagtgccccacttctccctgcacctaaaacagtggataaaagacctggatttcccatgttttatcctgagttgctggcaaattctttcctaatctcagtcttcactagataagcaaccaaccctcttggttccttgagagttggggcgtctagaaatcctgcctggactagcaaatatctgtgagttcctaatattgaccagctctgcactggacattaggaatgcaaatataaataaggtactgtttatgttctaagtactcttaaagttcaatgcaggaaacaaacagattatcagagaatagaggtgataagtgtcatggcccaacatggcagggggccaggggaacgcctccctcaggtggagttaaagaagggagaagaaggatggtatggcttttccaggaagaaggagaagccagtgtaaaaactgagcatctggaagtctatgacacatctttgaacctgcaagtattttatgtggctaaagtgttgaacacaacactttcctacatctaaaatgtgcaccacacctgagatgaggctgcccgatcattccaacagtaacatctgataaaagaggccaggagttgaagtgggggcaaggggcttatctttgcagttggcttagaggggccttctttatcagttgaagagggcaggaaaggctgttaggatttttgtggagagatgttgggggtggggggtggggtgctgcacctgtctctcacaggctcctgaagaaaggttgaaaataacagcttttaatactgaataggccctctcattgtggaggcaggctgagataaacaggacttttactatcatgagtgctgtagctcattgcagtctttattgtgaaagtgttcatgtgcataagtcagataaagcaaggatggttttccattaccatcctaatcaaaatttccaaagcttttagagatagctttaattcttactctgtgaagaaggatgaatagagtcattttctgaaatgtttccacaactatttcaggtattgagtgttttatatcttcccttagctgccgaagagtcctggggatccgtaggggtgagcaggaaggggaaatgcacaggcttccttcatgccagttgctgagagagagcttagagacaaatacctgtggtaatgtggaatttctgagttgagcatgggtcaactaaattaaaataaaaatttttattcccaagtctcaagttgaaatgggtaagccaagaaggtctgagaccgcagggagaaaactcctggaggaatccactaaggagacaagtaggcagaggcgcttaaagatacaaacattaaacactcacccagggaatgccttcatcctgttggctctctttgttctgctcaaatatctgtctggcatcctctctccacctaaggttaaaaatcgggcattaggacacagagtagacataacgtaaaaattacaactaaaagtcaaccctcctgatatcttctattcaacatttcttccagtgcactattatcttcatcacatattttttatagggtacttactgttcgtggtattggaatgggtcatgggaatagcaaagttctaaggcaagttctattcaaagttctattctcaccaatgtgttttccatttatttttaaaagacagggcattagaaagtacaattaaagattacaaagaatacaaaaatataacggcacatatgataatgagggttagtgatttcatgtgcagtgctctaggagtttatgaaaggaccaattgctataagaaaatttcttaggttcgagactgcagtgagctatcgtcacatcactgcactctagcctgggtgaaagagtgagaccctgactcaaaaaaaagaagagaaatgttttttaaaaccttttttgcttttgtaaaaaaaatttatttgtatatacttagtgcaagcgcaaatttcttacttgcatatgttgcatagaggtgaagcttgggcttttagtgtacccatcacccaaatagtaaccattgtacccaataggtaatttttcaaccctcactcccctcccacctcccgacctattggagttttcagtgtctattattctactctgcatgtccatgtgtacacatcgtttagcccccacttataagtgagaacacacagtatttaactttctatttctaggaaattttacttaggataatgaccttcagttccatccatgttgctgcaaaatatattatttcattctttttcatagctgtttagtatatataccacattaagaaaattgtcttagaatagctgaagcttaaaagaggcaggagttggataagcaggaaggaaaaggaagggtatttcagggtgggtatactagttatctattgtcacatacaaatcacttcagaacttagaggctcagaacaacatttattatctcagtttccgtgggtcaaaaaatccaagtgtggcttagctgcatcctctggctcaaggtctctcatcaggctgccatcaaagtgttacctagggctgtagtcagctaaaggctcaactggaataagatacacttcgagttcactcatgtggatgttgacaggctgatatggtttgggtgtgtgttccatccagatctcatgtttaaatgtaattcccagtgttggaggtgggacctagttgaaggcactggttcatgggagaagatcccttatgaatggtttagctccatccccttggtgatgaatgagttctcgctctattagttcatgagcgagctgatcatttaaaatgagcctggtacctcctcctctctctctcttgctccctctctcaccatgtgacatgtgcccaggctctcctgccctgactacagagaaatggacattagatgtggtcaaggcatctctagagcaatggttctcaactctatccacatatttgaatcacctggggatatcctttgaaaatactagtgtctgggatacatctccagagattttgattgatttggtgtgggcttgaagctctggcttaccagatgactcaacctccttcccctcctcttgctcttccctccccctggggttgaaagcaactggcttaagaccttgctattccaagtgtagtctagacaaacacaatcagcatcacctggaaggttttgagaatgcagaatctcgtgcaccatcccagatccactgaatcagaatctgcattttaaacaagactccccaggtaaattatatgcatattaatgtttgagaagcactggtctaggcattcgtcattattgaaaacgttcatggaggtaaaaaaaaaaataaatcactctttcccaaatgtcacccaagaatccatacttgtaaaaaatctcctgaagggatactgatgtgccgccagggctcactgataggcagtcagtcatccccagttcagtttacagattatttgtgttactaccaatataataaatattcttattggggtgatagtgagtccttgtatgcttcttagaggaaggtattacataaattctaggttttatcatttctcattcatccacaagcaaataaggaagtggattaatatttactgagtcaatatactttttaccacaccacgatggattatccatggaaacccagaatcttgtgccacataccttcaattcaagatcaagccaaaaaaaaagatccacaaattattggtgtctgattaagtctgattgggaagaagaggaacaggagacacaagaatgtgtgcgtccagtggtccaatcctgcaggatgaatgaggacatgaagttctggcccgtgatggattggggtaatgtagaaccagaggttggcctggggtgagcatgaaaaatagcctagagacaaggaggaggaaatcctgggagaaaatacctggactgcccaacaatctgagggtctgcgcacaatgaaaaaagaaaccagacaaaaattaaagtaaaaaacctggagaaatttaaataattcctgtgcttactagcaggtaattaaggaagcattttatgtaacatctgaagcctcagatttagggggagacagggccactgaaggccctagcatagtaagggcatggaccaagtttctctgcagaaatcccgaagccaaatgagcgatatgaacacccactattatttttgtattattcattttctttttttctttctttctttttttttttgaaacggagtctcattctgtcacccaggctggagtgcagtggcgtgttctcagcctaccataccctcctccttccaggttcaagcaattcttctgactcagcctcccgaatagctggaattacaggcacccactaccacgcctggctaatttttgtatttttagtagagacggggtttcgccatgttggccagtctggtctcgaactcctgacctcaggcgaatcgcctgcctcagcctcccaaagtgctgggataacaggcgtgagccaccgtgaccagcctgtattgttaattttcttccccctccactggtaaggacaattgagagttgactaaattcttattattgttgcctccactgttctgctttctgtgattcttatccatcatgagaagggctgacttggaagagttcagagcagtgaagagaaatcccagagagtgtctgccaacactcaaaaagactttgaatttgatgtcagaataggaataggcttgccactctcaccagcctcccaagaagagtcattgggcaggctggatggctagaaaaagaagatacctgtctgacgcccaaaggcagctagaaggcatcctggcttcaggaacagtgccatcacctggctgccctcacaaagaggtcatccaacattgtgaaaccatgactatgagtgaaaggcaagagaaaataagggaatctgaaaccatgtgaatatgccacttcctctgcatcacgggacaccagagacgggcaacgaagagaatgttacttctatcatataacacattctcgattcggaaggtgccacagccttgagaaagtcctcattacaccatcttgaaagctctcagggatgatataggtagggtccaaataagaaaatggactcaaggaaatccaaattgtgaccttcactttgaacaattaaaattttaaacagaaaattagaatcgttgaatttgaaatccagaaaggatcttaaaaacaaagtaggaatcccctcattcagtttaaatgttcactaaatattgaatgagtaagtgatcacccagcctcaattcaaatattttcaatgacaattcttgtttcaaaaaatctgtcctataccaaatcaaaatttgcctcccataacttcatatctttatatttgttatgccttccagagcaacgcagactaagttcaccttcgcatattcaaatatttaaagatagctatcctgtataaccattcctcatgactgtctaataaattttaaactccttgagagaagcatccaagttcaatatattttcctgtaccaatgcaattcttaatagagtgactcatctgtagcgggtagtcagcaaatgtgagttgaatacatgaattaatatctatgtgtccacctgaccaacagttctactcgggtgtctcaaaggcacttcagctcaactccaagacttaaatcaagatcttccttgcaaatatggccctagcctaagattccctatctgaaggaataacaccatcatttcaaacccatccactgctctccatccactgccaccagccaggtcaaaactaccattttcttctttggattgtttctatagccttttgagtaagttagccggcctctggtactattcagtatctcctccccacagcagccagagtgatctctccaaaatacaaatatgatcatgtcatgcccctgattaaaaatccttcagtaacttcccattgcagataggcaaatgaccaaaatccctaaaagtcctctaagaccttgcacagtctgactcctcacctcttctgccatacctctcactcttctctccctcattttccaaacatgccttcttccagctattaaatacttgaatgtaccgggtgccttcccaccccagggtctttgcaacacttctcccactcctcatcccctgtttaactcctattgaaaggagttaaacaaaaaagatcaaagcctacacatccgcttttcagaggcatcttgagatctcctaacaagttcaggttgtttattctttaacgctttcatatatcagtttgtaatattttattaatttgattatgcctattttctcatgagtctgtaagctctggagatcaaggactatatctgcatttgcttattcaacctgacaaatcgcataaacatagctgtgtgaataaatgaatgaatttcccacattctgggacttcccagaatttgatcatcatcacagactctgggctgcagtggggcctcaagccttgccatattctcactttttaggggtctcggagactccagtgtcatcctgagctggagtccaaggcttcttagaaaccactgatttctactcattctgtctggcatactcaagagcccattcttgggcacacaggacaactgaacaggattggagggtccttcataggtctgagccagctcccacatagggaccctgaacaggtaagtaaaacctgcccagagagtctagctagacatgaagaaatcagaggggcccaaaatgattattattttctcagtgactactggctgggcttatgatgatccctcttggtgtttttcattttgcatggctattttcagtagctgtatcattaaaatacacaagtctataattatggggatgcatatcctcatccctcaaatatgtactgagcacgcacaatattcctggtcctgtgccacacgctcggttacaaaggcagccaaagctcaattcctgtcctcaaggtgctcttcctagtggaagaaacagacatgaaaatagaaacttactaacagagaaaggagcaaaccaaacacagagaaggaagtgatggcctagagatggggagggcgtctcagaggaggtgacacgggctcataacagaaaaagcacttgtttccccgaggtaaggtgtgcttgcaggttccttaagatgacccaggagggaagatgagcatcctcaacagttacacacaaacacactcaccttcatctctgatgcttgcagtgaaaataaataactgaaaataggcccaacgtgctgtctcatgcctgtaatcccaacactttttttctttgtttgtttgtttgtttgtttgtttttaatcccaacactttgagatgccaatatgggaggattgcttgggcccaggagttcaagaccagcctgggcgacaaagcaagaccccatctctattaaaataaaaagaaaacataaaatattgaaaaacagccaaaaatatgctgaaaaccaccatggcacatgtatacctatgtaacaaacctgcacactctgcacttgtatcctggaacttaaagtaaaataaaaaatttttaaattaaaaaaatgaaactaaataaactgaaattttatggaaaaatacaaaaccccagactagacacaatcagcttctttttgtgggaaaatgaatttatatcaaagctttcataggggttctataaccacagaatgtagttagttccctgccaagtaaaacttagatacttccaaaatgctgctattgtacacaccgcagaacagagcagccaaaatggtagtggtatgggttgggaagataaagaattaagaaaagtaaagtggaaggggagaggaaaaggagaatattatttccttgaatgatgatcactccttttattaataactttctgttcttattaaagagatgtcccaaacctctgggctttcccagaatttggtaccactggtgcactgacctatcctcatcctgccaatgtgaggaaacccagagagactagtcaaatcccctgcagagcagcaaccacgccagtggggctggctgtgaactttcactttggtgtgttctttgatttcatttggtgtgaaatattgagatttctcctcagatatcccagcgccttgtagctgcactggatctataaatctttatctgggctagattgaaccattttcatttatggagttgtttttaatcagagcaagagtaaaacttttgccctgtacaaaagagtcagctgtaaactgagccattctgcttcagctttcagcttctcctctgaagttgtgtctcttctgagagctctggaataaaacagctgccatagtcatctcacccttccatattttcctctttgtattagtcagctctgctatggtaactaacagtgccaggacctcagtggcttacagcaatgaacatttactttttgttcccacttttactaccaattggctgctgagctctgctccctctgtcttcccattccagagcccaagatgaaagataagccactatttgggacacactttttttttctgacaggatctcactctgttgccgagaggctgaagtgcaatggtgcgatctcagctcactgcagcctcaacctcctgggctcaagcgattctcccacctcagcctcccaagtagctgggactacaggtgtgcatgccaccatacctggctaattttttattttattttattttattttgtagagatggggtttttccatgttgcccaggccagtctcgaactactgggctcaagcagtccacctgccttaaccacccaaagtgctgagattataggcatgagccaccatgcccctccacactgtttttatgacagaagaaaaagaacaagagaaatgctagcagaaactccagatacttcttaaaacttctgctcagacacagcagacattatgtccactcacattcatcagccaaagcccttccatggtcaagcacaagatcaactagtcggggactcacacctttcctgcagaaggcactgcaagacacatagcaatgggtaggaagcaataaccctttttcatggaaagaaggatcaaatacttcagaataataattataacctaccataccctttaactccacccatgtaatttgtctccatcctggggagtttctcctgctgtcaacttaaaaggaatttaaaatgattttttttcttcttggaattcttctggggcaagatttgcccaattattcttcagaatgtcaccatccctcaagatgttaacagtggttgcacaatttaaaagaattccaccatcagataattttggcaaatgctacatattaatagcctcctcttaatatttacaattcttattaccatattaaatgctctgagaacccctgctgtaaagatacctatttaacgtgggattggaatcacagaattctttttgtaatggcacagccattaagacttacgaaattctataggcaaataccgtcccaaaggattacgcaggattcagtcagatagattcctgctgtttcctcatttctgtgcatccagactgaaggatacctaatgacgttgagaggagctatgcataaggccaatgggtctgtacaggcctcaaaaagaaggcttgcattttttgctaagaccaaactcaatgtcagaaacctgaaaatgttattcagatactactctttgtctactgaattaagtataaacacttcagactgtcttttgctccttcctttctttctgcaacaaacgtatcttgagtcctactaggtgccaagtactatgccaggcattgagtacacggtatgagcaaaacagacatgcaccctgccctgtggacttgccagtttaaaataagagagacagacagaagacagggatatgagtaaatagccagtgatcatacaacctcccagtggttagctacaccgttggccacccattcctccttgaaatgctttccacacttagcttctgagatgccactcttggctgattttcctcttcatcactggcttctccttctcagtcccccttgctggctcctcctccactacacagcttctaaatactaaagcagccagggtctatcttctctcctctatctctccctagatgatctcattcaccctcatagcattaatttcacatatgtgcccatgactcccaaatttatatctccagtgcaaaactctcctctgaggatataatcttcccccaattgaaccgccttagcacttcccactcttgagttatttcatgtgttttctcttttgccatgattgttttcatacttccttcatcctcttcctgacttataaacccctcgaggcggggatccttggtctgtttcatcttcagtttccgtagtgcattgcagagtaactgtttaatatatgattattgaatttaatgtttgaactgaatttctgctttagggatcactgagacacagatgtaatgaaagggaatattttatttaaagaaataatgcctcatccttctgtatttccaaatgaacaacctcaaatgagagaacacagctacagacattagcatgaggtgaatacttaagtttaaaaatgctaaatcaagccagtatcatcccttgtggtcacagcagctgctgctgcaaaggttttataaattgcctacattcccgcaccccatctggcgatgctggtgtgttacagccatggatgacttactcttcacaatagccttcacttggatctattccctactttaaaataaaaagacaaaaagaaggtgccaaagggcttgcctaaagtgctcccacccaacaagagtacaattcaaccacataatgctgcctcctcagcatttagaagattagattcagggccaaaggggaggtcagaagaggaaggccccctggtttgcagaaaggtgtttcaccatcagttctaataatagcatgtggcagctgcacttctggtccttcctctgcattttaatcccattattttctaagcctctcccaaggcctcctttaccagtcaaaatcagccaaggtttcatatgcccttagaagaaaagaggactgatagaacctaagtatcaactagagaaaagccaagagcttttcgtgctggatgatccgtctgagtccgggttcctgattgccacacagggaggccctgactatagtgtggacattggttcctttgcatagctccctcttgtgtatacacagaggctgctttttctcatcttgtttgccctaaaacattttttgacttagcctccacatacttgaaacttagagtttaacctgtcaaaatcagagggaaattgactgaattgcatctctttcacgaaaacaaacatcttccaactgccatggcattttagactgccctttctgctagtgttgcttccctattgcatttccctggataaacatctagtttgtgccataatatttattaacaaggagtcctctgggcagacggtggcattaggaatttctgcttggcatttggtatgctgtccagctgagtccccaaccatgttgtgagtcaatgcgaacacagcaggtttcaataaaggcaacagttatctaagcaggctgcagccgtgactctcagctcagcctctgggtcaccaatctgggacgtgagctggcacctcgttaaaaaaggtattctgacagagagatggctgtcagtggactcttccaaaaattctctttccctgggttcttctagtccatctccttggcatgtgccattccctatgcatcttttgttagactacatctctggtttctcaccacagcctggacactgctgatgggctagattgataccgtatgctttgtcatgcaccgtgatcccactcacaatgttattccagtgggatagatgctgagatggttcaccatgcaagaggaatcgtgctgcacgtagtattttctttgccctcctttggtaacttcgcaagttcccacagtcactactcagttatgcacgtgtgctaactcaggctcagactactttgcgattagagccctgccaattggatagcttgtatttctattcaataatcttttcattcactcatactaaacattcattccatagctcaatgttaagagccctttaacttgtcatatacatgatgactataacagcactcgcattctaagctaggctttaacacagcgctacagtggtgattatagaacagccactctgaactgcggcttctctagctgtggtgaatgttataaagaaagtgtatttactctagtccttgcccttttaccagtccccacacactaccaaactcaatataaaccccacataaccagcaagaatatctgaggtgtgcaggttatggcaatgggacagcagcagacgcacagtgggtgaggttcctgggacatgaccaggacactggtttatagtggcccaagctgctgtaagtctaagatcccactcaaatactgtactcactttcccacttgatggtttaggaactcttttctagcccccaaagctacattctgagccactttttttttaaacctacacagctgccttcccaaaagtatcctgcagtaattccatgttcctcctccattgtttcctcgttagctctgactccatgttctggcaatctttcagcctcattcctttttcctcccagtctgtaataaaactaagcaaaaggtagtaggtatattagctcaagaattgggatgtacctgtggaactgttgcgtgatgcaagtttttgtcaatgactatgggagcccctggcacggagggccgggcccaccacccctctcccaagggaaagaggacaagtccccatccatctgtcttctcccctcctctggcatcatagacccaccccagtagatagggtcatctcactgtctcccattggaggtggagtgggggagggtctcactcccagaaatgctcctacagctttctcctctcccttggattgaaggatgaaaggtagttatttgcttccccataggggatgaagcagggagtttccctagggttctgggagggcccacccttgtcaccaccctgtggtgccccaggggtaatcggccaactgaaggaatgtaagatctatataataaaatcttaattccacagaagtatgattccagccacaaaatttaagctctctatagacactaaacactctacatttccataagtcccaccaccaaaggaggagaaaagagcatttatattctctctaacactgcgctatcccctcagcctactcccaaccaagaatcttgagcaaaattctttgctccacttcagaggaggaaagtgggaaatgttttttcctgtgtgcagagactactacaaagagggaggggctcctgttcgggcccatttaaactaattttccatctgctcccaatccaggtttttccagttttacctctttattgggatattgttgaatggaagcacataattaccattattttattttttataaatgggcttctacaaacaaaaacacaggattagtctattattagcatgaaaacctgtgccgtggcttctctgagttctacctggggaccagcacacccccactgtcttccagcgagcagaacaaatcaaagaggatttccagagacagcaataactttacattccacccactgctctccctggggcagcaaatcttcactgtgaaatctgcaattccaggagagcagaaagcaatctatctccctccaaaaacaagttgccatttcagggactggacacattttcactcctaatggtaggtctccttggattactatggtctgccatgagcctgggaattgtaagacaaaaacagaggaaggaaggaaggaaggaaggaaggaaggaaggaaggaaggaaggaagggagggagggagggagggagggagggagggagggagggagggagggagggaaaaagaatgcaaagttgaaatatagcaagaacccattactctatgagtccagtgcgctacaggctgggttccatctcaaacacacacacagtgatgtcccaatgtaaggaatcccaactgaattctacctctcagaagggagctggataggacaaaatttctatctgaaaggtcagagcaggattaggaggagaaaccaagaacacagacttagcccatttcaactagcacagaaggacccagaatgccaggtatgatagcacctaacaaatatttactaagcacccactaagtgcccagcactgttgaaagagatcaagggaacagggagatggttggtgctgacctaagtttgtaagaagtgagcaatcaccaggcagcaaaggtgttgggggtccgcgctggtcatagagaaaggacaaggagcagaagactggccgatcccaatgccacagcaggccctatggtcacaggtgacacctcttccttgtcccctcagtacaacagtgtataagcctttactgtcctacaattcttctttttgttacacagtggctttcaaccctggctgcacatcagaattatctaaggaagttattaaaatcctgttgcccaaaacccaccccagactaatgaaatcagactccgtgggggtggcacctaggcttcagtagttcttaaaactcccccggtggtcccagtgtggggccaagattgaaaaccattgcatggaggtaattgtcctaattacctctccagcttttctctgcctctacattcctcttatctaagctgttatattgcctttttatttttagtttgttctactttgtcctttcagtagataattctataatactccattaaaccttttttcatgctttaactttgttttttctcatttaattttcatcgcccactctacttactccctcttcccattatgtttgttttgttttgtgttttctttaattcagcatcaacatttgcagggcacttgatatggacagagtacggcagcaggcatttaactgctgctaaaaattatatttaacgcagtaatattttgtgttagatcctgtgccgtggctacaggctcttgtcttatggaagattggcactttggcttcttccttggaagtagctgcattgctgtataaatttaagatccaaaataagtatattacaataaaaaataaaagaagcatccacaaatatgagggaaagaagcattaacagcagtctgaagctaaatatcaacatcacccctgccaagctcttggcctcattgtaggtggaagacgctgccatgtgcaacaaaaagagaaagggcccaggctgcatgcacaactaacgaggctgttccctgaggaaagggcatttgctgatttagactcatttcctcaaggtcctcaagcaagcccaagagtacataggccagtcgctgagacactgaaagttgagatgtggaagaaagggccaacagactgtcccagaagcagaatgcttcagtcctccagggaagctttgggggagatctgccctcgtgtcctcctacagctcagctgagagcagccctggagcctcagaaccacaggccctgtagttccctgggtctggcaaacccctgggagaacaaatcactgtcctccccacagagccagcccagcactgagaacaccatacaagccagaggatgcttgccaaatagatgcatgaacgaacgaatgaatgaatgaatgactcctctgatgaagttgtcccagggagagtttgtgggaatactgaaaaggagggtggtccccaagctggtaccccagtccttgatactctgatgtggctttttaatttctctgtcttccttttaccttgatgtatttattctctatcaatctatttgtttatttatttatttactttaggaatcaagccagacaccttgttggagcaacaagagctagagatatttgttccttttagaagaagcaaaattttccagtgccaactgacagggaagaagatgaataattacactatgtcctggtaaagaggacccgagacggcttcctgattttcgtacatcaacaaggagacgtctatgaccctggtctccagcacacctttcttggtagagttgagaattcaaccagccagttcttcctggagattctcagagccacattgagagagcagaggacttacaagtgctgccctatccatggtgactccccttggcctctaggtaagtcacacactgaagcctgcccctcccaccttccaccctggtcagctaatctaggttagtgcaggtctaacctagattacaaggcgtgctcgtgtgcataatttcatgaccaccaacaaccacatggggcaacgttatccccattttattgtccaggaaaccgaggcctggtgtggtaagtgacttgcaagtaagaggaggagtgagatgtaaacccagattcctgaatctaaattcagtggtctgtactgcagcatagctgccgcctcttgagaactagagtgggcagtgtggaagtgggaattcccaagttcccaggcctcttccagctcagtcttctatgtaaaatttttcttttccaggcttgtctgagcagaggtagagtgaccctgccgcctgttcctcaacagtctgtgcaaattcaaagaaatagagtgtgaattcaaggaactcatttgaagaacaggaaaagcaactctctccttgaggttatcggggaaatgaaggttgaaacatggatcagaagacttgctgaggtcccttccaccctcagctcttccattctgttcccaaatgaggcccaaaacacagctttctccatcactctttaatctgttggttgatttgtctggtgcacccaaccagcactgtggccctgaaaataaaatgttaattacatcaatcttacagccatccatcgctagccatctgatgctgatagaaaggcaggaagcactcgtggcagtttgcatatcagggtcagcagttcctttcttaaccctcctctgtctggcaaggctaagggagcagacgttcctgtaatgacctggcctgtctttagagctgcagccctaagagctggttttcttcctgtggctatggtcttggcactgagctccttcctgctcttcttttgctcttgtgtgtagcggaccacaacatgctttcagatcagacatcctgtgggcagaagaaattatttcacttcaataagaatttttgaagaccagtatgggttcaacgggtgcttttgggggattacaccagagataagaacagactaaatcacacgcgtgaggcagcatttacaaatcatacaacacaatatgcaatagcagcttctgagtttctgcagaggaaaggctaaggacagcaacctggttggaagatgcctcaggaacttgccttgaggctgtattttcatagcacataagattgggaaagacatcaaagaatgggaaaccttccattctggagagatggagattatgggggagaatggataaagcccccaaaaacactcttgcctctcctactaactgttcaagtctcaggtatcattatttgtatgacaaagagaaaattaacatcgttaagcaatgagccaagtgtttacaagtataatttcatttatttctcacagaaatcctatgagttatcttctcccattttacggagtataaaaaaattagttttttctagaaatcacatgaagggacagacatccccttggcaggaccaaggaagctgtggcctaattgctggccttgacacgaaggaatgactgagcacaaagaacacagcctacacagggccggaggagggttgggtctgagggcagagccctggtggatgtttctgccttccacctgggcaccctgagacaggctgtgttttttttgaagttccatcttgtcctgccacaggcccaggccaagctgactgctcctgacctggtgaagcactagccacactctgccccaagctcccgccgcatcatcacctgtcctctcctgtactgtcttctacctctggctttgatttattgttcataccagctttctctcttagtcaggcctagaggaaggttgtttttggccattaacaataaattcttaaaattccctctaaccggtggaagatataaatcacagtcataaacataatacacattcttgggacttttcaaaatgacttcctgaataatttgagatagttcaacaataattttctaagaaagacaggcttatttgagccctgctaactactcttttgatattaatacagctttaaaccctctatacttctttctgcctcaaggcttttttaatacatgtcctcatttgttacatagaatgttatttccccacccatgccccatacctgtttcaggcagggtccaagcaggagacagggcactctcggagtgattagagagagtttaatgaaagggacttttacaaagctgtggacaggtgttatggattgaaatgtgtcccccaagggacacattaactctcagtaccttagaatgtgatcttatttggaaatagggtcactgcagatgtagttaccttaaatgagttcatactggagtatggtgggcccctaatgcaatatgactggcattctatatgacagccaagtgaagacaaagacacgcagggagagaaaaccatgagacagtgcaggcggagactggagtgatacaggtgcgagccaagccaaagaccatcagagtttccagcaaaccaccaaaatctaggaagaggtgaggaaggattcccctacaggtttcagagggtgcatggccctgctgacaccttgatttcaaactttcagcttccagaactgtgaaacaatacgtttatattgttttaactacccagtttgtggtactttgttaaggcagctacaggaaattaatacagaagggttatgggaaaccaaaaagaaggtggtgaaacacccagggctggcaacaaagaaccgctgccatgccaggcctgaagcgtgtaggggaggagccttcactgaaacctgcagctgtggaagaggagttatagcttccagtgaaggaaggcactctcctccttccctccagtctcctgaaggtgtctccattggccaaaccaaatgggatggagagccggtggatgctgccaattaaggtcaggctcagagtaagaagtagagtggatgtgcagaggcaaacagactcagtctcaactgcaatgccacttcctcttcagggaagccttccctgacctcctgaccaaacctggcctctgtaacatgctcccatagtccttctgcttctgcagaatacttatagctgcaatggagggataaattatgcaaattattaagtgatgactggctctcatgctagaacataagctccatgaaagaaaacactgtgtctgccattcatcaatggcagaccctgaatcctgagggcctggcatatagtaagaatgactaggttttataggatgtgccaagaactaagcagcctgatagaaaaaggtcaagtatttaagtccaaacagattgaccttggcaattttcaaagagctatagacagcagacagcattatgttctgctgggggacagggttgctgatgatataatgtgtaacatcaaagaatgtgaccaccttgaatacttgctaatagtcctccaagagcagtaggcaggatgggcagttgtgcaaagtgaggcgaggcagaggtgggtggggagagcaactactatggggtcaagaaacttcatctgctcctatctgaatttttttcagggcagtctgttcccagtcacactggggaacttaagaaagcttagatgagtctttcctccactaacctgggaatgtaagtcctgcatccaccctccaatatggaagccacctttgctcttgcctttttgcttaccaagtgactctcttcccagcttctgctgcactctctagttctcattattaatttacctgtttgatttcaaaatttcaaagattgacctttaaactcaaaagtggaggtcccaaaaatcctaacctcccctcttttgaagtccatgtaaatttagcccgtcataagttgagatgtagtagtggtttctaagttttttacaatgtttggctttgtgtaatttaacacaggtaacctaagaacccttcagaaaagaagctagatgagctcaataaagatcaggaaactctggctcacatttggaagaccatgtttcattggattgctctttaacacatgggtaaatcacccttatccaactttgcctagagggagtttgcagtgaacacaacaatcattacaacatcttcagtctttgtgcacatgctattgatctcctcatttggtggttcttttgattacagctgtaaatgccaataattcttcttggtatgaactatgaacatcaccacatagtgtctaacatgtacatctaacctgaaactggaacaacaatatcaaatttaacgtctagggaaggaagcagaaaccctgtcaccaattaaataagctgccttaatctcctctcagttggcctaacttacctgaaccgtactattggtcttgaaggtggcactgtcatcccattagcaggcagcaggccctgcgagcctcctgtgatcagctagatttctctggggaatgaaacagctgctgatagggactgacttcctcagtcacaagtgtttcacaagtgtgttggttcagaggagggaccaggcagaaggtggttgagaggcagagctgcccctgagtgagccatgcagaggatctcctccctcatccatctctctctcttctgggcaggtaaggcagaccccagaacttgggccaagcaagactcagcagcaaagaaacatcaaggctcacaggaccttgtactcatggactgtgctccttactcaatgacctcagcccccagccctcactgagcccctctcttgtgtcttttctctcaggagtcatgtcagccattgagttggtgcctgaacaccaaacagtgcctgtgtcaataggggtccctgccaccctcaggtgctccatgaaaggagaagcgatcggtaactactatatcaactggtacaggaagacccaaggtaacacaatgactttcatataccgagaaaaggacatctatggccctggtttcaaagacaatttccaaggtgacattgatattgcaaagaacctggctgtacttaagatacttgcaccatcagagagagatgaagggtcttactactgtgcctgtgacacccaccctgctgcagctctacttctgagcagctcaaaaaccactgaccaggcgcggtggctcacacctgtaatcccagcactttgggaggccgaggtgggtggatcacgaggtcaggagatcgagaccatcctggctaatacggtgaaaccccgtccctactaaaaatacaaaaaaaaaaaattagctggtcgtggtggcgggcacctgcagtccgagctactcaggaggctgaggcaggagaatagcgtgaacctgggaggcggagcttgcagtgagccgaggtcatgccactgcactccagcctgggagacagagcaagagtccatctcaaaaaaaaaaaaaaaagaacattgccatccatgtagagcagcaattccaacaagatcgtgattttctcttgaataaataatttaggaaatagggaccagagaaagctagtgtttctacctttctttcaggctcagccactcagcttgcccgtgccctcccatggtgctcagataggcagcccccagtgggacagaagagaggagagatggagccaaaggaatgaactgtagcatctactgtgacagttttcttggaggctcataaaaggtatgaccacagagccacagtgcttagagtatagcatagattaaggaggcaccttacaatttacaactatgggtgacatccagtttttccccagccacatgcctctgaatttacatgttctagaggaaaaggactggcagtggggggaggctcctctccctccttcagatcaaatatgtacactacctgtcattttgcccaacatggaaggaaaggctacatctctagcatctctagcatgctctgttgttttgatgattactgactggatattttgttttgctttgttttgttttcttcatgagacggggtcttgctgtgtcccccaggctagagtgcagtggcgtgatcatagctcactgcagcctcacactcctgggcccaagctggatatggtgttttgctctccctttcttctctatctctttacttccacatgtgctagaaacaaaacgttgaaaaattgcttccactggcacttccttatccttctttggacagctcaatttaacactgcacttttatcttgaacaatgtgtttttccagatttagatgattgacggggctctctactccaaggctgaacctgtggcagaaatcagccttccttctgtcctcatctagaaaatctaccacttaccttgttaaataacctcataagaacttgtggtgatagacatggtcagtgacttgattgcggtgatagtttcacagatgtacaggcatatcaaactcatcagattagacactctaaatgtgtacagtttatttcacatcaagtatacctcaatacacttgtaaaaatatttgtttaaacccaaaatggattttttaggcttctttggactacttcaggcaacgtctacacaaaatgttcttcaacaaacccctctagtcaaatatcctctagtcaaatatcttccacagaagtacaaagaggctgacagggcttgccacaccttatttggtttcagtcagggcttttcactgttttgccaagtgtcttcccaatcctctctcctctcatgattctgcctgacctttcatatatataatacatgttatatatatatgttataatgtgtcgttgttccatgcattttagtcatgactgcccccatgagctcttatcatttatctccccaaatagctatattctaaaccttcagaaaatctctcttctctactcttcatcccaaactcactcactttgacctgatgcatgatcccaacataggcctggaacctgccttctacctttctgccccaccccattgggcaacttctttggttgaacggtctgcaaggccctggatactggctctgcccttggacaaaatcgggttcccaaatccccatccagatacagcactctgagctccacgatcttggaaggggtttggacccagccttccccagatgtatttaaacagagggcctgtcatgattcatcaagcccactgcctgccactcagatctaattctccttctttgaacaaatgataggcaagaaggtggagtgcatctccaacatggagaggatacaattattctcctagtttgaaatcatgatttggaaaaagaatgacatctggaaaactggttatgcagatgtcaaagttgtggagccatggttttataacgcctgcaagatggattcctagtaagaccccaagtgactccctctaacagagactgggaagagtgtctctaaggagaaggaggggaaaaaatatctggacaaatccataagactgtatgtcttccgtattaataactaatatctgttgagtgcttactatgtgccaggcagcattctaagcacttaacgtgtgttatatgattaatcttcacaacaaccttagtatttactttctattcttgtcctcattttacaaatgagaaccccaaggcacagaaaacctaaaatacttgcccaaagtagcatagctagtaagggagggtgacagatttcagactcttgatgctgcaccagaggacacagcatgtaatttggggagatgggggacccatagagaaagccaccttcaggatgtgtcagaaccaagggacaacaggggctgtgccctcaccaccaaacctgttccaattgatactcccgtgaccatctgtcaaaaaactgggacaacagaacaatggtcccaaatgacctctcaagtgttttctaactgagattttgtgatcctgacacaagcttcacactgtcttctaaaatcatctgcatctcttcatctgtgaaatggggataataagagttctaccttcactgtgttataaaatatataattatagaaagtaaataaattgcatagcttatagtagctatttaataaatgttacctattataagaaaaagcaaactgcaaggaagaataattgagaagaaagtgaactaaattactgagcaccaacgaaatgcagccactttacaggtatggactcacttatcctatgacaactcagtgaggtcattatcatcctttctgttttgcaagtgaggatactgagactcagacaggctggacagcttgcttacagaagcagagccaggatccggatctgacttgaagcctgattgtcctggctgggatactgggctgggagctgcggaatgtcctaaagaaataccttacctatagcaacatctcatgtaaaggatggctgggaacaggtatgtgaagtctggtcatctttgctcatgcaaagattgctcttgactccttggccagtttccagaagaagggatagtaggaggtcttcaactccttccccctgcctcctctcccctgctttaaaacaccaattgtaatttcagcttccaggttgttctcccgagatggctcactcccctgactgaaggaagacagctactccccagcccactgccactcacactcctgagcaccacccctaggtcagcagcttttctcccagggtacaccatgagaaacatgagagactggcccacatattccctccttctgatgcttgtcaaaggtagtctcttgttggactcccttagatcctcggggtgctcatggattcactgccttttcctctccttttcaggggcttgcctggagcgaaaaccataggggtccaaggccggcataatgagagctagaaaaattccctgggtttctgtcaggtccatagagttggtgactttaccacccacatatatctttgctgtcaagcaaagtgtgcaagtttgtctcttccgttgtcatcgacttatcacttatacagaggcagcaatggggcttgagatctgacaaccacaattctctgcattcaaaagtgagcacacgggtaccagaaaacactgcggtggatgaaggtgcaggagccaccgtgtaaagaatagaaattaatttctaactaaatgtctctgctttagttagggtcttagtccactgcagtatcttaaacaatacatattcaatgataaattttccataatgacaaggtgaacaaactcagaatcaaagctcctttcctactcttcaattcaacacattaccctaaaatattaattgaaatgataggattatacagctttttttttttgtcagagcactttattcattctttcagtaaataccatctctcatatctgcttaatttttctccacagcatttatcactatttggcatgctacatattttacttgtttatattttgttgtctggctctccactggaatacaaggtccttgatggcagagatgagtttttgtctgttttgttcactgctttaactccagcacttagaataactttggcccataacagacactcaataaatgtattaaatgaatgagggaatgaaatacatatgagtgagtgctacgtaccctgcactgagctggatgccagggacacagtggtgcacaaggctggtgcggactctgccttctgagatgttctccccaagcctcatctacccactaaaaaaatgctactgaccgtaacaagattttctgaagagttgattatagagtactctggaacaccaaataacttactcttggagagcagacatcgaggctcctaagtgcattggatgttagcaggggcaaaatgaagaaaatagtagctttctcttttctccaccttttctctcttttgagtcccaagggccccagccctgagtctgaggctgtcaaagaaaaagcgaaacacttctgttttatttcacaaaggaatttcgcaacgcttctctccaaacagactggctggggcatgctatttcacaatgaaaagccacgataacacagtttcctaaacaaaggggcgattcctaactccctctcactttatcaccactgccaccaaatgattttggtattcttcaagaatacagaatccactgggtctttttgggctttttagcaatttacacatccacaaacacataggtttatgagcggtaacagcgtacattccagtgcatgaaacactgcagggattctctgaaggcgtgccctggatgctgcaaggctccaaggcaacagtcagccagtggaacagtgtgccacccagcatgctcgacttgatagaaaaaagacccagtgacagggcaaaggaagtcaagccaacatgcaattgcttgtattaatttaaataaagccaggttctcaaactccatgtttaaataagaaatctaacagtcataagttttctttttacctgcatgcatatgggagaatagggaaagtttaaattatctttctggcttaaggacaaaattgcatgagtatttataactttcagaaaaagaaatgtcagtctaaatatattactagggcaacaaattattaagaaaaaaaacccaaagtacagtcttttggaaattaaagttgctttcatagaatatagcagcattcactcagtaacaattcattaagtacctcgtatgtgccagacgcttttctagacacaatggaagcacagctctcagaatctcaggagcttatatttcagtggaaataaacacaaaataaaataagtaaaatatatgtcagatggagataattgccatggagaggagtaaaacaggcggggagagagagagtgttgtcagcaggcttgcagaaattacaattttaaatcaggttgtcaagaagggatacaataagaaggtgacatttcagcaaaggcctgcgtgtaggcagggagcccagtatttggagtgtggatgtttgctggactccctctgttagaaataacattttcatgcacattcttaagacataatcataccagcttttctgtaggttagggagataaggagtcattttttctttcttatcttgctaagagctctttcacaagtagttcacactttcatttttcaaaatcaagcgatgaaatgccattaattagcacaaagtgtgttggggagtggacgcgagggtttggcaaggaagcagtcctgaaaagatcaaaacttacaacatgaacaggaagatgacagcactgattattgacaaacggaaaatggggcatggcattttgagccctttgccttgagtctctccctagtcacgtgaccacattctgtggactggtgagtgtttcttccccaaccacagggataagaatacaaagtgagtgatgcatttctctcactggtccccagatgactccactctagcagccccggaaaagaacctgcagcctcatctatacctgcaggttgatgtgcctcccaaaaactgtctcactcagttgtggagctgaaatcaatcatgtgttcacctcagtggggttcttggtttttcttttctggcttctccaaaaagccaatcatagagaaacctgaggactgtggagccactatggagaaggctggagtgcctttaccatccctagctcagctttagggattcaccctccaggacctctgagtgtgctgggatcacacggcctaaggtaggccctagagtcagtttctgtctttacctgccacctgacaggagtgagaagttttacttagaggcagtgagaagggaagtcagcagccccagggacagtacaaaggagacacagcctgagtgtgtgttgtcagaagctctgtcacagcgaaggcctcctcgggcataaagacctcactgtgtttgcataacacctgtgttataatcgtgagtgatcaataaaggattaactgcctcagtcatctaaggaaatgaagaagggttttatgcaccaagttcataaataaggacacagaaaaaaaccacgaaggccagtgtagctgcctctgtacgttgaaattagagaactggtacaataacaataacccacctctgtagtaagaatcaatgtaaaatctttgagttcatagctagtccatttctcagcatcaaaaccatcattttgctttctgtatggaggacgtccacccccacatatgcacactcagagtgtcagagcaatgagaaaccaattaccatcaggctccacctctttggttgaagacatagaaactgatgaatgaagaaattaagtgacttttccaacatcacacatatagtgcagacaggtaaagtgatatactgtacttctgtctctttcctccaatatcctagaagtcaagggctaagaaaagacagaaagggtaaaccatgtgatcatgccaaagtgaaagaaaaatggcagcggagtgttctccacattccagacaactacctcctgccaccttctaggtggcaatgcagtccaggtaggtaaagcgatatacaaaaataaatagccttaatcattcacaaaaatattaatgtgtgtcaaatttaaaaacaatgaattgcaaattgcccctaactttggcaagatcctttcacctaccttaaaatggacaagtttacaaatttgggctataaactgcatataagtttttgttggttttttttcttccttgagacggagtatcactcttgttgcccaggctggagtgcaatggcacaatctcagctcactgcaacctctgcctcccaggttcaagtgattctcctgcctcagcctcccgagtagctgggattacaggcaggcacaaccacgctcagctattttttgtatttttagtagagacgaggtttcaccacgttggccaggctggtctcgaactcctgacctcaggtgatccacctgccttggccttccaaagtgctacgattacagatgtgagccaccatgcccggacacatatgagtttttataagtaagttcttttagtagtgaaaaaagcataggctctggaatcagagaaaaatagaatcacaacccctcacttcatagttctgtgaccttgaaaaatgttgctttaacttttctaaccctctattccctcatccacaaaataaggataataattgcatagagttatcataatgatcaaattaaataattgcaagtaagtacctgagtgactacaaagcagaggtgctcaataatactaactccattcctttcagcacccgatggtctgcagtagagcggttcaccctctactccagacagaaggagacagaaaagacagaaaagctagaatgggagagaacatggccaatgaccaccagcatttttccaaaccaagaaatctaaagtgcctatcagcacattttttataaaaatacctcctcaggaatgttcttcccacacaacctctctaaatcctttccctgcactaatgatagtgaaggtcccaaaggcaagaccatcactgggagggtctagctccccaacaagagatgatgccctcattgcccttcatttgcagagatgaaggtgacacaggtcaatgtcagcttcaccaatagtaacagggagagtaattttttttttttgagaccgggtctcgctctattgcccaggtcggagtgcagaggcatgaccatggctcattgcagcctcaacctcccgggctgaagtgatcctctcgcctcagcctcctaagtagctgggactacaggtgtgcagcaccatgcctgggtcattttttaattttttgtagagacaaggtcttcctatattactcaggctggtcttaaattcttgagctcaagtgatgcccctgcctcggccccccagagtgccaggattacaggcatgagacctcacgccctgcatgaatgaattttttacatcaaaccttctccaacaaacttggttcagatgtctgagacaagagttgcacaaaggagtctcagtcttcagaaagttcatccttacccagctttatggatgctctaggacacatttaattcttgcatccatttaggaacagagatcttctcccatccttaaaagggaaactataatattaattactgacctgtgatgagtcagctgtccatcctcatttggcccatgctgtctacatgaagttagttttcactgtagtgcttggccaagaaaaaccaagtttttctaaatgaattccaaggataaatagcctaattcctgttctttggcttcttccactaaagaattatagggacctgatctagggaaactggggggaaaagccagggaatgagagccactgtcttgccagaaatgcatgttctgatgaggaaagatagttcaggatatctgcgccaaatcacacattggaaagaagctttctgagatctgaggaaacttccacctgctaaaaagagctagcagtctgctggaaagaaaaaaattcattcaggtgtcagaactcttactcttcactttgtgtgtgactgtagacaagtcagttaacctctttgcacctcagattctcatctgtacagtaaagagttcacattagattgtctctaagtttccttcagcactaacaagccgtgggacataggagaacaaatttgaaagattcctgagatacaggagtatggattcctgcagctgattcctttatgtgacccagtaaggataaaatcgaaaaaaggaactaaacgaaatacactcttgattaatcaaaggggattgaaagtcgtggctaacctcacacctaccttgcatcacctccagctcacctcccttgagacactcctcctcttctttaatgcctcatcatgattctcaaaaactgtgatcactcaaggttgaagcttttaatctcccatgtataaaaggatatgcaaatagagttcagtttcctgttgagtctctgccaaggtcttagcctggcagttctgggaaaagagccaaagacctcatatttcttggctgttaacattctcccatctgtgctcaagtcagcagcctaggcttcaggctgtggtttgtctttagtcttacactttcccaagttttctgaaggaaccctttagaatgttcctgcaagaaagtaagatacaagtggctcccaagaaaccagacagaggattatctggttatatttggaggcagtaagaaaaagaccaggaagtctatattcctatagtatatagccacagaatccaatcttgcaagctacttgaaatgctgatattaattaagtcttaggcagggctttcaataagtcatctgtgtctccaatatgggatgtcccacatcatgcatatgcacagtgaaaaaaagcgaggtccttgggtacagtacagcattcaaaaattaaagatctgaaaaacacaagacatctcagtgtgcttccgggctggaggctctgctaaacaacagaagcagagaccggactaattgtcccccatgtctctttgactgaactcacacaaaatagaatctaccatttttactcagtgcggggtacccagactcaagtttactgcaatgttgttaccaatattctaatggaaaattatatattcagagctatgttaaatttgaccatttattaaacatgaaatttctactttttctgtaagtgccttgtcttacttgtatttcccggtatttcccttctaaagctaactccccaaagggctttcctgtatgttctcacttccattacaaagtcaatgtacaagttaatttttttaatttctttagaaacctttataaagagatttcctccttcatttctctgttatcccaggcagctgtcaggagcaaagagctcaagcctgcactgccttggaacaggacatcagcaaaagacactctcaatctactcagaaggctgaggtgggaggattgcttgagccaggggttcaagaccagcctggacaactaagtgaggctcagtctcaaaaaaaaaaaaaaaagatctcaatattattgttccatacccagtcattcacttggtgttttctgcagcatttatttataaatatctcagtctgttcttaatccttgagcctatattttttaaaatcatactttgatatctactcagagtattgattctcttcaaatttcccacctcttagttctcctcccactctctcccaccctgagccttacacctccaacaatgatcattctaagaccatttatatctcaataggaaagtgatgtaaaacgggtctccttactctgttttggagggtttttttgttgttgctgttgcttgcttctctgtcccaccccaaactcatgtgtgtctgaaatttagcaccaccttgcgacgtttgtgagcatttttctcagagcagcattttgagactgagcctgaactccactgatgttatgacccttaaaagtgtctggctccaaaagactaaggagttcctgcgtaaatccaggtccagctacttcatcactgtgacttgttattggaaaaggttgagctatcaacatattgctcctgtaaaggctcagaactgaatcttagattcttcaggatatttgagtcctctgaggctcctgggtaaagactccaatgtagcagttctgtggactataaatgggagatatccagatcatacaccttcaatggaagaaaaagcactgtcaccttagacgactccaactctgtagtctacttttgtcttcctaatatcatacctcattctccagtgggtttatggcaagcctcatctactcagaagtaaccaagtacaagccaacacactcttgtgttagtgtggaggcccaaagtggcataagtgaatgtgactccagatgaaaaccttcccctctccaacacaaagatgccaaagactatgtataaagcaagtcttaaatcactctatatttccatttgaatatatttccccagttcctgtgcattgcttctgcatacacagaattcaatgataaaaattgagactgtctcctagatacagtaattaactcagctatcaatgccaattgactgtgtagaggggagacaattttgtaccaagatttactaacctctattttaatggaaaaacaatggaaaagctttcttcctactatgactctctctggataaattgcttgccaggaagcgttaggataattctgccatgactctttgtcttccacacccaaagacatttggtctccatcacatatggaggaaggatctccttgttcagcagtatttacaccatcaccctgacacccgcagtcagatctaactatacagcttggctaataaacctggagaagctcatattctaagaaaaaagtggagagtggtgggacagatggggcctgagtgctgggaaactgcccgtgcccactgctgacttggtcttctcaccagctgcttgatctaacagatgcatcttccttatgaggcaccagagaaccagaatgtccacatcctgtggtcccctgtacccttaacaccccacatttgagttcctttccaattcagaaaacaaaacctgcaggctttgagccaatttacaacagatgtgggtcacaacaaccaactacccaggaagcctccaccagaacgcagcgtgagaatcagcttcttagatattcccatacgtgtgatcccatcaatcatttaacaactgtcaaagagaaagactaggagactttctcccgagcatctccagggatttaattcactatgttggaaattaagagattactactaagccataagaaggctaagacagagttaaaagaattattggaaggttggcattacaactttacgtgtacactaggaaaatctgcagctctacctgtagctttgacataatgccttcctataccctgtccttgcccaactgtgactcccacatcatggtcataccctggataggcccctctctgcatgtagagcaatgtgaatggggattctgcttatcaggatatcatcactagtctgtgccaggccttgcaagaatgtccttgtactgcaactatttgtaccagatggtaccctggccacccctaagtgtgcagactttttaactttttcccccaagaaagtggtccctgatgtgcactgcctactgagtaaggctaagaaagataggaaggaagaggacaaagtgcaaggagagaaacatttttgcaaggagaaaaataatgatgtggatgcagaatatttatcatgtgaattcatattaacctgacttcctcagaaaatgtcaccgttagtattagaatgtgtatttccttcggagctctgaaagaaaatatgagaattcaaggggtgctagtgcagaatacacacacacacacacacacacacacacacacacacactgtgcttcactgtggctggaatgatgcagagtcttggcaatagttcgggaagctgctagctgtccgcccattgtaaacagtgaagtaggtcatctgtggctccccatcctcatctgtctgggccattttcttgggccctcctccacatcccattcctcatatgttctcattctatttccatcaaacctcaatctcaagaaatgacctgaaatcaattcgtactaatgtttgagtcatgaaaacagaggaaggctttagcttctctgagattggcagggagggtcgctagtgagcattgtattttcataaagataatagccataagctaaacactgcagcaaccacagcagaattttccaagcctgaggaacactgcccaaaatgaaagacagaggtttgttctctctttgtttggaggttcagtgtggatcatacacagagagtctggagcctcccacagtggacacttcttttcctctgtccagggagaagtccagctggagcagacaaccagagagaacattagcctgaccatggggaaaggcattgcagcagaattaggcccaatagaggaaaaaagatgcctggaaagaaatttcatttcaatagcaggaatagctttgtaagagctgatagccattcaacagtgaaacaagcatccttgtcagtggatgagttcggtggatgactacactgggaaggttgtctacattggttgggagctaaactcagtgagctctttccctcctagaattcattatatactgtatgtatatgattatatatactctgtgtatgtaatcgtgtattacatatactccatatatgtatattacatatacatatattacatatactctgtatatgtaatcatactccatatacacatttgtatccattacatattcaattttccatgctattggatatttttcctattcaataattttaataagctatgttaatattgtatctagagctacattatagtttactcaatcagttctcttcatggttgagcatttaggcaacttctaaatttttcctactatgaaaattattatgatgaacacacctgtacttacaactttttcattatttaaagtcatcatatatgtatatgatgatttggatccacttccacatcccattccttatatgccctcattctatttccatcacaactcaatctcaagaatatttcagtatgtgacctgaaatcaatgcattctaaagtttaagtaatgaaaacggaggaagactttagcttttctgaggttggcagggagggtcacaggtgagcattgtattttaatagcaataatagccataagctaaacactgcagcaaccacagcagatatacaaatggtatatatacaaatatacaattatatttgtataaatatatataaacatataataaagtaagctcctattttcttaattagaagattcaaagttaagaattttgtccaacttgaatatatgaaactttagggttatagagaaattagccaattctactttagatgttttaatgtattaatacagttaaacacacatattttaaaattacatattatataaaataatatatcaattttgaatactgctatttccttttaataattcataaaataactttaaattcttcacaggcatttcaaatcaatgtatttgttgccactagagccacttttttatcctcaaatatttttccagagtatatgaaactcactttgctaaattgaaaattaagaggcacattagatttagaaacataattttaaattgtttcaatgatggcacattattaatacctactttgagacacaatacatactcacataatattagaatcattgttttgccatttatcctgtaagtgaatattcatgatctccacaacaaaacatttactttgatagatttgtttaaacaatatcaaacacttgcagtcttgaaggcactggaagacccaaaaaatagttactacgtttctgttaaactacttagtcatctttttaactaattctatcagctgactgccataagcatccatgagctagcattgattgagatcattccaatgtgtcctcactaaactgtacttaactgttcaaagccaaataattaagtgaaagtatggtaatactgtttttcataattattgtaaggaatcaaatataagggatttcttcttctctgaggatcatgaaccttactccatgttcaaatagatatagtattttttcacagtaaattccccaaagtggaaatagtcactcaaacgaatacttttactcttttgacattaaccaaatggcttccaataaaaatcaaacaatttatatttttaccaacatcttgcccacattgggagtgtcaacattttgagcaaaagctttaattaaatatccatccaaaaaatggtttgttaatactttacagttttattactagagggttaaaatcctttttcaagtctgataatcaatgattaactttcttcatttgtccttcacccatttgttttttaggttgatggtgttttacttattgatttgtgtaattataataattttgtgtctgagttttacagcatttaaccacaaaaacagcattggtgaaaggagtttcaggggtattgtggatggcagcgggtggtgatggcaaagtgccaaggaaagggaaaaaggaagaagagggtttttatactgatgtgtttcattgtgccttcctaccacacaggttggagtgcattaagcctttgtccaaaaacacccagccgtgacccgctatgtatgtctcagcattgggaagagtcctctgagtgtcatgggaaaataatatatgagttttattgcccctgtgtcccaattattttctgtttactccatgttggtctacagcaatagcttcagaacataaacaaatatcaccaaaaacatcagtgatgaacaattccaaccacacatttcaatgtttactaaatatacccgtggcactgtaaaaaagaatataatggaagagtaaaggaattgggactgatcgtgactgagaacctgtatagtaggctacacactagctatatgatgaaccaagaagttgaacccaaatctaactaacttacataatcccttcctttaaagaacttaatgtccagtgcaaagcaagtgttcaaaaaagtgtttgttgtgaattgaattcatttcattggaatacagcatgcttgcaaagtcccaactttttaaaataatgtgtttctaaagaccactggtctttagaaagaccaatgaccaaagaccttagaccattggtctaaggaccatctggaagcagatccccaaggtgaaattctgacgttgaattcccaaatctaacaggtcatgtgccttgttctgatgagaaaactgtcgaataagggagtagcagtggcatgaaggttgttagtaggtagcataggccaaatggcccagtgatgtgatgaaaagtgcactcctccaaataagaccctagttactagaaagtcacaagtaggtaaacagatgccgggagggacagtttttgttggataaagtcagcagagaaaggcttttggaggagatgaatcctgagctggtgtctacagatagtgacagacttagtgcgactaggaatattatggagaataaaagaatctccctctctaactaatgccaccaagcagtcccttcaccccagagcaaaggcataacctatcttcacccaagtgaactatgtattcttgaaatatatctccttggaactaaaccatttttctgttcacttcaaatcaaccagtgttaatatcatagatctgacagcttagaaggcctgtgttctccttcactcttctcttgaccctatgtgagtttgattcaagagcatggggattagtcccttctcttgaattacaatcaccaatcagcacaccacatccagttgctctttttaagtctaggagagcaaaaacaatgcacaggtgaaggaaactatgcctaggcctcatccctaggttgtacaaagtaactgaatttatggcttcaaggacagaataaatcaaataaaatcaaagaagcccattttcagggaatagaaacaattcacagaaataacaccttgaatgaaattctcatttttagtgcagaaatggaacataacattcttagattacttgctttctaaaagtgaatattctttaggtattactttttcaacattgatgagtttacaacatttctttttgcatagcagacaaaactgtgtaggcattcacagttacagaaagaaaaaatatgactagcttcctgcttcacacaaagaaatcatgcaaaaaaaaaatttcaagccaaaagaaaaaaaaagttttaaaacattttaaagtctcatattacttgctggctgtaatgggaatgtgtaactttgtgaagatgtctgtagccatcttattctaatgatcacttatctttatcaagccattatgtccatcttgacatgatgcaatacacagggcataacattacctacacagtatttctgacataaataaataaactaaaactaatcaaacttttagttctaacaggagacaggaagctagaaaagcaaattaaaggattctacaaagaaacatctagacaaatccagcaggtgagacattccactggacaacaggttcagtcccaccaataatcaatgtcatgaaaaggcaggaaaaaagtgcagtagaggggaagcagtggaaggagaactattaaagattaaagagattttaaagatttaacaacaatgaaatgcacagtctttgaatggatccttgttttaaaaaaaaaaaaaatctgtaacagaggccaggcatggtggctcactcctgtaatcccagcactttgggaggcagagactggaggaccacttgagcccaggagtttaagaccctgtgtctgaaaaaaaaaaaaaaagaaagaaagaaagaaaaaggaaaaaataatctataaaagacatttggagcatttggaggaaaactaggaaaacttgactatgggttggctattaagttattttcgggaatttctgttaactttgttaggtggaaaatggtattgtggttgagtagaaaaatatccttttttgtaatatatactgaagtgaattgtcattttatctgtattttttttaaatactcgagcaaaacaaatagaaaatgtgacaaatgttaacaactgttaaatctaagtgatcattctatagatacttattttattaatctcttctttttggattgtttcaaaaattttataataaaatccttttttaaagtcttcattttgtgggtgggcatggtggttcactcctgtaatcccagcactttggggagccagggcaggtgattgcttgagcccaagagttctaaaccagcctgggcaacatagcaaaactctgtctctacaaaagaatacgaaaatgtcaccaggcgaagtggtgcatgcctgcagtcccagctactagagaggctgaggtgggaggatcacttgaacctgggagatcaaggctcccagtgagccatgagcatgcctctgcactccagcctggataatggagtgagaacctgtctcaaaaaaataaataataaagttttcatttttaaatggccaacaagtctacagcaaatttaaacaatgaaaatatgagatacaatatcttccttaaaaattagcatattttcttaaggaatactgctctgctcgaagaattccctagttctgtaagcgttcgaacaaattaaaatcttgtgtttatataacatatttctaagacaacaatgaattctgtcactaactatatgagtaaaatgaacaagaaaaccactaataatgatggtgcacattttagattccttttattctttttcaagacacagacataactgagatatcttaaaatcactgactttcaagatttgagataatgataataactcaagatcaagtcttccccttgtgttagaagtgggggtgggacagttccagacttccacagttgtaccaatgaaccccaatcagatgattttcaagttacttctccttcaggtgggtgggcatcagagagaagctaagagaaggttttgacaaaatccaaagtgtgtccagacccctcaaataaggtaacctgaccaagtttaatacattcttagggcctaatatggatctcagttaaaaatcctggtctcttttaattcttgtccagttgctaagtgtattatttgacccattaactctgcaagtcatgttggtccattcttcttctttacggttttgcaaaatacatcaggttacagtttcaagtatctgtcacttaaacaagtaagcatttattatttttaatgggagggctaacatattgccacagaaatatagtatgggtactgaagaaaatatacacagactctcaggtcatcactgagccttcccaccatcatcatagatccagcatctgacttccagagtaccaccaagaagaaatcagaggcagatgacatacatatccatggtccttgactctagagagtccagccaaaatgtgtgggtccatttaatcatttctacagaaatgggaggctattgctccaaatgacttctaaccactcactcatccatcactcaaagcatatgatacaattgatttaccagtcattagtaggcaggtagagagtggtgaagcagtggagagagcttggtatttacagctgctattgcaactttggtagcacaaacaacatggaattaggacagggattttcaaagtattgcccacggacttctgagcacctcaagatcttttcagggagtccatgaggtcagaatttttttcataataacagcaaaacattacttgcctttttcgttgtgttgatatttacactgatggtggaaaaacaatgatggataaaactgctggtgccttagcatgaatcaaggcgggggcatcaaatctgtattaataatcatgatattcttcactgccacatattttcaggggaaaaaagttagtttcacttaaaaatgatactgactgtattaccttgctagggctgccataacaaaataccacagactaggcaacttaaacaacagaaatttattttctcatagttctacaggatagaagtccaagatcaaagggctggcagagttggtttcttctaaggacccctcctccatctccaggcagacagcaggcttgccgctgtgccctccagaaaggatggtctttcctctttgtgtggggaacactggtgtctcttctcacagtgtgtccaaatttcctcctcttataaggacatcagtcagattgaattagggccaactttaatgacctcattttaacttaataacttctcaaaaggccctttctgcaaatatagtcacattctgaggttatgggatttagggtttcaacatgaatttggtggaaaacaattcaacccataatactgacaaagcaataacaattattaattttattaaatctcaactttcgagtacatgtctttttagtattctatgtgacaaaatgataagtacacataaagcacttctgttacattccaaattatgattgttatctaagaggaaacacttgtgtggttgtttgagttgcaagctgaactagctactttttccatgaaacacacatttttgcttgaaagaacaattgacaggcaactatggttattcagacttgtagatttgccaggcattttcttaaaaacaaatgaacagagcctgtcatattaaaataaacaacttatagttgttgctaattataaaatcttttttttttttttgacagagtctcactctgtcacccaggggggagtgcagtggtgcaatctcagatcactgcaacctccacctcccgggttcaagtgattctactgcttcagcctctcaagtagctgggattacaggtgctcgccaccacgcccagctaatttttgtacttttagtagagacagggtttcaccatgttggtcaggctggtctcgaactcctgaccttgtgatctgcccaccttggcctcccaaagtactgagattacaggcatgaggcactgcgcctggcctccaccagtactctttagcctctgtcctttgagatgaaaggcgtatatccagggagtcattgccacttcaccctgacctctagaatgaagacacataaaacagacctaaatccaactcacatcttgaagccaagtccaggtggcctgcagaccagtgagcaaaagtgatacatgtttgttgctgtaagcaattgaaattttggggttgttatagatcacaattacaacaaaaatagctgattaatacagatggtgggtcttgagaggattctaccttcatatgcttttaactctatgtctctagcaattatgaaatggcatacctaaaatttttggtggtttcctattatcctcaggacaaaacagtatagcttacttgctcccttaaatgcagttgcattgaactacttacttcctgaatgctctgtgttctttcatatttctttgcttgagatgccctttccttcttctatcccccaattggtccgtagtccctctgtattttcagggtcttagctcagttgtttgcttccctgcgaattcctaaatgactaccccagtgatctgggttaagtgctcacccttttcggaattttcatagcatccagtacttatctctattttcgcactcaaaaccctttttctttcttcttcattaggttgagacccttgagagaagtgatctgtcttgttcatccctgtataccatgtaccagcacagagcctaacccagtgagtgctcagaaagtgccttctgaacccattttaaggatgaggtatctcaggttcagggaagataagctagtaagtgacagagccatggccagatcttcccaactcccaggttctggctcagtgcctggtactaggctgccttatggaatactgccttaacatttgtttagtggtattaaaacacattggtttttaatattagcctgagttaaacatggttggtaagtttaatttgttgtgatttactccataccatatactatattctaaagctgtatagaaatgagtttcacattgtctacatatttggagtattcaagtcatgttctcttccactaagatcaattgcatctctggagaggaatcctcgaatgccacagctgggagatgtttcaaagatcatgtattcactctcctaggttttcagatgagagagtctagaaagatccagagaggtttcacaacttggccaagtcacccaatttcaaaagaacttacaagaaattgggtatctctatcccagtgcagtgatctttttggtacactaggcgaatgtcttctttggtctttcattctggcatttatggtttgagactgtttcagcctgtcagtggatacccttccctggagtggccctaggatagtctgggcaacctggtcctttctttctctgtgtagattttaatcgttatgtgagatgctcttctgcaggaatggggaagagcaggcacaaggtggatgaatcctgaagttcaactattcctggaaggagactgtgtcatgttcttttttccaggcaaactcattttcagaggaaagggacagtgttggaggctgagttgactgtggtacagttcagtcctggctgggttgaggtctcatgcttgggagcaaatatatgggatattaagccaagaaatgaaacagggattaaacaggggcatcctccaggcttagaatatttgggattgtgaactttgagctagtgttatttatctctaccccctgcttctggtattaacacacacggtttgagagttgtagacagactacggcgtgttttaaaaaggataccaggttgtttaacagacttcaaaccatgtcctgggaggaatagctaaaacatatgggagactgtagaccaaaggaagggaggtatcatagtgatcacagtcttcagatatctgtcagagaagagctggcatatcagaagacagttggattctcatgtctgcttatgcactctacctattgcagtatgttggtttggttgaaatatatgaggaaaatctggcctcacatagatatgtagtatgaaaacaaaggagtattttaatagcttgttcaaaatattgtggacatgatattctttatattgcaccataattatttgacaagaggtagtttctttgaaggttagttgcaatgtgaaatctgataccatcttagtgaacttatcatattctgttacattaaaacattggtttatcctgaaatttggatagaacgttcacccatgcatgcttcttaacccatccattagtcacttgagaaaattggttcgctgttaagcagcttccacctgttagcacacattttattattcaataccaaaatattacagtagctaacatcatcactggtctctttaagtcaggaaaaatttttaaatattggtgagctatctacttcacagtgacaaacataaatttcctaaaactctaatttttcctggaagcttagattttctaattagcaggctgggcacggtggcacatacctgtaatcccagcactttgggaggccaaggtgggcagatcacttgaggtcgggcgttcgagaccagcctgaccaacatggtgaaaccccgtctctactaaaaatacaaaaattatctgggtgtggtgggagtggctataatcccagctacttgtgaggctgaagcagtagaatcacttgaacccaggaggtagaggtcgcagtgatctgagatcgcaccactgcactccagtctgagcgacagagtgagactctgtcaaaaaaaaaaaaaaaagattttataattagcaacaacttagcttaggaggctgaggcaggagaatcatttgaacctgggagacaaaggttgcagtgagatgagatcgcaccactgcattccagcctgggcaacagggaaagactccgtctcaaaaaaaaaaaaaaaaaaaaaagagagagtgctggtggaaacccattatgtgacgtgtcttgaagcctcagcttagaactggcacaccgtcacttccactcatattctatgaatcaaaacataatgaagccccaatgtcaatagagcctgtagtaggaagccctgcaaagtcccatggcaaagaacctggaggtacacttctattacagggaggaagtgaagagttgggaagctgcattctcatcaggattcccaacttctgtttcctctaactaatcctattcacaccagtttctgatggctgcttcttgggaaagtcaccagcactagaaggagctcaatgagtctcatatgggtgagtcagaagcttatttcatcaatcagctacctcttgccatttcaaagactagtacctaaggccagctacactcaagagtccaagtgacagttctttattctcacctggttctccccatgaggccttttgctgtatgccatcccattacatcgtctgttattgaagccataacatttcttatttttctcttttcctatttgcttttttttaatcagcaaaagaatgttagactttatatagagagataacgttccttggagtttatggggcaggcatgcagctgtatgtagggtggaaagtcattacaaaggtcataggtaaaatagtcataattaaatcaaaccatggatttggataagactccagggaaagtgtgaagagtaacctttttaaattcctgctccctgttgataaatagcaacaacaacaaaattcctactcttctttcatggttaaagtttaataaggtcactttcgatgagcctatcacctatcatattgctttgttttgacagcactagaacagagatcaaaggcaaacaagaccagtgtcttgtgagccctgaggagaggttttgagaaggcaatgactgggtcaaaactctgaggtcaaacaagattaaaactgaaaatcatccgttgaatttggccagagctgctgcctctgattgctcaggttgtgccttcacaagggcatctggcagagaggagaagtggggctaaaattcaatgcgtgctctgccgccagccaaggccctgatgtggcgttgcatcttccggaaagggaaggccttttataaaccacacaaaagtgcaatctgttcgccaagcttgaacccaaggggctatctctacattcacccagcagggctgccttttctaaatcgcacaaagcaccatatgggctactggcctgaatttagcaactgggaggaggtcaatggaggggacacaattttaaatttacatgaaaaccctttgtaaactgtataacactattcaagtgtaaagcaggaagaggtgattcagaagcttagcaggtgacaggagaaattacactgaccacaagccttttctgcctaacccacagcatgtagaatctccatgagacgtttaagtacccgacaaactcctcagtgggaaaccatttgagggcagactggccagaaagcacagatgggaatggatgtgattatttctaaaagtccattctagtcacaaaccccaaggcagatctagccagtggggcagaagagccccagacagaagcacctgagccagcttggcctgacctaactgtcaggaccctttgatcttgctggagcttgacttggagaaaacatctggttctggggattctcaggggccatatagtgtgaaaccgaggggaagtttttgtaaagctctgtagcactgtgactgggggatacgcacagtgctacaaaacctacagagacctgtacaaaaactgcaggggcaaaagtgccatttccctgggatatcctcaccctgggtcccatgcctcaggagacaaacacagcaagcagcttccctccctgctttggggcctggaagggatagcaggaagttgactggaccagggagatgaccacagctgctgacctctcactcactgctgttcttccttgggtgaaactggcatttctacattttcttacagcacatttggggaatacaaaaaggcctttcttaaaaactattcttgtcttgttttcatgttgattctattgcaaaagagagttatatgagccacctcatacggaatttctaaattcaaacctctagagagatttacccaagtgctttgctttgcagtttgggaggatggatttgaagagagattgatttttttgtaggcaatcaccggccacagttgctcattctaaagctgactgctctgtaaatcacccagtgcttcatgccaccctttctcctcttgctgtgccacacgttatctgcctttaaagcagcagcactggtgtctgtaaaggccttaaccctggagtagtcatggagccaagacccacccctttgacagtgccagctttccaacacagagagctgagtatgggtctaggaagtgagagcaatgtaaaacaatagaaagcaacagttcagagcactgcatcaagtgtactgtgctggaaaggtccgccataggaaatatggtcctccatactcctcagacaacagccttccgaaagcaaacctgtccctacctgcagatgattaaccatctatgaaccggctgggtaagcaacaagtgccatctttcatggagctgagccttaaagatcctccagtcctaaagctgacgggaagaaggtaggtgggagcagcgctgaggtttttggaacgtcctcaagtgctgtgacaccgataaactcatctttggaaaaggaacccgtgtgactgtggaaccaagtaagtaactcatttatttatctgaagtttaaggttaaggcatcctccatctaaggaggcagaaataatcctgaaatgggaaatgggtgaaatagctagcatttaggaggactcctgggaagaggtgaaatatggttaatcctttccataggagaggagcagaaggtgtctgtaaaaaaagagtttggggcatatgaagggacccttctggctcagaggaaacagagaactctgcccagtccatcgaatttgggtcaggctgtagaaaccacagagtcattggcccaactccctgagcagagtcagaatggacacagaatgaagctgacttgagtccaggtggttttaccaacgtgattccaaacgttctgacctcccttatgccaaacacatcctcctggaagagctcagaactgaatccgtctcctgggcatggagggtggggcgagcgcaagtagtccctggtgttgcgatatttctctttagaagaaaataacctgtttcagacatttgtttctaattgtttgagctgcaaatgaaaactaggttactagtgagaaatatgggacattctggttcccactgagaccagattccaagcaggacaaagtgaatgtgtagtgcttccaactaagaaatgctttgaagtctccaggacacagccaggagagttccctaccactcaccagtgttcatcgtttttgcaaagagtatatggtgccagtcacttattaacagttatgcaagaatcaatgctaaggttgttgaaggattgtgctcaacacagaaggcatctttggtgtcctttcaatgacatttgaattcgaccgtgtcttgctaaaaaataaaataaaataagacagtggtctccacctggcagcagattccagttagatagtacatattaatcttaagtaagaaaatgtaataaaccaatacaaaaacccatttcgaaggtcctagggaagtctagcaataggggtcagtggtcccaaatctgcccaaccagctgttggaaaagaaacagcatgccctgccctggctgggactttggcactcagctcaggtttttcaaggtaaaagaaggctctagagagatagggtggtgatggtgggctcttctcagagaccaaatggggacaaagcagttccaggcatatgcaggcaaggaggctgaggaaggggaaggacaggcatgagcaacccaagacctcacacactgcagggagaaaaggggcaggggccctgccgtcagggagaaagacacccaaagttgtgctagtggagtcagtgcagagatgttcagacttttttaaaaaatcaacatcttagtaagattttgaaattttaactaatttgggcctttgcctttagaccttattatccttaaaattttcactaaaataagtttatccacaattccaacaaagctaaagactgattatcctaatttccctttgtttgccaagtaagggatgaattaagttcctctgtttacccatttacttggtccatatttccctaactgcggagtgcacagcacatattttcagatggagagacgttctttttatttgcatggatctatcttttaatggctatcagaatagtacaactaggctatcaaacccatgtgatttcaagtttccttttaattatattttaagttaaaaagtgaataaatttttttaaattattaagcaaattatgacagatgactatgaccaaaaaagcgggggagatgtgcttaattgaagtttgggaagtgctgaacttcatattggtgcatttcatcagcctttgaagtgaaaaagtaaggggtatccagagggggcacaacctagaatatctttgaatggcagcttctatttttaagctaccaacattggattaaagagactgcactgcaaacccagggcctttatcttctcagaagccttttgatgctttttttttccttgggagcttctttcaagttcttacttacggagctcctgggtagcacaaaactaacagaacaggtctatacaaacccacagctgtagatcccacactttagtcctctggatacagtaaacctggagagaccacttagcttcgtaaaacagaacagagaaacaggacaaaacagcatggaataaagtaatggaaacgtgtacttctatggtaacaacagcggcagtggggaaaagaggcatggtcgttgggaacatctgcgtggaagtgggccatgtgatggactttgaatgcaatctattattgtatgtcacaattatgtaactaccactttttgagtgcctaccatttattaggccactgggctaagtcctttaatgattatcacttcactcagtcctcactacgatcatgtggaattgaggtaccatgacttgcgttttatggatcaggaaactgaatcttaaaggggttcctcaagatcacacagcttagtaaagtcatcatttgaatcacctgcttgatgccagcatctgtgctcttaagaagtctgctcttccatcagggctgcagctagactagggcatgtgtggaggtttttcctgcctggcccagcctctgcctcaggtctctaatgagctccttttcaagctgaatcagaaacaacagttatgccacttcccttccagtgccatccccatcacttctctcaccaaggaagaacttctgaacccccgccaaaaccagttacccaaagcagcattccccttccccaggaggagccaggtgaggcccatctctcacattacacccctggagacccagggtccctaaatacagaaaggtccagacgatgatcagagcatcactctttccctcaagaaaaggagtccacataattctggcctcatcaaaatgtttctcagattccaaaagatgaccttcccattcctccaggcccactagcccttggcctggcatctggcactccctctcactcccagtcagcatctcccagaacagagcctttgcacctgcaagtccttccacctggagccattttctcccagggactcacacagttttctccctcccctcctccaggtctccactcaaatgtcatttccagtgaatcctttccctaccacctcatgtcactctgaagacccctttccctgctttatttatagccctcatgtctacttgaatctttatatgctcgtttactgtctgtttcccttgctctgtgagagaaaggactttgagttgtttcttactgcacctataagtacactgaaagcactaaacaaacatttgttgaatgagtgaatgaataaataaaggaatgaatgaatcagagaaaaagtcagctatggtataaagcaaaagaaaagaaaaatgaagggaagctggtaacctacagagccgagcctgagtcctggctctgcaacccatcacaggtctctgccacgaagtgccaggcactgttctgggtgccagggaatcgacatgaacaaagcaggcatgaacttctgccatattggagcttattttctaatggcaaaagacagatggtaaactaaataaataaataaaaaatatatacagtgcgttagggtggtaataagccctgagaagaaaaataaagccgggaaggagaataaagaggactagtgggagggaccagcatgcagttttaaacagaagagtcacagaaggtctcactggaaaggtgacagtggagcagagacccgaggaggtggtaaagtgaggcatgcagacctctggagagagagcacttccaggcagaggggacacagggctgcctggggtgtgtggctggaggaggggagggagtgatggggagagaatgtgaaaatgaggtcagattggtgatgggttggggagagggtggcttgtaggccactgtaaggactactgcttttggattcgaaagggaagattggggagtagaatggaagtcacacgtaacctagagaaaagatctagagagacagaaacctgaataccagtcctaacccacggccctaagaagtgggcaccctcttcatatcacataacaccaaaaaatagcttctgttctttttcagcaacctgtcccaacaatccttcctgcttgggagctctgttcttagtgcaattacattccccacgcttctagtaaaatgtatcttctctgagtttagccctaataaacattctaataattacatcgagtctctctagttcacagatgctgtatctaatcttataacctataatacggaagatgttatcctcacttcgtagagaaaccagataaagctcagtgagtttaaggaacttggccaagattacacacttggaaagggacagagtcaaaactaggttttggatcttctgacatccttctactttacaacgactaggaaccacccttcatgttagtgattctccaactatcatctacagtcttttaaggattgtaaactgatccgaaaaatccatattccctccttggtttttatgagtgacatacaggcaatctcatagattctgatgttcacgtataacagaaattaatttaactgtcacttctaagtgtgagagtgtcattgaagcttgctaaaatttgatatgcatgaatgtgttattaaaatggatggaaaaacttaattctattttgtactaagcagtttggctgctgcacaatacttggcaatgatgcaaaactctcagatatgaaataaatttcccctaaaaggttggaatgcatggtatatataacctgctaggtccctgcctcacctaagtgtagcccgaaggtggagaaccactgctctatgaccaacgttccacccttctttcctcttgatcaaaccaaaaaacatctttccagtctatattcattctctcttatttgagcacaaattctgtcagattgtaatatgggcaaaagcttggatttctatttgatgctagagtcacctcttgttccatcctgaaggacaacctctaagacggaggagaagaggctaggccagatgggacagaaaatcacatgggatgaatatcatgtgacttggcaactggggctagggttgccgtaaagggaaaagcaaggtagtttttggattaggtatgtcagctgtgccagacccctgatctttggcaaaggaacctatctggaggtacaacaacgtaagtaacctacttttccttcttatgaccactatgtttggcaattacatttgttaaatatttttctaagtcaccaggttaggaagcagtgctccagtaggtaatatagcaagggatggcttgaggaacaggaactgagtttccgataaaatccaggatggcgtctgtgcttcagtgagccgtcttgatccattgtccttcctagagagtttctattccctctacctggctccagaaagctaccctcctcaacatctatgcatccaccatgtacagatctaggccaccactgtgatcagactcacatgacagcacttcggggggtggacacaaggtgaaatgaggagcacgctgaaccagtaaatcagaggccaagttccaatctgtccaatgcattaactgacaatgcattagctgacaaactctgtgacttaactgcactgaactatagtttccctatagttagatgaaggatttccaagctgtcttccagcccttgcccactatgatcctgattatccccagaccaattcttatgaacaattgggaggaaaagcaaggaagcccaatggtgtgactgtcctattacccagtaggaattctgtgatttaatggaaaaaaaaaaaaaggcactggaaagggagtgaaaactctccctatgcatcccttaattagcccttgtgtgatcacagaggtttggaaaaatgatgccttgaggctcctttcagtcctaccatctattactctggttcaggggctggaaactggaaattgagtgaagcccaactcagccactcacttaaccacctttacagtgcctttgtctgtgagatggatctaaaaatatcacctcatagagtttatttcaataactttgttgaagtagtataaacaccagctgtttaagtaggaaagtatttatacaaatcatagtcatctgtgattattatagtcctttggatagaccccaagtcttttgcatcaatggctcttgctccaaccattgtgtccttccacctctcgctgaggcacagtcctgttgtgattgatttagttgaggcttgttgttacgtttctgcctacaacggccatttggcaattctcagcaaaatatgtgaaaatgttatcctgaagcaagatctgggagtaagagatggcaggttgaggagataatagcagaaaatctaaggacttgcctaagtgtcaaaactcagaagatagcagacatcaaaaaagctgccaaaatataatgctcagatctcagaaacccttgcaaagctctgtctccagctacacccattctgctccacccacccacttccaaacagatgaattagactgacagggagcaaataggtagcaaggtttttcgtaatgatgcctgtggtagtgctttgacagcacaactcttctttggaaagggaacacaactcatcgtggaaccaggtaagttatgcattttactacagctcagtgtgtatatttctttagggttgttgtagcgtagtcctgaatgaatggggcttcttgggaagtaaagagttccaaattagaaacccattgtttgttgcaaacagtaggggtaaaatttgggagcaaatgcattagatttctcttaagaaaatattctgtatatgcttggaaactccattctgaggcttggtattcataagttttttacaactactgaaaaaaagccctaggtcaggcttttagttttgggctccctagaaccaggaaaaaggcaagctgtggttgaggagggtctctccagtatttatgagggataaaagtcatggtcacagtgtaggaagagggaaggttagaaagaaaaaagtattacgaaagaaggagttttaaaaagaggatctttctctcctctctctctctctctctctctctctctctctggataagaagccaatcttgcccttgtcacttttttctgaacttgcattaaaccaacataaatggttcagattaaatggttctcaaggtcccatcctggcctgggtctgctgagagcagttatgagctcacctctcctgttagccctgaaactgggaactttgcacaatggttcaggagcctgtatccaatgtagaaacacagccaccaactccaggacaatagagaagtcgtggtcccctactggagacattgtctactggtagcctactccaatgtttggaaatccaggggctatattctggtagtttgggtagctgccaacagtcaatcactaagaccagtccagagaatagccttcagacaccttccaaaatgccaagtccattgggagagccattacctcttacatgattaggtattgattttgtttattcagaggaaataaataagtagggaatggtacatgaatgtggctaggctatctgaccaaaagtccaaaaagtgactggtgctgtcaacatggtctctgcctctcagagaataatataaacttatagggattctccactgcctgttgcctccagggaaatggtagaatttggtgagttttcttatctttgaggggagagagactagagcactgaaaaggagggaaacagaatcatgtcgtagctgattgtagtctgattgatgtttagcaaattgcatctgagcaaaaactactgtgtttcattttcccctaaaatcatttccacttgaaatttggaattatctgcagtgttagaatcaaatctttgaggctgtgcctttgggagtcttagggaagaaggaaattgatgaaactgatgcttagcccctctgccaggatgctgaccatgctccccgatgacactccattcgcttctctggttttcttctcctgcagtggtgaaatgtaatatgatgatgtgaagctcaggtaggggatgtgaaaattttcaaatcaaaccccaagtccttaaagctttgacagtgaataatggccctacacaactgtcattctcttttgcctggctctagcccaacgatcttgatttttggtgatgaggcagagtaattcacatggtctttatgttacattgcacatgatgactatatactcctgaaacttatatctggatccagagtcaggagaaattataaaacaaaaataagcaatgcaaagcaagcactggcttctctgacctgtgtccatgacacacagcaccagtgggctccctgagcagtgaccaatttcttgttcaaccctcaggtccttagaaagcctttcgccaagctcagggaattagaaagcaggttcgttattattgtgagactcagtctgagtgatgggggaaattaggtttctaatcaaaattctgtacttgtgacccaagagaatggaaccagagtataataagaatggaaactctttctataaccctcctctcctcaacctaacatttgttgtaagaaaggtcaagttaagtgccccatccctaccctcaagctattgtgttcttcttggatgcccctctcaataaactggaagttagattttccatcatgaaggcagctatttgtcacctgccaccctcttctcttgctctgtctcagccctgccctagtatctcttggatggggatatcaccctcacatctctatcaagcagttcaactattattagcttcaaagggaactgagactctgtgtactcagccccttggtctcatcaagagcagctttgtagttctctgagctgtggggtctctaggctgagaactgaggctggggaggcagggcacagatgttacagctcaggccccagggccagctccaggctagttacctgtgaggcactgtcataatgtgctcctgggacacccgacagatgtttttcggaactggcatcaaactcttcgtggagccccgtgagttgatctttttcctatatttctgggataatttgagtcctggcactggggctgcaatccagtttgcattataaattataactagtaaatgaaattataacaaggagacagagtattacagatgtgaaataggccagagtgaacacactagactgagtcacttaagtagctctgtaactctatttattttaatatatatactctatattaaaacaatagctcccatttatttctgaaatcttcagagcagcccaaaaaacacaaagaaatctagaagaactacactaagagttggagcattcaggtgcaagggagacagtgggagggatacttcagccccaattcctcaggaagctgcttcatctctgcacatccctttggctaagctaactagtatgcgtgcctccttgcaaactgaaaacaagtgtcctacagcttggaagattctggagaaaggtagttagcatggtcagagtaattaggtagaacaaacttttatttcagggtttaagttaaatcccatattggcagaaagtcttgaaattctgagtgacatttattacagttgttgcaattcttaggggatcagtaggactagctatgagaatctaaaacataggtgacttctaagtttataaattaagaaagactgttcaggaatggtacacacttttttggtattgtttaccagcacataaacttagcaatgtattggtgttcataaaaagagaaagtctgacaataaagcaattttccaaagaaataacacttgaaacacatgttgcaatgtaattatatttgtggactaagaaaaaaagactacaagttcttcaaagataaacgattaaatctttaatctaaattctggactacaatttcatacagcttcacgtctgggtttaagtcaaatacaaaatagactaggatgcatatggcaactatattgagtgcactccagtttttaaaaaggtttaattcagtcagacacccatttctttggttaccaagatgccaaacaatggattctataagacactttctttcaaacaatcgttttgaaaatataaacattaatgtagaaagagggattcagaaaaatgttttatcaaatcaatgtattatgctctatctgaaatgctgactaacagagtcagagcacaatatcataagtgcatgaccttcttcagacatctgtcttttcagttatattgtattattcaaattactcaaacccaatctccccagcccaaagtgatgatttgacaactgcctgatgaatttagcttttaaaattctagcaagccttaattatccaactaaatcagaccaggattaagagatactcttaaataaacaaggagatagggtgtttattttatggacaagtttcttttgtaacttgtaactcccttgaaagtcagccagagtatgtctcaaaccaaagtcaagatagtgagcaagaagtgttgcacttatgaagggaggtgagtgagcaatgcatgtggtttccaaccgttaatgctagagttatcactttctgttatcaagtggcttcagctatgcaaggaaaccaaacaggggaagttttctcaagcaggttgaaagcaggttccaagaaagccctttgaaaaatgtctaatcctttcaattgtctagaactaaagccaaaaacataaggaaccagattcttaggaataagtttcctgccctgagtgactgaaacagaatcagtcttttagttgagcttctcagcagaggaaacggggagaatgatgatggtagtgatggggggtttctctgaatagttgattttctaggaaaaccatgatcaactttggtccatttacaaagccgtgatcagcagaaacttcctgactagcaatcgccccctctcaaccagatataaccagttgatctggcagtagctctgctgctgtgaacctcacagctgaagcccaaattcagattcaggataaagcattagaaaaattatttatttttatacagaaaattagccaggtgtggtggtgtgcacctgtggtcccagctactcggaagactgaggctggaggagagtctgagccaggaggcagaggttgcaatgagttgatattgggccacttcactccaacctgggtggaaaagaccctgtctcaaaaaaaaaaaaaaaaaaggaaaaggaaaattacttattttccatttacacattcattaccaactttctgttcagcaacacctaatgtcttgattatagaccatagtaggtaaaagtacactggaattcaatgtatttttcatttgatatcaagaagcaaaattcacctaagtttcaaatactaagggccaaatttacaggagcaattaatattaaaagtcagcattaaatttaggattgaaaaatgtatcttgatcatcattcacaggttggttgtgtttcttggtttcaggtattaacagggctctttctttaacagttatttgaagatagcctaagaatttaagtccccatggacacaacatttatcacaattcaaaaacttcagtgaggcactgtgtgaaagaatcatcactacctctctcaaagcttcaagacttgtggtcttaaggaaagaaaagtatgcatgtacagggtggtagtccaaagtgaggcacaaaagaagagaaggccaggagggaagccaatcctgggaccaacattccacagttcctcttagattaaaacaagaatgaacgggcttcaattggttttatttctttaaggacttcctgaaaatgatcattgttatcctctgattaaagactcaaaggaaactatacagtagtcagtcccctacagaagaatgagtattcacctaaaggcagaaacatgtaccacctaccttcagcagatccctttccaccctttccagcagatctggaagggatggcacccttccgggaccccaacactgccatcctcagaacctctgagccagttatgcagtccttctcagaccctcgattctttaagtgacagaatgcatagcatgagcacctgccctgatctaccatccaagggcccatgcatttacaaaaaaccaactggtgcagagagatattcagcctgacctagattgtccagaggattgattaataaaacacagataatcggctggatgcagtggttcacacctgtaattccagcactttgggaggccaaggtgggcggatcacctgaggtcgggagttcgagaccagcctgaccaacatggagaaaccccatctctactaaaaataaaaaaaattagctgggcatggtgatgcatgcctgtaatcccagctactcgggaggctgaggcaggagaatcacttgaacccgggaggcggaggttgcagtgagccgagattgcaccattgcactccagcctgggcaacaagagtgaaactctatctcaaaaaaaaagaaaaagaaaaaaaagaaagaaaaagaaaaaagccacagataatcgaaacccagatgatccagaaacttctttgtagttgtcattttccatctgtgcttccagccctatctcctagcagctcctaactggaagtcaaacttactgcctttcatttctgctccccttgcctgtcctttcacagaggtggtaataagcccaggtcactaacaggatgcatggaggtctggattgtagtgtttggctccagggtaatcgaggtaatcaccactgtttaacccccacaaagttgtgaataatcatctcacctaataagttgattatatttgcaggaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacaggtaggccatttctagcttcaaggagctggagattatggggaacaagaattgggtgaaagggaagttagagatgtaactgtggacaaatcattctcagtatagcatcatgctggaaataagacttaggcccaactatagcctgccattggcaggggagggaaatgcttgtcatccctaagatggaatctaaaataaagcccatcttatttcttcctcatctctcctctttacctaccactgtccccttcatactagactctgggattgaaagtcctcgtgcattctaatccagtgctaaattccaacaaagggcaatgcggcctattgtggggctaagaatcctagttcttcccgcatattggtgtgcctggatgttgacctcatggtacaatgaaaaaggctagaatgggaagcatgttgtataattagctatgtgaccttcaccaagtcacatcctctggtcctcagttcactcacccaaagtctcctccagttttaaaagcctacaatcctgtgagcctcttcattcccaatgtaaccctgaccactgctgtttgttccagatcacgtaaaaccaaaggaaactgaaaacacaaagcaaccttcaaagagctgccataaacccaaaggttagttcaaatcaaagggccaacttcagaatcaagggttaaagcaaactctgtaattgtccactggggccaaaatgtatcagatttcaaaagaaaacacaaaccatgctgagcccagttggttctgcagagcctctgactctcccagcaaggcttacctggctgtcggcatcggtttcccaagcttgcctggctgggtgtcagcagcagcctaaggtctctgacggctatctggcaccatgctggacttgcaggccagaaagaactaggcagacttggggcaggctaatatcagtgttgcaggcccaatttctggaagggaatttaatctctccctgaagccaccctcttcactctttttcagccatagttcataccgagaaggtgaacatgatgtccctcacagtgcttgggctacgaatgctgtttgcaaagactgttgccgtcaattttctcttgactgccaagttatttttcttgtaaggtaagaattagccgcttcttattcctatctctacccacaccatgctgcacatggggaaaggggatttagaaatggctaagaaaccaagaagcattggaaagggaaaatagagacatacttagaattaataaggtaggctatctcagctactcagcaaaacagcaccccatttcctgttatcctttcattttgagtcagactgaaacccattaggtagtataatgtactatttttctaatataccagagaataaccctcactttcactccagggagaaaactgaagataaataaggagaattcatcttctttactgctattttgttcatcgaccaagagaccatgggttatttgcaaggccataagtaaagctttgcctgaagactatccagaggaagcagaacctatctttgtcctgataaagggaatgccagctcacactccttaatcataggaccagcctgtctatgtgtggatcagcctgtctttgggatgaacctacacacagcattagtagtgaacagctcactattagctactcaggatgcatacacagttaggtttgagatgtcaattatttgcctgttacttgcattccgttctcaggtaatctcatacacgaaattgaaaccagggcctgggtttgcgtgtgaggcttctccccctcactccttctccaatactcacaaatgctcatcaaccccagcttctgttctaggaacaaccctagactcagagtacttgactgatctgacccagacagtaaacatacccagtcatctcaaaaagggggtccagctcacctgttattttactaacagtcccagggacacaggcagtgtggctgggtaaaaagagagctatactaagagtcagaagatctgggttttatcctgattttgacactaacttacatgttaccttagccaggtttcttcatctctctgggcctgggtttttgcatctgcaaaacaaatgagttaaaaaaaataataaccaaaggagaacaaaagagtctcatgacttgtgccaacactgatagctgaactagctgagctattgccatgtgtacatggaaagtgagccacaatagattagtgatgtctgcaatggtacagtatagcaagtaccggccaaccccagactacatgacccctacgattccttctagcactggcagtctattctataacaactttcttcactgcaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggatataaaaagatataggactctttttttactcctacaagtgatacactttgaaaatgatgttttgttccttttgactttctttaccttttgaagtagaaagtgggaaccaacaggttcacagcttcattcctcatgaggcaaataggccttgggagaagaagagcgggtgcccttttatctaaacatggaaggctctgctcaactgagcactagatttgctacaaaccagcatcatcttcttcctcctgtcctcacggcttgtcccaccctctatgttcacttcaggagccacactagagattctgcatggcgtggaggaggacaaagtttcagcactttctgcctctcctaatactttacaaatgagattacatttgaatttgctaatactttatgagcaggcaatgaggtttccaaaatctcatctaaatactctccaatctattagcaaaaatcagagtaaaatacagaggaaaggcactgctttctgttaattgatttaacatgcatgaattagctccctctgagttccaggcactatgctgagagtacaaagaagacacaagtctgctttcaagcaactcactgtgaaagtgtttttgaagggaggaacagaaatgagacccctatctttccctataaaaacaacatttttactgtcttttgcctgccaatctgtatttgaaaccattggacactgattctctggcctgggactttggcattgatggttttctgcctttcttctcagcctctgcctctattgcatttattaaactgcattgtgtgcacctcgcctctggctttactctttgcagatcaccacagggggaaactcagctctgtgagctcactattagtcagccaaaagccaaattgaacttatgggtcacactgcactttcctgagccccaagcctacagaggccctgccttggagacccagcctcgggtttcctgctgcctctgctgatgccgctgttacagcaagagcaacagcagcacctgcagcgtggccagtgacctctgctactgccacccaggaaggccacagccttttccaggagcactgctcaggtgcagagccctagcaacccattattgtggttctctcagcacctatgtggagcatcaagtcgggggttatgaggttacaagtgaaagagtgactgtcgccaacaactccacttgccatccccgacagcaaactcccccatcatgtctactacaccttgtatgtgtaaggaatgctgatttccaaaacattcacgagttaccttgtgtaatattagggtgtttcctctgaagttgttaggaacaaaaagatcatattctcatttttcagataaaacaaaaatgccctctcctcaaaaaagtatgtatcatgtccagagtcattcagtgaggcagggatattgctgggagcagaaccaaggtctcaagattttcagcccaaagttcctgctataagaacatactgcatccccaaatgaggacaagatgtcaaagtgagtatcagctagaatgaacttcaggattgtcccatatttagcatataaatgagccaccctctagcccactatgccagaaacaaaaaaaatcctggcatatcacaggaccatgaatttcccacaccaaaaggagcctccagggaagatttaaggcaagagccaggagggattatggctgccttctgatctggggccatgatatgtgaactgtgagatggacatgtgtcacactcagtaggcattagaacagaagccccagaaagccaagccacatgcccaaggtctttggctccctcatcccctgttctttccattgttctatacagtggctactcttgtccactgtttctgaagagcacataaactgctgcccaaaccactcactgatagagccacctagggtacagctgcagaagagagccctggaagtgtaacgctgcatctctgggcctgtcattatccaggtatacgactttgagaatgtccaccatgtctctggactgcagtgtagtttctataaaataacatgtaaggcctcttctatttctaagattatatctaataactctaatagttctattaaggcagataattcaagagaagaggaaggagggactgattcccagggactgagggtgtgtatctatttcaacatcacatagtcagtttgccccagaggaaattttctctgccggagacaccactgagcttcaaactcagggacttggcagctggaattctggaagtcacaactttccaggagtgcctcagtgctctgcagtgaaaaaaaagaaaatgttctccaaataaaataagtaaaatggaggtgtcaaagaacatcaaggagaaggtggctggatataaaaagatgcgggaaaaaaaaagtaaattggtgaaaagtcttttaagtaaataactttgtgtctaacttaattttttttttttttttgagacagaatctcgctctgtcacccaggctggaatgcagtggcaccacctcggctcactgcaacctctgcctcctgggttcaagcgattcttgtgcctcagcctcccgagtagccgggactacgggcgcgagccaccacgcccggctaattcttgtatttttagtagagacgggtcttcgccatgttggccaagctggtcttgaactcctggcctcaagtgatctgcccgcctcagcctcccaaagtgttgcaattattggcatgagccaccacatctggccctaatttaattctgcaatgaaaacagatcaattcataataatggataaatggtggtggtgactaaaataaagacacggctgacggcctcgccttagatgggccctttacctgcacctgaacctgcatcctgaaacactcacagaaaatgcagcacaggcttgtcaagcccctttctgtatcgggacgaccagggcaccaggggcacgaagacagcgctctgtaaacatgcagttctcctttgcctaccaggagtcattcaggtggcaagggccccgtgagtcagaagtggggagatactctgcttctctgaagccagggtgctcccctggatctgaccaggccatttatttctcagaagacactttaggtcacttctaaaggccaggctggaacccaaaatggctaagagaaggatgccaagtcccagacatgacctgccctaagaggcagctctgctgagctgtgccccaggagtttgtgttatgacttcctgggcacctgcatcatagtgctaaaggcacagtagtaagtggcactgtcttcagtccttactggagagatcaccaagtgaaaggctttctgggtcagaatgtgtttcacagaaaaccgtccttgagtaaaatctgcaccttctgatctgctgttatccccataaaagacaaactgaaaggaataatctggccttatccggtaccagaataaatctggatttgaatatacagtgtcgtaagtgcagagcagtaccacctcactgccactcgccaccgtctggtccggggaactctgggttactttgtcacacagcgtgcccctgtctgggaaaaagacaatgaggaaatagtgaattctgcaccccccagacagtgagtacagcacatgcctagcccagaagaactcaatgagcagaggcaagagaaggacacagaaataaagccaaaggcagcaaataaccaaaaaccaagagtgcaagagaaaaagccttcaagagtcagagaaggagaaatggggttatagagcaagtggaatgtaaacaaatgaaactacttacagaaaaacaaaaagctaaagcccacagtaagaatcatcttttcttcatatcagggcagaggatatacaacaaaacagggttcctaagatctcagagactatctgacggttctaatgaaagaagacgggaggaaaacaagaggagactggcagcgctgacggtcatgtgactgattcagctgtgacttctagaggcaaatgcgctcagccaaggaaactgctattgctattatgattttggccccaatccatcttgaactaacacatatgacaatgaaaaatggattacttttaaaaaagaaaagaaaagaaaaacaaaggaagggagagagagaggaagtgagggaggaaagaaaactgcaagactaatgatggcgttcttggatatccaactgctacaaaagtagttcactctccatttctgtatcctctggtcacagactggtgtactagtccattaatcacatgtcgtactttgagtgacactgtctcatagcatctagcacggctccacacactttgttctattcaataaatggaataagtgaaagagtaccttggacaactcccttactcctctgtgtaaagaggaaggaaagggggttggaccagattctttctaaaatctgtcctagacctgaattccagaaatctttgatttcagatgcttgagggagtgtcctgatcctaagtgcttcttgcacttcaccagcttgactttccatctctcactgggcccactgcagcacacacttggctccagctggaaaatcctgaacagagcttcccggcaggtgaactgccataagtgggttataagcttgctgagatagtgttcagagtgcccatgtacctggggtggctggagcccctgagccagcccctcccagtcaggagcactacaaatacagttttccatgtaagccatcaatatgacaacagttgggaggcactgctgtgaaaaacagaacactgactaactcactccccaaaatgcaggagtgttcctaggagtatttctagaaggtccttcatttccctttttccctacatccacttcatcagtaagacctgtcagttctaccatgaaaatatatctccaatccatctacttcttccatctccactgcaaccaccttctataaacaccatcatctcttacagggactgcttcaataacccactaactggcccccttgcttctgctcttgtccctggacaatccattctccagttcttcataaaatgtacatcagatgatgacagctggacctccttcccaggcctgtaacatctgcaaacgatctggcccttgcttcctccccagcctcacctcacatctgctccttctctttcttcccttcagctgcagtggccttccttctcgtcctttctatgtctctcttttctagctacctgaaactctgtctccaatttttcacagttctcagctccaactaaattagtcacccatgccacccataaccaacctcaattacatctctgttcttattttccctcacatcactatctgaaatcatcagattcatacatgtttattttatgtctctcccatctcacctctcccctacacacacacacacacacacacacacacacacacacacacacacacacacacgataatataaactatatgagggcagggagcttatcttttcactgatatgtctccagcccctgggcttgtgttgaccgcatcacagacaatcagtaaatatctgtgtaaaaaaaaggaatgcaatttcttcacttaaaaactcaccattcacctagatttaggaaataaaaatacaagacacccagttaaatgtgcatttcaaataaacaacaaaaatttcagtaatacgggtagctgggacatgccatatttggaacacatttatactaaaaaagtattcattgtttatctgaaattcaaattccactgggcatcctgtgttttatctggcaatgctaggcatgcagaataccaaaagtaagcaccaggcaggccagagtcccaccatgagcatcttcagggcccctggatgtggaagagggatgttgagggcccaggggctgccttgccggtgcattggctgcccaggcctgcactgccgcctgccggcaggggtccagtccacgagacccagctccctgctggcggaagtccatttcagagcttccggttctcccaagtccaaggattatgctcactccccacccacagtctcttagtgtctgtccctgctctaaagatgttgtctgggcttgatattaatatgagagctgactgttcccttcctgatctagaccataaccatcttcaagttaaattgctcctcctcttctaactgcccaacctcacccacgtctgaccatacccaagcacagagaagtgggtttaatggaccttcacacagaaggacacatcctctcctataatgctttacatggaaggttcagacataacctgagtcctgcttggggtagcatcatcatgactctcttgccctggtgtccttgcaatattccttgaaaggcatccctcccccaaggaagggcaggcactgagcacagcaatgcagtataatggctaagagtgggatcccggagccagcctgcttgggttcacatcagctccggcttttaccagttgtgtgaccttaagcatgccctaactctccaagtctcaattgctccatctgcaaaatggagatagtaatagcttttctcacaggactattggaaaatttagtgaggtcacacatgcaatacacccagcagataaatgatctatgaatgtcaggtattgctgttgcatatttaatttaaatgttgccatttttattaaatagacatatgaatagagttcctaagagtgttactctcatcaatgctgctcagggaaaagatgctgagtaaatctaaattttaaagttgcaaaatctagcaaaagattgttgatatgttgtatcaatcaatggttaaaaaaaaaagactgacatctttaatttgctttcagtgctgcaagcatgtcctagagctccgtgatcccctgagacctgtgatcctctgagacatgagccagctgtgctctccccaagtccctaagagcattaggagcatgagaagtgagcattccagccccttgttcttatgtcttccaaacattgtaacaggcttgttcatgagaggccacaatgcatgatcaagtgaccccaccactgaggaataggagaaagcctcaagattcagtggcccactaaggacgtattgccctaagtttctccaacccatcttcctattggcatctggagactatgcctcttcccaaggtgctgagggtgctgcagaccccacttgccctgcaggccccacccgcccaccagcgaagaagggctgcctttcattagcccaaaactgccactcaagaggggtcctcagacaaggtgggagccaagagatttggcgaacgtcacccttgtcccacagcttggatcttgatcactcatatcactcagaagagggacttttctctcttgtttcctttgaggtgggcggctttgtttttgacattgtagcgccctctgctgctactaattatcgcatctccataaataggtcatactggaggttgatagaaaatagatcagggaaggaaaacattctttgttcacaattcaagtcaaagctgctgcttctgtctccattcccttttcaactctgagactggcagctgcttctctgttggcccaaagggactatcctccaccagtcacccaaagaggactgtctttaaggatatgagatagcaccctaagaggataaatggacattttcttgtctacaaaaagcctaatgcaacagtagaggacatagggaaatttctttggatggatagagacaagtgcatctctttcttacgaaagaatagaaatgtgattaaaaaggaaaagcctagaaacatctgaacgtgtggaaatgggggtgagtgggctagagaaaggatttctgcatcactttcttcctgtagcaattccatccgagatccctgggacagacctggcctgatgaatagcaggaagcacaccagggagggacaaggtcctgcagacaaccttcaccaccaggctgggacagcgccatggggacccagggcctctgctttggggaaagaccttgctgagggccccatgggcaagaacaagtgtgaagaaccctactatggttttttgcccaatgccctccacaaagccagcgtttgaaggaaaactgtgaggaagaagggacactccatggtgttgttgttgccaccgctggagcagcctgtagcaagaacagtcttggtccaaccaggtcagtgatactttttatgatggggctgtgtgggacctgacctgactcttgctaaccagatttctaaagccatctgcagggtcttttctcctattattccccagggcagggagggcaaacagattatatctccattatcaagagctaacaattggtagagactatgcggagcatgctggtaagaaagattctgaggccacatctatactcagaggaagagagtgatgtgtttattagcaatatttaccaagggagcagaagcaggaggcaaccccacaccattttgtatttcccattcctgctctcgatgtcattccctgaaatgagtcctgcagagaaagaataatcagagccaattctccattggattgtccttttggtaaagggcaaatttttccatttctgtcttttccatggaccatttcccctgctatcaattgctgttgcctgcagcctaagaaataaaatttttaaataaatgagaacgttctataattctctctaaaatcataaacaatgtgtcaaggccaaacacttccctggtgtgatttattcctatgtggactcatccttgtataattagcaggaataatcacaccctgagccagctggcagagcccctggggacagagaccacccaaagaaggtccttgttctcctgagtcacataaagggagtcacacaaggcgggagtggaactcaggtgtccggagttctagtcccagctctgcttctacctatctacatgaccttgagcaaatttatcccgcagagcttcagcattttcatctctaaaatgagggcattggcccaggcagctgttaaatttccttccaagtctcacattctaggatgctaatgtgtaaaattatagaactgacccaagagttattagttcatatccccctgtgcatgttgcttgaactcctcattgcccagcaggaggaaaagggaaaacatgtttcttcattggggggtagcataatttcctggttgactatgtgtgactcatcagagcctggcggtccaagcccatatgccatttgaaatccggttattattacatctgggagagagaaaagtgctgaaaacagcctttgggacactatcgatttggccaaaaaaaaaagaagaagaagaagaaggctctgtctagtgtgataacattttgttatcttattcattgtcttcatccctgaaatacactctgctctctcctatctctgctctgaaaggcagaaagagggcagccctctccaaggcaaaatggggctcctgtggggaacagaggggtgcctctgtcaacaaaggtgatgccacatccctttcaaccatgctgacacctctggtttttgtaaaggtgcccactcctgtgggtaccgggttaataggaaactgacatttggagccaacactagaggaatcatgaaactcagcaagtaatatttggcagaatttttttttctatctgaaaattatcagtgagagattctaatgtgccttaacaaacaggaacaaaagatgagtgtttaatacaattcaatttaacaaatatttattaagagcctacagttattcccatggatcatctgagtcagtttccgaggaaacattatcgttgccttaagggagctggggggttgtcaacgggccagaggtgggatgaaaaatgacaacagatttacctctgggaccgggacatggttaaccacagcggccctgggtaagtagcttagcttcagaagaaaatgtgcccaacagcatgggtaacctaaaacaccgggcaatccaaatattcttttatgattggctttagcatgtattttattcttttgtagggcaggtttatctcaccaattatatattttcttaactgacctgtaaaatctacaggggaaaagtattttaagaattatatgtttctgcaattaggctcccagcagtcaacaaagaagtggtactttttgtctttccagtgatgaaaaagggaacctggcatccctggtggcccaccagcgtctccttccctggcctaggtcagaacaagccgtaaatcagcaggccgttatcttcttataaatctgtagagcagggtggacaacaaaaggcagcctgctaggttttcagaacatgagttccttgtgtagccagagaacctgggaccatcctgacgtggctggtcctgctgtcctcacagcctgaatcccaggctgtatgaataggagaggttcaagtccagatgactgttcacgatgctggtcccccttgcatccctaatcatgctagagacatgaccagggtctgagaggaggaagttacagcacagcaccaacaggggcttttggtaaagggcctgggcactatgtgaagatcacctagatgctcaactttgggaaggggactgagttaattgtgagcctgggtgagtacctcaactccagaggtagctttagcggaacccctctatacctaacacctggcaatcagagggctgaaacacttggccagataatgaattctcttatccggtgggaaaaggctgtaaagatcaaaccacctttcctatgggtaagcaagagtctgtagtttatgtaaaggcagcagctcctgtgggaaggaaggaaacaggaaatttacatttggaatggggacgcaagtgagagtgaagctatctttaaaccaaaggtgtcaggttatttggtttggtttttgaattatctggaagttccaaagaaagaacacttctccctgaggatttgattgcaaaattctgacttcaaacttctaaaaagatcaaatgttaaatcagatagtaggcttggaaaactctatttctctatgtaaaaagtagagaactacttttcttttgtttgatcattttattttgtttaggaaataagaggattagataccctggtggtgagtggggagggcagggacatttgcacagcatttctggataaattagatccaaataatcaaatcaaagactctcagctcagaaagtaattaaagatctcctcacccacctctttaattttgcaaatgaagacagtgaaactcagagaggttatgaacttgctcaaggtcacacaactgatcctgatatcaaggtccagggcaaagccaagacagctcatagttctcaccagcccagacccaagggagaaaaaaacatcatagtccttggccacggcagcatcatttgcatcccaaacattctttacccaagacttaatgaactcaaaaagaaatcctgagttccaaagggaaataaaatcattctgcgtctgttgaaaaaaaaagcaagctaaagtggaacaataattgaacttgatattaggggaaaggtgcagccatctgcagactgagagaagggtgaaaaaaacaaaatgaaaatgctagtcttgtgttcagacaatgattatgaccatagaacactacctataagttctgtagagctaatttctttcccagtgggttgatattctatgatagattgcatcagcggtgtgattgttttggaccatagaatacgtatacagaattggcttgttgagccttctggtgtcttgaagtgaaaatcatatctctggacatatctgtcaggcctgaagccctaggctactggaaagaaagataccatgacttatccttcctctaaagcttagaagttggagaaaaattctagttcttgggaagctctgcaaagcagggttcgttaagctgatgccacaggtttttgcaaagcccctcagcacagtgtttaagaaaccagtggctctaggttgacctttggggaaggaacacagctcacagtgaatcctggtaagtggaggggagcattgaatcctctgcctgaatgtatccattttatgccaatgaattgagatatggcttcttgccccatctctgccacattcaagtcctgcttggctaaacaatgctcacggatgtgcacgtgtgcagtgggatgcagctttttctaacctctcacaaaatcacgcaaccccttcaccaaactgcttggtggctcttctgtgccctcacagcccttctagtttagcagttagaggaagacaagtgcccaagggctttctcatttttaggtcattgtggaaagaggaacgttggtgatatgtttgcctgcttgggaggaaaataataatgatgatttactcattggtttctatatgctagttgatgtgctgcattctttctcttatcacatttaatccttataccaggtctgtgagttaggtgctattattatcctcattttatagaagagatatatttatattttatatttctatagaagcacagagatgttgaataacttgttcaagccgatgaagtaagaaagagaacctggagtttaattcttggcactcagattccagagctaaaagcttttcagtgaggggattatgtctagagggaatgtccctgatgctctagtctctaaggttgctaagataatcgctaaagaactgcgctctcagcaagtaaagccaggggttggtcaacaggaccacggtgacccagttacatattcttaatccttacaacatcatcaagcagttgctgttttccccactttacaagtgaggaaactgaggtgtagcaagttaggaaacttgtcctgagttttaaactcaagcctacctgccccaaagcctgagctcttttaaattaactgcaactgctgaccagttagattaactaattacttaattaataagataacaacctaacaggctgtaaggtaaaaaagtaatcagatttgttctataggtcccctcccttttcgggaatagctatacaattgtataattttatgcttcccctgggagagtgggtggagccctggctcccagcccgtgatggaagggtcttggcagtatttgtaaagcagtctgtgggggtgtaactcagggcggatctgaaaagctggtctttggaaagggaacgaaactgacagtaaacccatgtaagtctgaataatgcttccaaatttctccctggaaccctgatttccaaattttccattctgttttataacccaggtccaaaccacagcagtcccattaatggattccagtgcaaaacaactgctggtgtattcctactacacgcaggtctctgttgtttgccctcatgtgctattttatctaatagctgagaatgacagtaccaatggagcactgagttaaggagtcagactgttcgaaggcttcattcttcgttataattggtgagattttccatgggactaagagaaaattgattaactctctgagcctctattttcctcctctgtagaatgggggaggcagttcctgttcccattttaccacagccggcgtgctgtgaggggatgttggtacatttccaataaggggacaatgagtgtgaagagaaaggaaggccccaggtggtccgtaaactcttccaccagtcccacactataaacagctggttttatcagggggattcttggatgacaagtaagcacttaagtaaatatcaaggggagtttgggcaactgagtttttgtagatcctcgtgtcattgtgttatactggagccaatagtaagctgacatttggaaaaggaataactctgagtgttagaccaggtatgttttaatgaatgttatttgtttccaaacataagccaccatccttagaaattcagtgaaagataaccgaatctcctgcccagttattagcatctttcaccatgggtctttctggagaaaatgacaatgtgggcagcccctgactgcagcccctttgggactgtttctttaacacctttaagtacttgggaatgttcagtgtgtttttgttaatgttggagatatgtgtctgacaaatggaatctgaattgaagttttagtgtgtaggggcagaaagcatttagaaaggacaaaagaaggacagattagactaaaatacataccaatggctgggagtatgcaatgcaacccaatccaaaaggaaacagtgagatgtagcctgctgattaaacaactgagccagcactccgtgtcagctgacttgtcttcccaaagcttccatgttggtgcaattaggaaaagaattgtctaatccccataactcaaaatcttggagccaagctaaattgggtaaagccgtgtaagattttctggtactgacactgactacaagctgatatttagggaaaagttaagattgaaagcaaatattcaaattagtcagaaagaccacgaacttctgaaaacaagccccagggtgctgttaactgctgcatttctaattgggtcctcatggaacattttcatctctgccttgtctgagctttctgcaccagagaagccccttttgatacccactcacttctgagtccctcattgaaaaggtggcaactaagcttagagaaggattccctaatccaaatgcaatacttgggggaatattttgagtattgctccaccattctcaaaacaaacctaatttcagttaacttgaatgtagctgaaattttgttccatgagggaatctctgctttctatgataatgcaagctcatttcaaacaattgtttgggatttaacttttgctcataattcccaaaagataccaactattcaatgagtatcttaaaataaaactacttttatgaccaaattattatccccattagaatggctagaatcagaatgtcctagtatgtattatgtgaaccccatgcgaccttcctaaagtttcttatgcctaaaacagcataagagagaaaagcatttccacgctaacctgtgtgttcactggttaacaaaggtctaaagagcaggtgagtcagctgctccatttccaaactggactggacatttacagtcctgcagatactaaaaatgataatcaggaaaagcacacacaattctactttttcttataattcccatctttcccaaagaactgttataaattctctcccaaaggtgttatattcatccttcttttgttgcctctatttgtgatgtgtactgaggtgaaatatttgttgagattcaaaaaccccatgagatttaacttaagctttccctgtcagagagattctaagagctaaaagatgggaagctggtatttgggaactagattaaaaagaaaatccaaattaatcccaaggagcaaggctcaatagatagttatttagacataacatgtccaccctgcaagcctagttgctcagttgactgggctgcccctatcttagtcttgcctggaagagaaataagttgtttgccccatacctgtcttgagaaatgtcagcctccagacctgaaagcttcttgtgatttggtttatttctgtagagtttattattatacacagtgttcttgaagtaatagagaagtgcattagaagctcctgcaaatggaaatgaaatgtaaatttagattgtaaatacatgactgcggtaaatagatagcaagaaaaaggatgaagagattagaaatttgccacatttctctaaccctaaagggatgtttctataaatagtttaaaactgtagaagacgaagggggaggaggaaggagaacagaggcaaacagattttctcctaatcctttccatttggcaaaattagaaatggtttttcaattaaatttccctgagcagaggaagaaaccatgtctgtttccacactaaaattcctgtgggtgggagtctctagagttgatttggaggatggatccctgttagtgacaagtgctggtaatgctcctgttggggaaaggggatgagtacaaaaataaatccaagtaagtgtggagggacaagaagatctcacagtgcaggatttcccctggattttctgcattgccttttcacctttcctgtcttagcacgacaaattaggtcccagatgagcaggccctcgcattcaaaccggaaattttaaggaggaagccagattaactttactcgggagacctagtagactctgactttaaagattcttttaatccagctgtttttagggagagctctgtaaaagatgaaagaaatgttttaaaaaaaaattaaaattctgtggggtgaaaacaaagatgttaaatatttgattggcaaggcaactggaaaatctggaccatgtctacaactgctaaaggaggctttgtgaaagagaaaatgagcagcccaaggagatcctgtcctaaacttctctggccagtgaaattcgggccattctctgccacagccctggactgctaggagggcagatcatatgtcttcctcagtggggagaggtgggccctcgctggcagtttctgtaaagcctcgtgctgtggtgtaattcagggagcccagaagctggtatttggccaaggaaccaggctgactatcaacccaagtaagtatgacagggtgaagctacatgcagctgagtacagtcttttcctttctagaccgtgtcctgcaagctctccttgagggacgtatactcattttgcattgtcctttgtagagaagcagaccaggaaagacaggaaagccctcaaatttccacttttaaacacctccctgtaaaaactgtctcgcttccctccccttctacaatcagtttctagtaaatcagaatccggtgaattgatatgcaatttcaacgaaaaaaaaagcagagaaatagttaccccaacaagtgcaaaaagtagaaactatctgagtaccagccaagggaagataattaggaaagaaaaaaaaagaaagaaatggattactggaaccatgatggcagcttagtcacaaagaaaatgataaaaaaaaattaaaattaaatttcaaaaactttaaagatatatacatatatatatatctatatatatatgatatattgtcctctggaactccagcactcacctacagcagctgcattctggacttattatcaaataacctataaacctgtagcttaatgaagagttgagcaatcgtgactatattgacccccaggacccttctgcaaagagcagcttctgttcctgtttctgtaaagccttctgtggctgtgagaatagtggaggtagcaactataaactgacatttggaaaaggaactctcttaaccgtgaatccaagtaagtttgaagggagtgggggaaggggggattcaaacacttctgatttaattacttgcccctccaaaacattccagcttaggttccaaatctaatgtttgtgctggggggatatggtgcccatcagagggattagaactccactgtacaaagactaaattactttcagcccaaaacattcctatcattcatcttaaacaagattattggtgcaaggagaaaaactgaatacagaatcctgagggatccagctaagggtcaggaaatgtttgccgaaaagataaagaggaaattggcatatcgtgactacgcaaatgcagtagaccaaatataaattgtcctgacttagatactaacactcctcttaaatttatcgcctgaaataatggaaccctgcaacttcattaactaatgctgaaaattctataagcaggctccttttcttcttttaccttcactttacctctctgaaaagaactgttctcaatccccagtctggtaactgaggtccagtcagttaactgtctggttaactcaggcagagcatttaaccccactttttccttggttaccaaaatagtggattcagcctccactttacttagttcacctgagaaggggaaaattcatctgtcctctgagtcgtgagaatagagcagtacattctctccttcaaatatacacccacccttccctaatggtaatgtgtgagtacttagaaaagtttttaaatgttagatataaaagtaaggcacagtggttgctaatggcacttcttgaaaatctgcgctgctggtggacttctgaaagtggtgcttataaactaaggctggagaagactgacttgtaaaattcagataaaatgaaaatgggaaaaacttatcaaagggccccggtctcctaagtgccctgatgttgagtaaaggccaaatgccccagttttacttactcagatctgctttctgtgattaagaagagatgcacactagagagaggcactttgaaaaacacagcccaggcaaaattcttaaaaagactggctctggtggcggggcgggtggtgaaggactcagggacaccgtgcatgcagcattgagggagttaatgcagacttgctagcagacagcttggaacgttctgggataggccctgcctgaagaacatgcagtgtggttagccatcaagttcccatgtgcagaagtgccttgctcagcaggggcaaaatcagcacgtctgtggcaacagcaacaatgaataatatatgatgttaaatcccaggggttccgcagtctccactgaggtcttatcaaattaaagcttcaaggggattcatatgaacatcccaggagactcaaggactcagtcgcttttcagagggtgggcagccaatgctagggaccagacagtaggcttttttctttggtttcttaccggaagcacactagggcggggctctgcagtgggttttccagaatgcagagaagctgggagcccctctcagcacttggtcagcctcttaggggactgagaactgtaacaactcctaccctttaaaacattgacgaggtcagggtgtttgacagcctaaccaggcaaagaaaatatctgtgcaaggctagcattcttccagagctctggacagtaatcgtatgccagattttccatgcagtggactctagctgcaggaactatatggcaaggctggagtccaaggaacccatgattaaattctgttttcctgcagtaagtggaacacagagattattgccacagcaacactttgggtgcctgtctgtttgagggcctcagctgagggcaggcatctggttttgcttatgtcctgcggaggctgaagagagggtgggaagccctttagacagtgaatactgtgaaatagtgaagagatgggaagggtcgtttgaatccctgactgctgtccttaaaaaaaatggatacgtcttcttagctaaataatagcctttttctctcacccttttcatgatagtaagcaagctaaaactttaaccctttgtaacaagtggttgcttgaagacatgactaaacaggctagcataaattcagcccaaaaaaagtctgagttaagaaaactaaattctattaaagaggtgtctgtttttcacacccctggggacagggtttgatcatcaccacatcatgaaactgcctggattttgctcttcacattttttgtgacatccagacacagccagggtgactcccaggattcctgtggttgtgtctgttggcaacagaagcattatttggtcaagggatgaaatttacaggaaccccaagtaaatgtgcaaaagcctgcccctaatagagacctcacttaaccctaccactgtggtcaccgggctgctctgtgaggtcagaacacctcaggtgagactgtggagtaaccagatgccctggttttcctgggtttcaggggttttccaggacaaaggtcattctttgctaagcccagaatgatccccaggatagttaatcaccgtaagaaggcacagataaaaacttttttctgtgagctactacttacatttcaccaaattcaagactgacaaaaaaactacgttgtgtgaaagctcagttacatgtgcccatcatttttatttcttatgctagggcatgaagggaagctcaggagatcctgtttcatgaggctacagtctaaatctcatctaattctagtcagtctccaaaaagctgaacactctcctcttgtctccttgtaatcaattcattgtcatcagaaatgtgtgacacctcgaggggaggggaggacgtgtcttgaaaactgatcagagaaattgtcctgaaaatgatgctgtaaaatggaaatgagacctttagaaagagagatgctgaacatgagaaatcagtaagcctcaagacaaaaaccagaggaaatggagagagatgggaggcaggaagccggacctcgggggacgcagcaggtcagtgtcccaggaccagaggtggaaatggtcttccagcctttggtgggatgaaactgagcctcacagacccaggcccctttgggtgagtttattctccccagaattaaaagaggaggaagtctgcgagcttcagaagtccccctagggttcttgtaaaggcctccagtgcagtgctaatgctggtggtactagctatggaaagctgacatttggacaagggaccatcttgactgtccatccaagtaagtgtaacaagacacagcagtatactggaaattctggaatgtcaccccagtgtcaggttttaaagaaccagatattgcttaaagttaagtggtgtcctctgaggtcctttctcttctttaacctcaatattcacagattttcttttggaccctgagttgttaggtctgtctccctgctgcgtgtacagctgaccttgaccctggaaagtcagaatctttcctgctttcagtgtcttctctggaggtgatgccctaacttttttgagggggaggtcatcctttccaaatgactcccctgagtaacctgttctaatgtttagtagcattccctgtcagaagtccttccttacctcaatcttaaattattcttggtatagccgaggccgtttccaccagcatcatccacaataaagaggaaaattgagagcggagtttgaataggtatgtggtatttggttcagaatgggttttaaatgaaagtggagagggaaaaaatgaaacctgaatgggaatctgaggtcttatttcaaatccctctctgtttcctgtctgtcatctccttttgcttctatagatgcaaaactacagagagagaggcggggagagaaaggatagacagaaataaacatccactgtgtccattccctgtcactgaaaccaccaggcaagggattacaattaattccaaagagtttcagatacacggcttaatacctttctccttgtggtgacttgtatcctggctgataattagagcagatagaaagatttggctttggtgtgtttgccgctgcaccccgctgggaagagacagaaacttgactgttttttaagattcataaagttccttctgtcagtcgtcgtaaaactccctgaagcagggagatgcgtgacagctatgagaagctgatatttggaaaggagacatgactaactgtgaagccaagcaagctggaaagacctaaactcacagtgttccttatgtacttttgctcccttccccgtttcaggccttttggctgtttcctgtagggattctaagagagtcaaatggaaatggattgaagagagtctgaagccccgtgggtgctcagaaatgataaatgaaaggaataagagacagaaagggaaacaaagttgaaaagcaggaatatgtctttcactgcagcttgataagactgagatgtgaggtgggtgtcagagaagggcatgatcgctccagctgctattgcagaacactctgttttcctaggatctctatcaagggcagtgtcctcttatgccaaagggatgagtcaagtccctatatttctggagtagctgcccttgtgcaggcatagttggtcaggcagacagcacaatcccagctcagtgtgtatggaggaggccacctgacattgccagctgtatctgctccattcagtggcagcataaatccataccaggtgggtgtggatttggaatatgccagtgccactacaaggctgaatgttgagttgttgtgatcatcttgaatgtgtgagatgcctccaagtgaagtctggttctaatgagcagggtgcaggttggaccaatattgcccattttctgttgagtttctccaagcccagtagtgtgggagccaacattgagagactgacatttgagctagggatcctattgactgaaatatgccaaagggatctgaaaggtcaaaactgccttcagagctcagcctttgttgttatctctctggcagttgtcatttcagcaaaatgcatccacttagaaagctcagctcttcattaggcagacaaatgagaacaacatattgaccagagataaggagttgggagcccagatctcagcctctgagagcctggcatttccagttctttaatcacgtgagccagtgagcatatgctatctcagagaaagcagatcaatggtgcctgaggacctggtgtcaccaagctagggcttagagacagaaatgagatgcagatggggatgttgtgtgaattggggaataatagagaagtgaggaggagacagggagttcaatgatgctttttaaaaccagcagcatgtgagaaattgtaatgacacaaaggtgaagaagtatgtattgcatataatcctagcaagtttcctaccattcccaacagaatctagcctcactgtggctccaactcacagatcctataggtaatgctgaatcgtacctgagatgccttttgaagtggcatcaagactgggctctaaaatctttaagagtcacctgtcagttattgtaaaggtttggatggctgtgtgaaaacctcctacgacaaggtgatatttgggccagggacaagcttatcagtcattccaagtaagtgtccctggggtgctgcctgtggagtgcgctggggctaacagtctcatacattagggcttaaatgactgtgcagatggcatcgtggttgaggacacaaaactgagagaatcgagatacattgactctgatcagaaaaaaaggtcacggaatagcaaacataggtttagtccttaaaaggtagcatagataacatgggacttgaacgtggcaatttgaaaaacaacctgtggtctatcagcacgttctcactgcacacgggggataaacaggggtgggggaataagcaatggacattgcatgataggggtgctagggaaatgaggcaggtcaggaagaaggaaggtgatcagagcctcatacggagttaatctagagaagatgaattgttccataagtttcacaaagaaataaagtccaaagatataataagaagtcctgattaaaatccacttcagaatcatatgatcatcaggagagaaattaagtcttaaaagaaaaagaagtttttaaatgtaggtccataaaacaaatggacctacacctttaattagacagcaagcagcacaagatgcacgttagccttccttttaatcccctctcaggaggaatcagtctctccagctgcacatggtcacagctgctctaagccctggagctccttcccagtaatacccttgctcctgtgcctgcacagggaaaggagatgcctgcctgcctgcctgcctgcctgcctaccggtctgccttttggtccgccgcttggtggggccccaggtgtaacctctggctgtctcttctgcctggtttttgttgagcttcctatcacagtggaacaccggtaaccagttctattttgggacagggacaagtttgacggtcattccaagtaagtcaaagaaaattttccatcaccattgtgttgagcaaaccctttaaactgcagaaagagctgtcaaagtctgctactctatttctctgcttctaggtataactttatctggaccagagtaaagaggcccccgacccaccccgagaatgatttatgcttggacaggtctttatttcattccttgaactatctatctgtctatctatctatccagctatctatgtatctatctatctatcatctatctcagaaatagttgtttttaacagttgattctgtgcctcacccaaattgtcattaactaaatgcagatgtgctgccacactgataaacttcattggaaaaaaagaaaaaaccaaacccagagaatgttccttgaacattcctgaagtgggggggcaggcgatgtcacttgcagtgacagctggcctctctagctcacccccacatctgtgccaaccagagaagctgggccctttgtagcacaagcctcaggagcagagaatggagggacattctcaactgagaggagagggactaggaggctagatgggaaatgaggtgactctacagaaaatcgaatatgggatggtataaaaggatgagaaagatggcagggggtccacgatcgctcttgtatttagacctgggggatgcactgatagataccacctggagagagaaagaggatttctgtttccctctgaagaaaaatgtggcagaaaaatcaaaacagatcgcacatgtcaagcctctcctaattacagcctttcattctggtttctctcagctgttccagcaggaaatggtaggaaagggtcattggtgcctttgatgttgtggaagcattgcaggaaggagatttgcaagaaacggggcaggggcttgcagtagagtctggagagtttagaatgatggtttttgcaatgacttagaacactgtgtatctaactttggaaatgagaaattaacctttgggactggaacaagactcaccatcatacccagtaagttcttcatccttggtcaggaaatcagcctgcataagattctggggatcatagtagacatgcaggcttagagaattttcatctgtccttgttcataactggtagagacaggtggcagccaaatatctgagttttccgggggaactccagtcctgactatttaattcaaaactagaaaatatgattcacaattctgtttttgctgctgccgtcaagtgctaatgtggcatgtgaagagaattcaggcagaatgactgcatcttcactttcatcttgtgtgataattttagctttgagtactgcaagtgtttgggagaaatggtagaaacatagaatatcaaagagacaagcaaaccaagagacccagagaggcaggcagacggaacgtcaggcagtataattttacaaaactaattcagtgttgtgtctctctctgcaaatggcaaggtatcgggaaaggtgctaagagctagtgctccgggtggggcaggattatctaaatagaaaactaagcactgatctcagggggaaagtttaaacttggaaatctctgggtttggttttttgtttttttccaatgaagtttatcagtgtggcagcacatctgcatttaattaatgacaatttgggtgaggcacagaattaactgttaaaaacaactatttctatgcagccataaaaaatgatgagttcatgtcctttgtagggacatggatgaaactagaaatcatcattctcagtaaactatcgcaagaacaaaaaaccaaacaccgcatattctcactcataggtgggaattgaacaatgagatcacatggacacaggaaggggaacatcacactctggggactgttgcggggtggggggagtggggagggatagcattgggagatatacctaatgctaaatgacgagttagtgggtgcagcacaccagcatggcacatgtatacatatgtaactaacctgcacaatgtgcataagtaccctaaaacttaaagtataataataaaaaaaaacaactatttctgagatagataaatgatagagagagggagatactggatatatatacacagttaatgacaatttgggtgaggcacggaattaactgttaaaaacaacatttctgagatagagagaaagagagagatactggatatatatacacagggtagaagaatgtagagagaaacatgggcaaatatattcttttgcacctacaattaaaagctgtggaaaatttgaatatgttcactttgtaaccaaagacaaccacacaaaatggaacggaaagcatgcttgcaacagcgagaactggaagtatggaacctttctgtcttaaccactcagttgcctagaagaatcttttttctattttgctgcattagaaattaaaggcatgagtattgaggatttgggtaggtcagacttttatagtgacaatcacattacaaagcacctcttagctaggttggataaagcacctttaaacatcaaagtctttttcttctttctggatgagatagaaaaatggtctctcctcactctgtatctaaggacagggggctcagagagttccagacttacaaagtgagactgcagcagagctgagccatgggacctggagggacccagtgacggttagtctgctccctcccacgggtgctatagtagccacaaccgttcaggaaaccgtccccaggtgagaacgtaacacacgcagggaaaatcccactgctactaagagcaactcagcataagaatgcattacccagcaagggacagtcagaggggctctaaaccagagccccaaatatttgaaaactttatgtggaagccagctataacaagttcgttttccaagccgtgcttccagaagctgttagtggttggtagttgctaagggttttgaaactggaggacatcatagcagagtggaattatttggcacaaggggctatgattagaattaatgagatgaaagaaaattctggctagaagactagaaaaatccggaaagaaaagatacagtaaaccttgggggagttgtagcatttatcctagtccaagcagcaaagagcagacagaagccaaattccaataaacaattggcctttttacttttacaagtttctgcaattatcacaatgtcttcagcttcttgggcaaatatcaacaggtcctaaatgcaaagtggaacagtcctctgtttccagaaccgagtagcttagccccgccccacacaccacccatgctcaaccactgtttttgtagaggagtttgacgctgtgtggaatatggaaacaaactggtctttggcgcaggaaccattctgagagtcaagtcctgtgagtataaaacacactcaagtcccaacctgggtttcattgcatattaaataaactttttctggctgggaagtatttgattctaaagaaaggaaaagtgaaattccaagcgcaacgcaagcatttcattagtgtgattcattaagaatttccatgggttgccttcgagagcgttaatcacatccattcactggtgagacccacagtttgaaaattgagttaaatttgaaaaaaaattgtcaccatctctgtagaccacagtgcttgctgtttgggtgtctagacttccaaaatggaacctcaatctgtagtttcgagcttggagatttatcccgagcccgtgacttagagatgtgtaagaaaagctgcacactgctgggccttgtagggcatttgtgggatcagtgtcatgaaatagcctgggtagacaggttggtgaggagacactggtgacaggtgtctgccctgtttctgtaaagctgctgacagccgtgagaagaaaagcagcggagacaagctgacttttgggaccgggactcgtttagcagttaggcccagtaagtctgagcagaaagtaagatatttatgccttttcctattatttgttctagcctgacatttgagttgtcctcctttggattccagatcaacaaaccatagtgtcttttcatactccttttaatatttgtggctaagggccctccgttcttcccatctgtcctacatgagggtcctgtggccaggtccacattcataaagaagccaacagtgatgcagttggttggcagtgtgtcaagaaactgcagtcatcatctccagggcccttactctggttatgtgtgtttcaagcttttatgccagcaacagaggagagggagaagtgaccagtagcaatgaccagggctattagctgtacctggtgtctgtgggtttcagagcagctgtggaggttacgggaggttcagggcatgagtttttctggcagaggagtttatgtaaagggttggcccagagtgtgtattcaggaggaggtgctgacggactcacctttggcaaagggactcatctaatcatccagccctgtaagtgcttttgcctgggaggtggggttcaaaatgcagtcctcatggggacatttctaaaccttggctcatgtgcttctggtgccactaccatttttggcactatcctacttacatgggaggttttgagccatgtagacaaggaggtgatgcagtttgtgctttggaggactcctgagatctgccctttggcaactgtgtttgagtaggagtccctcattggaaaatctggatgccagcagacaaaagatatgagcttaggatgggtcacaaacaaatggaggccactttgccagcagcacctttgcaacgaaaattgctttcataggaaatgtggaaatggctgtgtagatagagatttggccatttctccttttctgtctttataccctcttctctgcctgacttagggaccttaaattagagcagttattaatcatttgatttctcggccccatcactcatcaagtatgacaagagggattcattaagataaaacccagaaacagaaaggacaaagaattcaattctcaatgtcttcagagttgaacttgacaactcctcagccttaaccatctagtcagcaccccatgaccaactgaggtcaaagagggcaaccagcaggtaatgttagtcaagtgagtatctggccagagccagctgccctcataggaattaatactgtggagtttgggaaagggaaatgcatctgtgagggctcacccaggctgcccatctgggagagatcatggggagagttctgagtgagggagtgaacaccagatggaaagtcaagcaacaggtttctgttatgaagcatctcacagtgtaaataccggcactgccagtaaactcacctttgggactggaacaagacttcaggtcacgctcggtaggtaacagaaaccgtgaggtaacttaactgtgtgttcctttaaaacaggggatactgcagaggggatatcctggctggatgtagtccttccttccttccagtgggaggtgatctcactgaggacacatacctgcattcagtcagttcttgtgctatttttatacctgttacggaggctttcctttccacctgtgaaaacagaacctctctgctccaagcttcttcagtctttattaccctatgtatttcctttagaacagtggtttgggaattaatttatcatcaggactttgtctctgatgatatcactctgggcaacaaaatgaaagggctctcaaatagagaacagagagtcctgaatactcggataacttctccagagtgatatgtgttatgcgtaatgggatgaagtgggctagaatgaccttccaatgactgttttggagacacactaaggaaacttgcttaacatcctatatccttaacttgttagaacattggtgaagtaaagcaaaatcttgaccctctaagaacataaacaaatgccaactcctctcccccaaagcactgccatgtttcattatgtgcaattatgaaacaaatacatgataatttatatgaaattacatagatgagtagtttgagtattttgacccatgagtaagatgcaaattgtagaagttctcaggtagttcttcataaaaagttgtccctgaagacaaatagtgtacctgggcataatttgtttgcagtgttggtttatgcaccatttgggacctgtttgaaagctgattatgtcccagtgtgccaatttggggtctcaattaactgtgctcagtgccatgataagtgcccatatttacagtctagaagcatgacaaaatgaccccatttctgtaggaaaaggagaatggaactgtgtgtggcgtggtacttgtcagtgctgctcccccttgtccctgccatgctggaggtggctgcaagttttccccaggaggtttttgttagagcatgtattactgtgacaataacaatgacatgcgctttggagcagggaccagactgacagtaaaaccaagtaagttgggggaatgggtcaatcttaaaagctgacctgagtgagcaatggtgctgttctgggcagtttctgtggggttaagacactgccactcccaagaggatctaagtacctggtttctttgtgcctgagaccctgagctggttggaagtctgttagttgatgaattcctggcaatcttaaggattaggtcaacgaagaagtagaaaatttcactggtttcttcattggcttggctctggatatataaaaatgctaaatataagccgggtgcggtagctcactcctgtaatcccagcactttgggaggccgaggcgggaagatcatgaggtcaagagatgcagaccatcctggccaacatggtgaaaccccatctctactaaaaatacaaaaaattagctgggcatggtggcatgcgccggtagtcccagctactcaggaggctgaggcaggagaatcgcttgaacccggaaggcggaggttgccgtgggccgagatcgtgccactgcactccagcctggcgacagagcgagactacatctcaaaaaaagaaagaaaaagaaatatggctgagaaagtggcatggtgctcctggtccctaaagtagcccctgggacctcaatgttgacctcctgtgctgggtgggatgtttctgcccaaccttgctattgtgcctctggcacaagcattctgtcagaacccagtgtcctaggaacaaaacaggggatttacgatcaagttcagatctatctgcacagccagctgttaattttagagaactgtcctgaccttgcaaaggaactggaaacagaggctgcaaggtggggagacttccactagaggggaaggtgatctcacttgctcagccttcccctccatccttcccacctgttgattattgtaaagccccataggactgtgtgaattatggaggaagccaaggaaatctcatctttggaaaaggcactaaactctctgttaaaccaagtaagtgttggggattcaaagtcctgatttatcatcagtactttgtcactctgggcaacagaatgaaagggctctcaaatagagaacagagagtcctgaatactcagataacttttccagagtgatatgtgttatgtgtaatgggatgaagtgggctagaatgaccttccaatgactgttttggagacacactaaggaaacttgcttaacatcctatacccttaacttgttagaacattggtgaagtgaaaacaaaagcagtaagtgcaactaaagtgcaatgcagagtgagtgagaagagacttaccaactcctttctctgtgatatcttccccccaccttcacccttgaaccccacagaattgtttctgtccatgcccctggctgttcccagtccagaccagcacgtcgttctgctggacataggaaaactccagacttcataacatgtcacagggccccctccctcagatggcagatctcaatattgatcacccacatcactgtggggagtggtgaccttgtcagcaatggtctcatggaagagggaagctttatttacaccatcaagggcccatggatgacccacagtctgtgtgactgctgtgtgattggttttcagacattagctttaataggaatcataggagaagggacatggtggctactgcaaggggttttttgtttagggagaacgcactgtggaactcaaattccgggtatgcactcaacttcggcaaaggcacctcgctgttggtcacaccccgtgagtttttgtggtttactaattgtcctctctggaaagaaatccaatgggacctgttgaaacacagctgaatttaattgctatgcttagcatgcagttgttaactatgtctgatgtgtgagcaagatatgaatacatgtttccctggaggctggatttggttatcaggtctcggggcagtttgataaattgtactaatgctgcaatcactgtttttcaaaggtccacaaagcacgttatggctttgggaaaggcagagataagaagcaaagctttgtgatagagacagaaacaaggccatgaaaagggaagctaccaaagcaatggcatagccaaggaagtgtgtcctcaacagataagtggcaaggaccctgttgagttgatgcttgtgttgtctggtagaattaaaaaataagatgagtgggctgggcgcagtggctcatgcctgtaattctatcactttgggaggctgaggcaggtggatagcttgaggtcaagagttcaagaccagcctgatcaacataatgaaaccccatctctactaaaaatacaaaaattagccgggcgtggtggcgggcacctgtaattccagctacttgggaagctaaggcaagagaatcgcttgaacccgggagcagagattgcagtgagcctagatcgtggcactgcattccagcctgggtgatagagcgagactccgtctcaaaaacaaaaagaaagaaaaacagaaaaataaggcgagtggactgaggactccagtgaagggagggcagcaggagttccaagcttggcatggctttcttccctatcgagatagcagaacaatgtaactttctctagagagagaacagagcccttgatttatcacatcaatgcttctgtttaggtagcccccttcctcaccgtagggacaaagcaggcccccacatggacttcacccccttaactaggctggccaagccaaccctatgggagaggcagagaatcccaggactgcagagggcctccccatgtccactagattatctgtaataaaacagaatatttatccaagttgtgaagctgtgagggagagggtaatcgtgatagattataaaaagcaatattgaaaattatacaagctgtctccacacttgcagaattcagtgtgttttttgttgttattgggtttttttctgttagaattacagaaacaggggtgctttcctgcaggcaccctgtttgcaaaaatgtctgccatctcacatttcagtagtatttcatcaacaatcttctgcacacgaaccagctgtgacaataaggtaatggggctgatttgttaacaaatcgagtttatacatttcaatgagtggcctagtcaaaacactcagcttgaagcatccaacactgtccattgctttccccctccctgaaaccaccctcaaaggccaaaacactttctttttgtagcatccatgatggctttatcttttaaaggtggattttactcttgataatcaaaatcctttcagaaccaaggctattaaatagaggagagaatcgactagttactgatactgttttggatccaaaaatagatgtaactataaaataatgtcatgggtttgtttatgtggctcataaactggctctcggggggaatcctagatggaatatttcagagggttcaacagtcatttagatgcttaagtcctcatatgttcactaaatcagactctttaattaataaacatgcataaagatagcatgagattgaagaacttttgcaaactcggacccaatagaagcagtgaagactttctgtatgaattaagatataatccgaaataaattacttgtagaaaaatacgaggtcaaggcctttcaatggggaaagtgcatgtaatgccccttttattcatggagagtaaagctgcttccataaatggtaacattatgttggtttatgtagagacacataacactgtgactacctcaggaacctacaaatacatctttggaacaggcaccaggctgaaggttttagcaagtgagtattacagacaagacaggctgtattttaaaggttgttggtgttcatgtttgagggacaagggaaggtaggacaagggaaatacccatgtaaactgtgcaagctaaaatcactgctatctgaagcggcaattctgggtccctctactctggacaggaggggcgaaggagagctctgaggcttaccatgatggacttactgccgatttcataagaattgtatccatcattagcaaaatgtttatgacttgaaggcctcaagaaactcctgttaacacaacaggagttctgtgttctttattcttttaaaactatattctcactttacatttttcactcatttttctgcctttttttatgcgtctctcctctgtgcaactcaatgcttcatctgggcattcatattttgagaaatcatctcaagaggaaatcatgtccagatcctagcatgtcactcaaagctctctgaaatctgggccctttctattctccaaatttattcccactgattccctttcatgaatgctctgctccaggaaaactaggtatctccctcccttgaatatttacacatgcccacacctgtaccctgtgtccatacatcagacatcctggacccaccacctaaaacaggcttgcacaggtgacaaaatttggcctcatcatctctcagccttgagacccagcacaggcatcaccagatttagtttcataggaagagcatgaaaaatcatatcattttttaattaagcaggccaaggtaagagatccatcagacaaagaagcaaagtaggaaggagagagatggcttctgtaatgggtttgcaaaggagagctctgtccctgaaatagcactaatataatccaagtaggagatttacaggctgcatgtttcttggtttccctttggagtgctccattcctaacaccagttgttaagcccctggtcctgaatgtggccgggggtgaggaagtgggaggagaccatgctggccactcagtggtggtgcccatggagtttcgggctcagattttctgtgagatacctcaaaattgagagaagctcaaaaggatcatgcagcaaaaatgggagaagtcaccttcttagtcataagaggattatttctgattagtccttgagctgtgttatgtcctggggaagggacagtaagagtagaaaagtctctcctaggacaaggataggaagtggtgaaaagtccttttcctggtgactagcaaagcaggggatgaaaagatctggagttggagtccagggtggattccagggcagacaactgcataggactgtctcgagttctgtggattgaaaaggttgggcatcccttcagatgttcctgagctgacctcagtcagaggtgcgtggctccagcacccagaaggtgttgaccagcacaccaacccctcctcccaggtgggccgtgacagcttccctcaatccctcccactctgacaacagtctctctgattgcttttgctttggtgctctggacataaactgttactactttgtccaagtgaggtatataattttcagaacgctggagaattattatctaaaacaccagtggatacgctacaattttggcattcagtattctgggcttgtgcaggaaaactctttctttagaacatgtagaaagactatcctttagttatccagtgtggaaacagtcctgaaatccaaactgatactgcgatcctgtgccaggttattactgtgacaattacttaatattctctgtgctcacgatatcactccttccagaagatctttagggaaaacttagttcagtttctaggaggtttttgctcagccgaagatcactgtgtgaataataatgcaggcaacatgctcacctttggagggggaacaaggttaatggtcaaaccccgtgagtatctctgctgaatccataatgaatgctctaatttcaaaaggaagccgtagcactgagctctgttttctgttttctctacttaattttatcttttatattaattctaatggttacatgttatcgatacatggcatatgtatatatgaaaatggacatacatgtaactgtctggcgtgggaacaaatgtgctggagaaaaacagatttcttgtcctttttgtcttaaccatttgggtcagaaggtctgactgagtagaacatgggctgggtgagcactgcagtgggggaatccttctccagcagctttgtcagaattatgctctttgctggcctggtcagaaggcagctttgtcaggaggtggaaggatgaactagttaacctcagaagagcctttccactccgaccatgctgggaatagaccgccataataaacagtcttttccgctgcctctttagccaacgtcccagctggaggagcacgccggccagatttggggattgaaagggatttcctgatacacattggcctggtcggttttggtaaagctttctatgactgtgtaatgctggcaacaaccgtaagctgatttggggattgggaacaagcctggcagtaaatccgagtgagtcttcgtgttaactctgtcaaacctgtctgtgcagtttgaaatatctcagaaactgcctccttcttttttagccctgaggtttaagatatctagttatggctagtgttttcttcctgtccaccaaagctgaacccttgcctacccctcaatcaaaataactagatagagggatccatatgagcagggtaggaaggccattggagtgttcagctgttttcttagagagcaaatacattcgtgcattccaaaaaggcctgtgtgggagcactgaatattacagaaggtgagtgtgtagcacatttcatggccgctttagtctgcactatgccaacctcaccgtgggccattggtaaatactgttgctttctggccaaagacaggtcaagtgctgggaactctcgggactcacagtcacgctagtgacgtgctagagcacatctccccactgtggattatccagaatgactcaaacttgcgatataactcctgcatctctcagttctctttggcttagagccttattgtggatttgctagaggtaacaggaaaggaactgatttcatcctaattctagcctcttctgagaagttattctctgcaagagtcttcagggagcatcttacagaccacctacactattcagaattttgttccgcacaccacattgtgttcccagcagtgtttgctgtggcttttgctggggccaggtcctgagtcagttctggagctccaggcttggcaaagctggataagggcaaggggagttgtacagcagaaccaaagggcttcaggaaagacatctttgatatagacattaatgaatttctaaatgggcttctatatgctaacctgataagactctctggggagaaggtcatgctttcctttgcagctctaaatataagacacatgcagaaaaaaaaaaaagaatgggaaatgtctgttacagtgccaaaatgaagataatcagtataaatattagatttgtcttaatattaagtttatgaaatgtaagtctttcagaagaactatctcaggatatatttattaggtcaatgaaatattttatccatgtgactggtatacacacttcaaaggagaacccaaaatggcaggcaggggagggtggctaatgaaaggtatggcatagtagttaagaatatgaattttggaataaaactgtttgggtaaatcctaattcagaaggttacttaatctctttatgcctcttttttctcatctgtaaaatggggatggtaatagtacctagctcactgagatgttacgagatttaaagagctaatacctataatggactttgcataatggcagcccgattaaaagttttcagttaatatgtttttattgctactatgtcaggttgctggagggaaggaagaaaaatggaaatgatccccatttatagtttttgtaaagtacagcattagagtgtggctctggcaacacaggcaaactaatctttgggcaagggacaactttaccaagtaaaaccaggtaggtctggatgtttccaagtgaagtgcagttatccactctgttcattttttgtttaatcttctctgtctcaacttctaaccaaaaactcttactcttaggttatattttccttttataaaagtaagtagaatgtgtgtaaagtctggttgatatgatcctttctaactcacttggtttcagctagtggcaaaaagaagggtgtattggatctggaattcttaggttaaggctgagagaatgtgagtttggctgacttggaagaaataaaaacatcaaatgtgggtggttcacacaaaagaaggtgatttttcataataatatactaaagtagaatccacccttgtgaccaccagaattattcaagtacagtcttccaaggacaaaatgggtagcatggaaatgatatgtttttttggggggaaaaaacatggggagagagagagaaaggggactattagttgtctggattgttaggaaacatggaagacagcacttcttgttgtaaggtttggcaaaggttatcaccaagtagaagtccaaatgtgtgtaacatacccctggcaaacgttatagaagaaggaagctggggccgggcacggtggctcacgcctgtaatcccagcactttgggaggccgaggcgggtggatcacgaggtcaggagttcgagaccatcctggctaacacagtgaaaccccgtctctactaaaaaaaaatacaaaaaattagccaggcgtggcgggcgcctgtagtcccaactactacagaggctgaggcaggagaatggcgtgaacctgggaggtggagtttgtgccactgctgagatcgcgccactgcactccagcgtgcgcgacagagtgagactccatctcaaaaaaagaagaaggaagctgggagcagtgtctctcacctgtaatctcagcattttggaaggctgaggcaggaggatcacttgaggccaggagttcaagaccaccctgggcaacacagtgagacccccatctctacaaaaaataaataaataaaatttttttaaaaatagccaggcatggtagcatgcacctgtcatcctagctactgaagaggttgaggcaggaggatcacttgtgcccaggaggtcaaggttacagtgagccaagaacacaccactgcactccagcctggacaacaaagtaagatcctgtctctaaaaatatatatttaaaaatataaaataaataagttaaagaaggaggaaggagatgaagaaaatttggcttagtaggaaagtgtttttgtactgggcagaaacactgtgtcaaactggggcaaacaacctcttctttgggactggaacgagactcaccgttattcccctgtaagtccttacctcttgacaaaaaagctcttagtctgtaatgacaagttctcacatcccagacacctaatgaatttctaaatgagcttccatgtgttaaactgataaaactctctagggagaaggtcacccttacctttgcggctctaaatgtaagacatgttgtaagaaaaattgggaactgttaattgcagtgccaaaatgaagacagtgattacaaatattgggctagttttaatgttagatttataaaatataagcctttccaaagaaccatctcagggtgcatttattagtttgtgtctatacagcccaattgtccagttactttgattaatgttggtagctgatgcagatatttagggacttccttgagaaaacttctttgtgctcaaaattgcatgaattgaatggcacattacctaaataattgccaaatctgtttcactttgtgctgtatagactcagcctaataaaaacaaatgctgttgtgctttttcccagtctgtctcctctccacacagaaagtttccctttctactaaacagcatctcttcacacgaagaaaagatgcccagcaagccatttgacttattgctgctgctagtttgcatttatatgactcctttccttagaagggatgaagacactttatacgacttattagctaaacagattgacagcctaattaggaagagagaaacagatctgagtatctttttgtggctgctgttcctaccccctcgtgtagaacatttggtcagatggctctttgagacagaaataagacagggacgtggtctctgcttgtagtgtgggacgtctcagctgcacctaagaggttgtcacaggagtactaaataggtcagggcaactgacacagccaggaaaaatttctttcccctagaacttgtgtgtgctcaccaagcaaagcgtgactaatttgacatccattgttagtgtgtgtctacccttcttgcctttgttttcagacccttcctctctagatcctattccttccatctccaactcctgtatgtaaatccctgctctctcctttgaattcctgactgctatgcccatgcccagcaccggcacccccacgcacactgctgcctgcctctgtaaccatcagctgtatttctgaggactttcctagctccttgagtgatcctcaaatggctcagggcctgagggaatctttgctgagggttggccccagcagagccgctgcagaggtagaggtggccagcaagggacacagactgcctgcatgaaggctggagctgggcccaggatgaggaaaagcctcaggaaggaagggctgacacgaaataaggaataccatggcattcatgagatgtgcgtctgaatcctctctcttgcctgagaagctttagcttccaccttgagacacaaaacatgtggttatgaagagatgacaaggtttttgtaaaagaatgagccattgtggataggctttgggaatgtgctgcattgcgggtccggcactcaagtgattgttttaccacgtaagtatatcttttctcatttctgtgggctgttatgtccgtaaatcatatagaacagttcttcttatgcacacacacacacacacacccattttccagtcactgaggagaaacagtctctgggtctacctacacagccagtttgaccattaagatggtcaaattcatttttcaagataattttaactggttccatttaatgctgccaacagccaagggcattagcatgtcgtgggaacctaatctatgttcactcactgctgtgggaggacagtcatttcttcttctcccctggcagtcagacttcagaatccagctgaccttttccatgcctgtctcttctggcagattaagtggttatttccactaactttcttgtggaaaaacacacaagacagatatattctccttcagtttttactaagaaagttttgtggttatcattttgacaataaacttcagctagcatagtccctactattcatgttaataatatcttgacttgaaccatcatattttccccacatcattcacaatgcatttcaatgctgtaacccactgcaccatccccagcccttttatcttcacaacgttctctaataaggtaaacaggatcatacatcatcaaacatatgtcacagacagaaaagctgacacacagacaagttaaataatttaagtcaaaccaaaaaaaaatcataactgggattagagcttgagattccctattttcttacagtgaagtgtcttgagctgtcacttaatgcattgaaaacataataagcacaggccataggcattttcagaacatgaaacttgactgaaacaaaaactgactgtttgattgctttggtgttttaaatgtatccccaaatctcctttgctattgatagtcatttggtgccagtgacagggaagagcagaggggcttaggaggtttttgtagatctcagtatcactgtgtcttataacaccgacaagctcatctttgggactgggaccagattacaagtctttccaagtaagtactagaaaccaaggagccattttgaaaaggtgttttctttttctttttcttttttttttaaatgaagttttgctccttgttgcgcaggctggagtgcagtggcatgatctcggctcactacaacctccacctcccgggttcaagcgattctcctgtctcagcctcccgagtagctgggattacaggcacctgccaccacgcctggctaatttttgtatttttagtagaaacagtgtttcaccatgttggccaggctggtcttgaactcctgacctcaagtgatctgcctgcctcggcctgccaaagattacaggccactgcgcccagccttaaaaggtgttttctataaacaggaacgttctcacagcactgcaggccacccttaccaactccgagctctgtaggggcctttagcacctatagctgcagaaccttctataaaccaattaatctatatgtgaacaatttaacctatatgtgaacaccatggtgctgactaaaatcttatcagcagtgaaaagaaggcactagagcgtcagatgcattatgactctaaacaaatgatctgtttccctcttttgcatttttatttaaaatatcagggaaggtgaagcaagttcaacttctccaatttgaaaactgtttctgaattatgcttcccttgtatgcagagagacctagattgactttggatgtttagtcattcgatttaatcaaatgtaattaaatgagcaaataatctccaatagccaatattcctatgttgtttcattgttttatgtgctttgctctagactttttgtctgggctttgtctctaataggatccccggaaggacagtgaaggtttttgttaaggtttttgtgtctgtgtggatagcaactatcagttaatctggggcgctgggaccaagctaattataaagccaggtaagtctcagagatgtgactgcacgggagaggagacactagttgaataatgcacaaagtgtagcatgcagattatatttttaagaacaagtcagcctgctggagacaatgcactcaacccaaatggggtctccactcccagtgagaagcatgtcagccgctaactcttttgtttggtctagtagcttccggaatgaataatgcttaagtagccctctaagagagcagaccaggttgttagggaatatctaattccctctgatatggttaaaactctttgccaagggcagaaaccagcctcattccattggaagagcaaattcagagaaaaaggaaagggtcacacagccaaagacggtaaaatgttcaaaggtgaaaaatagccaagtctgcagctctcctgacatccttgctcaggctgctgtcccacgtggagagcagatgcctgcaaagctctcggtcacttgctggagtcactcagggttctgggccttgggatgtaacttaaatgacagtgtcagggcactgtcagaggaatatgaaggctgcagcgatgcctgcaagtcagcttttgctacactgggactgaggtgttctaagcctggaaagacacaaagctgtcctcatcccaacctgccgtgcccctccttgagggttagtgtaaggctctgaaggactgtgtgaattatggcggtgctacaaacaagctcatctttggaactggcactctgcttgctgtccagccaagtacgtaagtagtggcatgtgtcaggtggattctgtgtccatggcaagtaggaagcgacagcacccttaggtggaaaggatggctgaaggttgactttgttcactgctgtcatctcttatctgccgtgatatagcaggctgtcaaaattcccattctcctggatggcacaccacagtcaggggaggagaaacatgctaattttatgataaaccccaggggagaaaaagactactgtgggaaaatttagttgagaaaatcaaattgttctcaactaaatgctgcaggctttatgcttctgtgaacccagtttcccagttattcattgaccctgaacatacgtttacctgtgcaaatacaatctctcctaacctatttatacaattatgtgtctgccggtccaaatgccttcttctataggccatgtttttatttctcttccaaaagagactccagagccatccttgggaagagtgctgagaagtcaggcaggcctaactcccaggggtcagggaggggaaagagaaggctaagggtaacttagctcagtactagaactgtgatccacgtatctgtcactctatttcctacgtttgcttcccttttgttttctctagaataagttctttttgtttgctctggacacccactgctcccaggatgaaaggagagaaatgagatcagttttgaacacttcctcttgaaatataaagaatcaacaagttacagtcatgttggggacttcttctctctccaagcttaaatttctattacgtaagccttacttttaaccaagaaagttagtgacatggtatcactgtctgggatgctcacccctctctcttttctccagatactccgtgtatactaaagctcagccaatgctcagctttgtgataaaggagctgttgtgtgtctttatctctgcctttaggatacagtcttttttataacagaaaatgttcacttctcccatttatttcatggctggactctctaccccttcctggctgaaacagcatatgggtccatggtggaacttctttgggaaaaaaaaaaaaatagaactgtttgacttttgccactcttccctcatgaaatgttttttaggctatcaaataagcattattacacattgagaaggctttgaaaaaacttgatcactgagtctggaggtgagctgggatggctctgtagctggaaaatatccctgtgggtgtaggaatgtaccgtcccttcaaacttgtgtgtttagggctgagctcacacatacgacagcaagagttgttaacaaattagattcagctttggcagttttatgcctagaaatgcaaaagaattttaaaagctcataagtttggcatttttaaaggagacattgtttgctttatgttgcagagccaatttttcttcctatcataaaaggccagaaacacagagaaagcaaaaaaaaaaaaggaaaaaaaaaaaaacacaaggagagtctaactgccccctcaccacagtgctatgtgtttggtagggttttactatgggtttcagtaaaggcaggaagtgctgtgggaataacaatgccagactcatgtttggagatggaactcagctggtggtgaagcccagtaagtggccatgttttattgatatttgaccaaacaaataaatcccgtgaagttagtggagatttaatttaatatgtaaacaaatctacttcttgaaaaatgacttttgtgaatacatgaaacactcgtgattattgagactagagcaataatgataaataaaggcaaaatgagaccaccccaaatcacctttaacattgtgcttagccctctttcttctagagagatatggggccatgagctatttacagccgcagtatctcttaaactatgttctgcaatgacttgtgtgtttactctgattttagccacagaatttgttttccattctattaaaaatgagaatctatctcattttaaatgctactaatatttataaggtaccttctttgtctcttgtgcctgcatatatattcatttcaaaaagatctcataagaaacccaaacattgtcgcattttgacaaatgtccacatctagtcccgtaatgtcaaatttcactaaaaacacagcctgactatgcaaatgcagtggaagaaaaaaacaattcagaaatggattgacactcccaggtggctttataaacacctaaaaggaaatccagagtgaaataaaatggcaggtatgataacacgatttttttttaatgatcaattcctccatggggaataaaagtttttaaacttacctccttgaaaaggagggaaataggagttcaggagcctggcattcccaggtgtgctcctggggtgtctgtttctccacattgccattttggagacaataggacccatccaaatgtccaaccaaaaaactaatattaagaggctggagtcaccacattgactgtctgttattaaaccctataacaggttataattaagattatggaatgactaacccaaggagctttaaaataggatagcctagttttaaacggttcagccttgggaaatgctggaagacaaggaaatgagatagatgactccataggtttgttttacgtctggtgaacatatccatcccatgttaattttttttaacgactatgataaagagcttctttggggtcaggtagaacccaaaggaggaagagaaaatgggacttggttctttaagtgtcaaacaaggatccagccagggttgagggcaatggcataaggcttccctctcttggtggtgagagaccacatccatggactgtggaaggagaacattttctaaaagacggggatcccttgggctaaaatgaatgatgctcatgacccccagctagggcagggctataatgagtacagcaaacataaggcaaggtatcctcagaatttggtgacagggcaaattctagaacttaaggcttagagccagggtgaagggaagactctgtaatgcagttccttctcaggtggaaatccagatatgtgccctaagtgacctattcctgccccatttttgtttgggctctgaaaagtggattcctagctcagtggctgtctgccaggtatcttttgccttcagtaacagaattatgtttgatattggaaaggagtttgttgtattgttggctttataattcactctcagtgtcaaatgaggtcattcaacttcctctcgcacatttgcaataagcagcatgaaattcaagcagaacaactagaagacacagagaaagatggctgagctgataatgaggcctgtttattacaggagaagagacaatataggaatctgttaagtcccatgaggttgaaatatccaccaaaaaatatgcagctgtcccccaaaaaaaagtcactaggagtttttgttatggtcccaatcacagtgtgaacagagatgacaagatcatctttggaaaagggacacgacttcatattctccccagtaagtgctgtttatgtgattttctgacattaactcccactgagttcaaactgctgagagtgttcagtaggaaagtttctaagacatgtgggtggcctgtaggtcctgggctcttctcttgcagaggtccagtcctcagcctttccacagctgagccaaataccaaattctcccctccaggctggaaaagttgctaccagtcctctgctacccaaatataaattatttttttattgtttattaagaagagtaaaagaatcgtgacactttgtccagaacctattttccagtcttttcccccaggcttgtccctggtaacctctgtttggactcattgttaagcccagcgtgatttttggctccaactaaattgattttggaaatgactccagcatacctatgacccctctccttccaccctccataaaagatttatttttctttatttggcctctgctgagattcctggctttgatgccccaggatctctcatttcccttgttccagggataagtgagagatgactttttaaagagctactttcatcttagagacaacaaagagagtatgccagcaagagcaacatcttgcattgagccttctcactctatgccattttccaaatctttttctttatttaggataagtgaccactcctttttatttctagtacagcaaagagtacatcatgatgtcagaaacagggatttcctttggaatgtttttcacaggctaacaataagctagaagtctgcaagcaattcagaaatgcatccctgagctacaactccatgtatggaagctcatcagcagggtagacaggcaaagcagaaacattttaattatacccatactttgtagagattgggtgagaagtgggcaaatgcgtgctaaggaaaaacaaaaactatggttaagtggggagatttctagatggttctaacagggaagaagaccaacaagaggaaacttccaggaaaaccaccaaggccaggcattcagggtttttgttatggaggaaatcactgtgggaattcaggaaacacacctcttgtctttggaaagggcacaagactttctgtgattgcaagtaagtgtttctagccatccttgattttgatcagcaatggcttcttcccttgaattatttttcagtgtacctagaatgcttttgcccccaagaaaggtttggaaggagctgggtcattagcattgcgcaggaaaattacaggttattctgttataattcgaaagccaactggacagtcatgaatgcacacagatctgggccctgcattgcaccctggcctagttgcctccagcttgttctgatcgtaatcctggcccagtttcctcctctgatcccaggagacaaaagccctgggcagagaaccagactacttagcctgggggaagcacaaaaaggcttgtctgagatccataagccttttttttttttctttttcttttttttttttttttttttttgagacagagtctcgctctgtcgcccaggctggagtgcagtggtgcgatctcggctcactgcaagctccgcctcccgggttcacaccattctcctgcctcagcctccctagtagctgggactacaggtgctcaccaccacgtccggctaattttttgtatttttttttagtagagacagggtttcaccgtgttggccaggatgatctcgatctcccgacctcgtgatccacccgcctcagcctcccaaagtgctgggattacaggcgtgagccaccgtgcccagccccaaaagccatttttaaatacattgcaggtttctatttaatgttgttattcattttgatttgcccaagtaatacattaaaatttctcattgtaaaccattcaaattacagataaagtccaggcacggtggctcacacctgtaatcccagcactttagaaggctgaggtgggcaaatcacctgaggtcaggagtttgagaccagtctggccaacatgatgaaatcccatctctactaaaaatacgaaaagtagtcaatcgtggtggcaggcacctataatcccagctactcaggaggctgaggcaggataatcacttgaacccgggaggttgaggttgccatgagccgagatcgtgccactgcactccagcctgggtgacagagtgagactccatctcaaaaaaaaaaaaaaaattacagataaaaccagcattcaccttggccacttccttcagtatcagtttcctcctccccaaaagtgaccactgaaaccagcttggtgtgttgtgatgagtttctctgtggaatatgtttatgtgaaatcccatcttcaaccaggaaagcttgagagggaaagggctcagactgcagtttgcaggatttcaattagatataaggaacagttgattagatgtaagagctgttagcaaaggaaaaccttataaaaactaggagctcttaataactagacaggtctttggtcagacaacacactgactgaggacaggaggatggattcgatgacctctgaaagtccagccaggactctgaggactctgaggaatggtctgttccatagcctgcctctgtaatgcccttctctcttgcctattgtccggttgttacagtctgagcttttgtcagagctgctcctatgctgtgagtggtctgattttctcagcatctctggggtttttgcaaagaaaggaaactctgtgcatactctggggctgggagttaccaactcactttcgggaaggggaccaaactctcggtcataccaagtaagttcttctttctggctaattattcttcccgagaagcctgtcttccatcatgcagaagctgtcaaaacacaggtggtgttttctttgcttggtttgtgttgggtggttagtaatatcagttggaaaacaaggttattaatgcacatattccctggggcattgtattcggacatttaatatccatgtagtctctccctgtgaaaatatgtgaacctccacgaaaagaaaggtccaaggaaagtagcagggaaaaggcaggaattggatgaaaatagccaaagagcctgcaggaatataaacaaggcaggatcccaggagacagagcagtagccactttgagtgaatttcccaggaggtgctcctgccaaggcccataccttcaaggaaaattaaggcaaatagaattgggctggggagttgctacttattagtattcctcccacgttctaacctaattataaggaggttgttttggccatgggcagtcatctcaggttttgttttcctgctttcctccctaacctccacctgtcttcctagaggcctgagtcaaggttattgcaatagcactaaagactgtgtaacaccaatgcaggcaaatcaacctttggggatgggactacgctcactgtgaagccaagtaagttgtgttcttctttgcctaggccttcaggggcaatcaatcaaatcattagtttgaaaaagactttaatcctatgcatctggttgggctctttattaatgttctttccccaggccaaagagagttggttctcttccctgctttaaaatgggatatgagtgcatgtatgcacacagcatgcccacatgcagactcttgctctagctcatggtaagggcttctcaggagcatatacaacattttgaaagaaatagagaaacaaacaataatgagccaatggagctgtcaggaaggttctccaccacccctgaccaggcttcccagcaggatctctggccatataggatgtgcttgcactatatcggatggtctaggatgggaaatatctctctgtaattaattccaaaatttggcaacccttattgccagaaagtacttctcatatctaagtttgatctccctgctgcgatttaaatatctacttgaaaagaaccactagaactctgtacatctgggattgagaatcaagtaactgccatagaatatgaggctgagcactaagcccacctctgcagcacctctgacgtgtcatgggtcccctctggacattttgagctcaagtaataatggattaagcaggatagcacaagctttggaaacagaaaaacctgaattcaagtccttgctccactacttacctagctgtgtgaccttgaacaagttacttaatctctctgagcctcagtttccccatccacaaaatgaagataaaaatattcctacctcgttgagtcatcgtaaagatgaaataatacagctaaagtagttagcatagtgctcagaacatagaaaaagctcattaaaccctcgctattaataataatgataaacatcatctctaacccacagcagagcctttgtttggcccctggggctcttctgtcaaggttctgttgtgcatcagcagcagagctggaattggggggagggtggagaatgtcagcctgttctatgaaattcttcacctgggatttgaaagtggaaatacaaagaatcctgactaatttaaatacaaaatcatccaagtgtcagaggcaggggagaggtttctgcagagagctgcatagctgggatcctcaaggctacacacacacgcttggagcagggatgcggttcacaggatggcagggcaaaggttgcagaactgaaaccttgtacttccccatcaccaaaatgaccccagcatgatttcctttaaggtgtcccgagccccttcccaaaagacaggctccccatgtggaggggcaatgacagagggaagatggaaactttatgggaagggctatctatcccaaggttgtccttctcctcttcagggtagtgaagctcatgagaaatatggctcctgaaaatagccactaaatgaaactctccaacctggaggtagaggatcagtaaagtctgcagaggcaaaatgaggcagtttatttcaaagaaaagaggttgagggcaaggtgggagttaagtcacacatctaaatctgggaaaggaagcattaaacagaagacggaggggctcggctctccacctccaccaggattcagaccacaggacatggctaatactgcaagaagggagttaggttagtggtaaaacctttctaataggtttttgaacagtgaaaatgagctgtcaggagtagttgccagggcactttctctagagagtttttgaaaggagatagacaccctgctatcagaggtgattggagtgcagccctgcctcgaggcaggaggagaaatgagagaacctcttaaagcctctttccagcccccagagcctgtctccatgaaaaaggcccaggctcattaatgcagagctgcatcctccaggacacagggggttgctgggttgttaagtttggaacctttgccggcttagtggttaccaaactccctttgttctcaagacttgacttgataaatgggctggctttatccctttaaagccaaaaacacaggttctgagtgctgtgttgtttgtggtgttgagatgcccaggctggagggaggaagctctagggggtttttgctgagcccagaaacactgtggggataactatggtcagaattttgtctttggtcccggaaccagattgtccgtgctgccctgtaagtacagttaagtggagatagaaaatgagtccagtgcttgatgtggggagaagctgcagggtcttgaggccaggagtccaccgtgacctcaggagtggtgatggagaagaaggttaaaaaaggaatgagaaacagaaccataaggacaatacagaggaagggttcattttcgggaaggaaaatcacaaggccgtgtgattaacgctggaggaaatgcactcctttggagggtcccttctcaggagggctttgtgtcggggaaagctgagctgttaggtttttgatgctgagataatcactatgcagaaggacaaggcttctcctttatctttgggaaggggacaaggctgcttgtcaagccaagtaagtgacatataatttatatgtgctgaatatgattatctccaagaggaaaacttgccctcttttccacgggtgcctccttgggtcaggaggacattaaaggtgttgagcagaccaaggcccagtacctcgtcaccttcttcatccttgaaggagctttaagaggtgtggacgggaagaaacccaccaggaccccaccaataagcccagccttgagacccctccactctgtcagacttgaataagaaccatctgagaacaaggtcttcctcagaaggggactccagcatagtcatccccatttgatagattttgaaactcagggcggggcagagtggctcatgcctgtaatcccagcactttgggaagctgaggcaggtggatcacttgaaggtcaggagttcgagacctgcctggccaacatggtgaaagcccgtctctactaaaaataaaaaaaattagctgggtgtggtggcacgcacctgtaatcccagctactcagaaggctgaggcaggagaatcgcttgaacccgggaggcggaggttgcagtgagccaagatcatgccattgcactccagcctgggcaacaaaagcgaaacttcatctcaaacaaacaaacaagctcaggcaagtagaggccagtgattaacactcttccaataggaacagatcccaagcaacctgcagtagtttttccagtaggctcgtgaactcaaaacatcaagttatttaaatgacagggcaaccgttgtgatcagctgtcatttgagtagtgctgaggactgggtctgaccttgagtaaacgcctaggctggtgggtttctatccctgcagcatctaaagcggacgcccaggcttcactgaccccagcagtctggctttctgcccttgccgcccgggaggtgcagctcttggcacacaccatccttagtgtcttgaaagaagagaaattaaaagagaaagggggaaaagcttatatctcatatcatgcagttgcctcattttgtagcaagattgtttccccatgagcagtttgtcttcattcagcagctgtcttctctggggaagccattttgtagaggtgtttgtcacagtgtgacaactgacagctgggggaaattgcagtttggagcagggacccaggttgtggtcaccccaggtaagccccattccctggagcctcacctgcccttagtatttggcatgccctgcatgccaaatatttctagccgagactatgagaaacacatctgaaaggaagccatttccctgaacagcagtacccaaagccattaagcaaaaatgagagatcagactggtgttaaatagaaacgtttttggataaatagtaattctcattattctctatcagtctcctgtgtgaatacccttatttcccttataaggaaaaaagttacaataagcaggatagccatgattcatgctgtggtgtgggagcaatctgctgtggatttgggggtggaggattagaaatgtgttcaggcagactggatgtgtttttgacaggatatgtaacacagtgtgatttataaccagggaggaaagcttatcttcggacagggaacggagttatctgtgaaacccagtaagtataaaattgtatccctggattaagcaatgtctgtggattaagggctgatttagacccaattatacaccatatgaagaatgtttagagagggggatgagcatcaaataggaagccaatcgtcgtcctggctaggatctagcatctcagtgcaaaatgggctatgtaagtgtgcctctgggaattgctcctgatatatgtgttgggactaaaatgtatgactggctacttgttgtattggctgggatcatatccctggatttgtgcagtaattggtgacaagatttctaattccttaacaaaccttctaaggcactattctatttggctaagattatgtcaatttatagaaggaaagaaccttgtaaataatgatcattaaccaaaagtaatgtgattagtctctctcaaagtctgaaaaaccacttttttttaaaaagtttactcatgactactgagggacacttcctgtttctgagactttcagccaaaaattcgtacagcgtagcctcacggagcagagagaaccttgacaacattcctttttgactttctccatggatgagaaaactgaggctcagggaagagacagatcccggccccacagccagtctatggctgagctagaactagattttaggtctctaatttgccaaacctgtcagttggctcaaacttgaagtttgaagagtccgcaagattcatctgacaaatattttcatgtacttgccctctgccaggctcgttgctgaaaccagggatccaacaggaagcaaactcagtgtgatattgccttcatgaaacttacattctggaggtggattccatgtttcttcccagatatgacaatgcttaccctgatttctcttgggcatggctctcttatactatcatcacttccttaggaaatactaaaactaatttttgctgcagtttaaagtccttgagcagataactaacacacataccactttagtcaggagaagggaaatgcccaaaagtgaagtagaaaactaggaatttgtctgataattgattattataaagttattttatcagtgtgaaatgagtggccaaattaactggacaatgccagctctgtacctacctcactttgattctatagactcagtctcaggaggattcaagaattcagacagttctctgatgacataatccagtgatgcccacaacagaggaggcgtattctctattctggactttgtgagtctccttggatgaaaagattcaagtgctgttttgacacctaaaatcagagagtatttgctctatacatatatcaaaaatacacagttaatgtttagaactttgtagtggaaagtggaaagcaaaggtcccctaaaagaaaatgggattgtaaagacgaaggagggttagtttaggatttgtagaaagtcagtttggctactccagaccaaacctagattaacagtgatgcaggcctaattcaaaaggaagcactgccagctctttattcagtgctttgccaacctggcctgtttgatctggtttttgttgttgagcaaatcatagtgtttcttctggttctgcaaggcaactgacctttggatctgggacacaattgactgttttacctggtaggctgcctcaattaaatactatttgcactgatttactaatctacaaatgtattctgtacatgtaacttaatgggcctgaggttgaagatggggagagacagcaacaatgcatactagaaagggtaatgtgagcagagaattatttatcagagaccaagaagagaaagagaagctttttgctaaggcttttagtaataggagttaatgaaaatgaatagaaaaaaatttcattttaacttagaagaattgctgaataatgggaacagattccataaggggaacctctgcttctgaaaatatttgcactaggaccagcctacgtgctacaaaaactgtctcacaccaagtctagttggtcacttacatttttagcctattctagtagctatttctaaataagtcttcaaacatagaggtgcctatatttaagatatttaaatgaggctctatttctatagctctctggtgcccttccagcaaagcattgctgtaacacattgcttatcatttctacaagtgagaacaagtaagcccctggccctccaaaattgcatgagtattataattacttggcttagattgaagtcacttctgtgttacttctcataactgtgttcatttgttgagatctgtttaactccaaactgtgtgggcgtctaactgttggcactaaggtttcttttctcttgaaattgccagcaaaatattttacccataaataatgtttcatctagacttgcaaatgacaactaacactgcaggctctttttttttcttttgctttgtttccttttttctgaagggaatatgcaagcaggaagcaaaaaaaaaaaaagccaaaatgtacagtttgactgtggggtctgggaggagagtgtcaatgtggatgctaaaatatacatggttgtataatgtaggtactgtcacagagaggctatagtgatcttattagatcatacatacagagcaccactggtcagctggcgttgctcggggtgtccttaagaaaagctcaggtctagttgtcaagtgcaacccagattcagatacagagtctcagagagaagcttccagatcaccctggagctaaatgcagaatatgaattttccccttagttaagtctacctgaggggaattttcatttataattaggaaaagagaaaggtaaagaacatttacttgcagtgtcctgtttcaaatattgtgtgcattgagccagaggacacaagaatgaacccaagcagaaaactaaagaaaagaaatcaataaaaccactgaagaaaaccagttgcccttatcttgcctgtctctgataatgaatgtgccttccctgctcattcctcactttggttctcaaattttccagggaattagcaaagaactggtagggttgggttagtcttggtctaatttggttagtcatctctggataacaagtctcctttttaggaagtgccaggggattttttgtaatgccaataaacatggtgtacaacttcaacaaattttactttggatctgggaccaaactcaatgtaaaaccaagtaagttatagttgcctagaagaaaaagttaccaacacattatgctaaattcttcttttcagtctgtatttcagttcttttattttgcattttgggtccccacccatgatattttattagtccttattcatatgtcacttgaacagatatgtagtaaacaaatctcatgatcgagtagacatgctgaaactgccaatgttctcaaggtgctattctttataaggaaaatgcccaaattttaactgttgctactgaacaaaagagcatttggatataatttaaagcacccctgaatgtccaggatttcagagaggagacatgacaaattaaaattatatgtattatttaaagatgaaaagaattagatcctcttgaaaatactctaataactaacatttcttcaacattcgcaatatgcaaagcacctttcataccttgactcatctgaccctcctaacaaccctctgggatagatattacctatctccgcttcacagatgaggaaacagtgtgaaaggtaaaactaaagcaaagaggttgaaatagttacccaagggctcaccgcagatgaggggcagagctagattaagagcctggcctgcctgtcccctagcccactctcttaaccatggtcttggtgaggtttgtgtaggcgacctcgcactgtggttctaacgactacaagctcagctttggagccggaaccacagtaactgtaagagcaagtaagtaagaaagaaaagtccagaataattttaagcaaaatggtgggtaggtttttcagcaatttcacctaggaagtgcaatgtcaagaactaaattctaagagctttcccagtttgtgttagaaccataatttttctacctcacacgtctccctcgccttctctgtcacctcagaacagctcctcctaaggcatgacttcacaatggtacatttgttggtggcgcagtctttgtggtcagataaaaactgagctaattatctgaaattatctcaggtctctaagtgagagagttaactcctttcaaatatttgaagaactacgatgtagaccaggtaaggggtgagtgtggaggccaaatcaaaacgagcaggtgcaagatgtgccccaacctcccctcaaacattgttgaacaagtggaactgccctgagtggaaaggctgctttgtgaagtatggaacttttcttccttagatatcttcatgccagacccctaaggttaaccatgagatgttgcagaaggcacttctatgccattttagctattagattgaatcacctctgggctccctttcaaatctaaatgctaagatcccatgactcaagcctggaggattaataggtgagctcagacttgtttcttctatttttactattttgatagccaaagaaataattcatcaaattattcataagctaaagcctacttgggatttttacacctagaagatggtggggtatgatttcccagtgcagtaaatgagaaaacaataggagacatcaaggaggaaaaaaagaaggaagagataaagggaatgtcttaagggaggctcagaggttgaatgaaggaaatgaggtgattttgcagaggacagatgtggctatcaaagattttacaatttcacctttggaaagggatccaaacataatgtcactccaagtaagtgagcagccttttgtactcgaaaatagggccaggggagcaaagtttcttccaatttaaacacactcaaaaggatgtgtaattgctttctgatgggagggaactctgaaggtagaaagactattgttaccacagatcacttgtccctggagatatagcatctgaggactgactgtctagcttagactgctgtctgcacaagaagaagacttacagatgcttaaggaggatggaggcaaattttcaaccctgtactccaaagctgaggggagaggggatgggaaacattagggctgggttcatgtaaaggggaccagcattgtgccgacagaggctcaaccctggggaggctatactttggaagaggaactcagttgactgtctggcctggtgagtgagtcgctttctattccaggaaaatattactgtggagaaattaaaaggggagatgaattaactcctttagtcttgaaactaaagagatatgtgtacttcccctcctggaggaccccagtcctaggtagattaggacgaggaagcagagggagacaaaggcgatggaaagtcccttttaggaacccaggaatcagagagaacttgatggtccccaccaaaggcaaagaagggaggtcccactaaaacatgtgagcatcctaaaacacctgctctggtccacccacaatatttggtgaaggacatggccctccacccagaatgggcaagcaaactagaccagctttctaaggtgtgtttttcttgggtcctgtgactcttggccgtctccctgtcagaggctccatctgtcgctgcactctttcttattgagaatggcctctccgtggttctctgtaaactttccccaagaagcctgtttccatgcttcctcagcacttagcctcaccgatggatgggctctagagtagctggagggagtctgggtctgaaactttcactgagaaagtaaagttgatccgcagtatccagtggatatggcagctgggaggacctaggactgaagtactcgtcctctctttggggcctttcctgggcactcgattgaatacagaaaccctgttagcaagtgcatgcatgtatatgagtgtgttcattcagcatttccattctgaatgtatgaatagccttactctgaagactccctggagcttacagggctttctgttttcagagaaaattgcctttgtgagacaaaaatgccaagtgggcccctgaatgaggttatggttgagagctattaatattatccttattcacagagcaagatccgaattcccaaagcagagtagacaataactatgtgaagggcttagacccaaatatgtgcccacttgcaagcattccagctctatgaagaggatacagtgctaggagataggattaccctgcacattgcaaaccctccacttttccaagaccatagaaaatgtcctttgttgagcaccaactgagtgttattttcttggtccctgtggtttttgctgggccttaaatcattgtgtgatcaaagctgcaggcaacaagctaacttttggaggaggaaccagggtgctagttaaaccaagtgagtactggggcttgacccacaattgagccttgtcatcaatttgcaattcaatgtgccgtattggcccaaattaatgtctcaaacttgtctttaaaatgtttcatgttgctcttatgcataaacatgcacttatgtacaaattcagcatggataaaggatattgtcatcttgacattttctagaatctattttcttaagagaaggcacatagtaaaaggtacttttcttatttcttcacatttcttaactgattttcccaagaggcagaggaacttggacgtggcgtttctgtctattcagagtagttgatttgaatatggtcacaatagcagagcaaggacttacaatttctaaggttcaaaatattgctctctgtaccagcctgcagcctctgatgaaccattattctgatttatttcctctggccctcatttttcccaattaatgtaactgaaatattggtaaccattatcttccggttcacagaaagtgtgtgaggattaaaaagtcgctgctctgaaaaggaattgagctggagggttttcttttgggggattattgttttgttgatggtattgtctctttcattgagggagagaataagaaaggaggcatacttgaaaggcaaggtaatatgatcaatacatgaacgtgtgcaaaataaatcattaaggcattcaactagaagccaaaaaacagtatggaccccggctcagccactcactcactaggcagccatgagaagatcaccaagctctcccagcctcagttaacctaaaatgtggagattattattccagccttgactacttccaaaggatgctatgaaattcagatgagataatatatgtgaaatctccttgaaagagatgggtggtcaaatgattcatgatttttttttttttttttttttttgagacggagtctcgctctgtgcccaggctggagtgcagtggcgggatctcggctcactgcacagccgcctcccgggttcacgccattctcctgcctcagcctcccaagtagctgggaccacaggcgccgcactacgcccggctaattttttgtatttttagtagagacgaggtttcaccgttttagccgggatggtctcgatctcctgacctcgtgatccgcccgcctcggcctcccaaagtgctgggattacaggcgtgcaccgcgcccggcctcatgatttttaatagttagattttatgcaaaatttcatttgagggtaaacttaaaggtgaacaagtttaatggactttggccatggcagagaaatggttaggtttggatataaggtggacctctctaattataagaaaaaaaaggaacatgagaattggtgaacaagaccttccctggagatcttcagaaacctgaggtcactcaggagagaaatgtgtgaagttgagagcttacagtaaatggtctctgaagtttcccaccattccaaagagtgcgtgagcttaaaatttttcgtgagtttagctaaatatgtgcttagtgttagattaggtttcaaccaagcaaaagaaccctgggagaagtactctgcttggaaatgaagcatcctttggtttttgtggtacaatagatcactgtgggttttcagatggccagaagctgctctttgcaaggggaaccatgttaaaggtggatcttagtaagtattattactaatgaattcttaattgattagtttttgagacaagtaataagcttttttggaaatctaagtggactgccaaatgttctcgatttatccatatttcatggggagcagaattcttcatgccttctccatcctcacttctgccaggtagcagtttgcattgttaacagggaagcagaatggaagcttaacagagaagcagtatggaagacgtctccttagcccagtggtcagttgcatcagagaagtctgctctgaaatgcgaacactttctcttgcagctggcagccccctgcaacctcagtgccctccatggccagggcaaaagcttccaggtgcccagataacatcccaaagtcactctgagagaaaatcggtcttactttacccttttctaaccaggaatttacatggttagttttacatctaacacttcagcagggagaagacatgatctaaaggtccatgtggacactctgtgtgactcggatccaggatctgctctttcagcccctccatttatcgcaaaagggatgatgattaattcctccatgcctagacttcactttagacatcacctcagagaggcctgtcttacccagccaatctaacaagccatcaaacacagcactgcctggctgctctctaccctgttatttagcctgattttaattcacacactttcatcacttaacattatactatctgtgtatttattgtttgccttcttctagaccgtagacaccaggaggacggggacagtgtctaagtggctctcaccgtatccctagtgccggcacaatgtctttacacatcggaggtgttcagtgaacagttactgagtgaataaaggacttagcaccaactgccgctctttttcatgaaattacagagctttgctatttcatacccaaatactaaaacctactgagatttttgcaaatttccatcatttatagttatatccaaggtggatttgagtgagcaggtacatgaggtatttgcagggcctcatttcactgtgccaaccaggcagggaactgctctgatctttgggaagggaacccaccttatcagtgagttccagtaagtacctgataattattgatcatagtgcttgtacttatcctgtagtcatatattgcacaggtgaccaaatgcctcctatttctttgagttaaggaatattgacatttgatgaggaaagccatttaaacacatgggaaaattggatgttgtctctcacccctaatactccaaccatagcccctgtcctattccatgctcttaaaaaaattttaattgatagaagaaagaaagattatctacaaggatatgagcaatttgctaaacagtggtaaaatgagattatgtacaggtgttgattcctaggtaaaaatgggggtcagagctgctatcctttggctagtaaaacaagattacttggtgaaattatgtaaatctcctcgaaagaaataagtttcagagttgtctagagaatatcacttggactgttctcaggctttccactacatctattgtaccactatggtgccctgaaaagaggctttctcaggcttaattccatggcttagtctttattccagtatcaaaaagggggaatccagccagagctcccatgagggagatagctgcatgctaaccacattaatctattatcaaggtaactcggtcatttttgtcaggcagcacagtgctgtgatttatagcacattcatctttgggagtgggacaagattatcagtaaaacctggtaagtaggcaatatgtcactaaagtaggaggcttaatgtggctactgagacccactaaacttactgcagtatttggaaggcccaagtgtcaagaaattaatggtttatgcagacttaagtggattccaatgaaggaagaaatgttaaagtaatggcacagaggatagaagagctagctgtgaaaaaaaatagccatgtggatgaaccaaacgcaacagactgaaagatcctagagagttgatcctaaagaaaaaggcagaaagtctggctgagcacttccagttcttctgacctggcttgattagtgaatctgggccacagtatctttatctataaaatgaaaacatttaatatcacctcagattttttgttttaattttgtgggtacataataggtgtatatatttattttaaagataagctaatatatgtgaaagtattttgtaaattcttaaatgctatccacagtgaaaatattatttgtttatagaacaaaaaaaactatgtcagatttagaattcttttaacatgagaatttgtaggttcttagtgaaatagccatttacatgtgatctgtagccctaggcattggtaaaaagcactttctcttctactgaaatatagtggctcaaatgctacccaaatgaaaagggcaggggaagggaagtcattttgtaaaggcaggcattacagtgtgaattctgggggttaccagaaagttacctttggaattggaacaaagctccaagtcatcccaagtgagtccaatttcctatgctttcctcttccttgtgttgtcttctctcagaccgtaacatttggagcacataaagagatattatgggcctgctcttctctggctgtttcaggagactgaaaaggattgtataagaacatcctttagcatgttcttagtattgttttgtccagtgtgtgtttcttcttaatatcaaaaaaaactaagacattgcctgtgaagccaatggaaaacagtagatttgcaaagaaaagaactaaagagaagacaagtggtactttttaccaagcttaaagcagagtgggtgtcctttaatcagagggatgcttggttctgggggctggataggactcaggtaagtaacaaggctaccactgagtcactgagcttctaaaatgagttgactcgggggagcaggaagctgccactcatgatgatctgaatgctattccgtgaagtttcagattgattgaagttaaaattaggggtgacactatgtcaggaatctaaaaattgataactgtaatggaaatgaaagaagggctagctacatctgttggataaatggagttgaaaatcatgaatttgatggcgacagacccagagagttgggcaggtagaaacttcatttcaagtgatatgcagtaaataccccaaatttgagtcaaatggcctgtgtaaaaaggaagtgaaaatgtaacccgtatctccttgtaggtgaaaaggccatatctctaggtcttaggtatgaaaaggatgtgtgggcttctgggtgtttttgactgactaagaaacactgtgggatggatagcagctataaattgatcttcgggagtgggaccagactgctggtcaggcctggtaagtaaggtgtcagagaggcaacagaaagattgagggtaaaatgtcttcatgtctcaggaaatgattgtataatgcaaaatgagctggagttttttaggagcactgttactagagttctgatgtctggttctagcaaaagaaccctaatatagctgtaatccctctctagaaggaacaaggaagaggattcttctctgaaagctcctcctaagatttatccatcctctgccaaagtgtcttgtggatccaggatacttacatctttgttagcagtgctggcccaacctgctcagcctcagatcacctatccctcatttgtaaaatgaggataatatttaagctcatggcacagttgaagcccaaatgaggtagtggaatatatgcagattattaatccatttggctcataaatgaaggttttctttccttttccctatgtagatcatgggttgaaatacctaacactgcaaatcatttttgtatggggatttgctatagtgtgaattcaggatacagcaccctcacctttgggaaggggactatgcttctagtctctccaggtacatgttgaccccatcccacccatgttttccccttatctggtttaaggcttccatatgtattgcgtgttatcctcatggatttcatcatccttgttttattatcaatgttctgtgaatttaagattgagcctccatggactcttcatttaaaaatgaaaatagctaatagaagagttggaaataacagtagaactaattcactaggtcaggatggagaagggagtaataccctagacaattaggacaaacgatggtttttccagaaatagcctcactcctgtttaagcctagacgtggtctctccccgggcacccttcacattcctctaaccctccatatcccaaatttagctgtggaatcttagacaatctgtgacctatgcagctacagaaatcttttcttactgagatatctgcctatttgaaccaaaagatccttgagaatagacagtctctaatattccatgaagtgtctgatatggtccttttacaaaagtaaatacttgataaattcttgcttaattgaagttaaacacccaaagaaatcaggtttccaggccaaagggaagaagaaaattaagcaaatgacacagtacatttgagcgtgtagtggggaggaagaaatgctagattgggattcaaatagagccatgttttggtctctgctgccaactagcaatgtaacttagaccagatctcttgcctctaagcctcagtttctttatctgtaaatggggaagtgggtccaatggccctctttggcctcttagtacaaaaagtctatgaatgtatcccatttggggcacttttttctcctaggagtaactcaatagctattttaaagcttgagtgttttctaactcattagagcacatcaagaagaggggtgaagtgacaaaagggagtttattgtgaggcatcaaacactgtgatactcacgggaggaggaaacaaactcacctttgggacaggcactcagctaaaagtggaactcagtaagtatgagattctatggtaattacaaaatgtattctggtgacaataagtggaagaaaaggtgatgtaatttttgtcattgtatcttatttttaatctattactgaagcattaagaattgtgacatccagataaattagtgaaagtattcaaaggctatataagcatgctttctttagggtggaatttagctaaccactaagactttttccaagatatgagattttcagctctcttcaacgtgagagtttttaatactagtattaagctaaacgatgctcaatggaagaaaagagctagaagagcagaaaattgcaccgtcatgatcaaatagatcctttctacttccactgccatggactcagtggtgcatttagaagagggtattcaaggtcattttagccatgccccaaaaaaaccactcccaattcattccagagattgtgcccccttatgctaaacatcatccaagaagagtcagtgaagtacagagaaaggaacccagggcttcttgtttcggtccagagttctaggtttgatttggtcccaactggatgtgtgatattggaacgagtcattgcccctctctgcacctcagactcctccagtggatgagggggtcaaagccctcaaaatctgttgttctgggatttcgctattataccacccgagagtttataggactcgagagtatggaatcttgtgagtatttcataaacaaattctatgaccctcaggaaatagccctgttaatcaacaacctaacttaacatagaaataataaccaccatctcagtccctaccatgtttagatacgatgctagatgcatgacatgtagaattgttcatctgaaataactctgtgaggtaaggggaagtatcttattttacaaaagaagaaactgaggctcagagaaggaagtgcccaagatcccaaagctagtaagtaaagggcctaaatttaaacttgggtctgcctgcctgactaaaaagccctgctctttcttttttttaattttattttatttatttatttatttatttctgagacagagtcttgctctgtcacccaggctggagtgcagtgcagtctcagctcactgcagcctctgcctcccaggttcaagcgattcgattctcctgcctcagcctcccaagtagctggggttacaggcatgcgccaccacacctgaaagccctgctctttctactgcatgatgtcgtagagcttgtgctctagtttacttagaaatgagaggtgatgccaatcacagtgactggtgaaatgcttggaatttatcttttctactttagatattgctgtgagttagagagggtgcttcgggaaatcttgacatggatgccccaagtgtctaaagagttctcctcccctttcaatgacaaaacaaagtacagagttgctgggagcatttaccccaatagggagaaaagagaggggagctggctgcagccactcccttgttctgactgtccctttccttcgctgtttcttgtattttccccaggcagaccagccaccaatataactgatctacaagagcctgactcctttgtgagttatagagaaatgcagggtgaaggcactttgcacatagaactttagctctgagagacagcctcaaaatatctagttcacccctctttattttcccaataaggaaattaagacccagagaggttggctgaattgtctaaggtcagtgcgaactagggctgggactagaacctggagatcctggtcctggggccatattctgtgactgctgtttggtgaactaaacttctgataggtaggaagtgtgagttatgctcataaacaggaaaaacaaataggttttacaaggggagtataaaaatgtcctccttattactagcaccttagtataggctccctagacctgctccccagctgtggtgtaaaaatggaaggagaaggaaatggcccattttgtcgcagtgcaaatcactgtgggaaatactggaggcttcaaaactatctttggagcaggaacaagactatttgttaaagcaagtaagttccatgaaataacctgatttatattacagttgaagaacatctgttttcattgatttttttctttttagggggaaggggacatagttttgtctgccagttaaattagaagatacattggcaataataatgttgcactgtacagtatccatgggcatcactcttgcaagaaacatgtataattaacaaacagttaagtgtggatggtaaaacttccctaggtcctatctagaactgaaactctgtaattatattaataacttttttaacttgaatattagtgacatttttatataacccaaggtatacaaagcagaatcttcagttgggttctatctgatttgttgtcatcttccaatggtcttaggaaaattaaggttaaatagtaagattagatgcctcctaccactttggtacatgcatgcagacatagaaacacccttagtaactaacttgcatgtgacttggcaatcctagctatggcccagtgacagggtcccattttgtacagagttatgtcagagtgtgaacacaggctttcagaaacttgtatttggaactggcacccgacttctggtcagtccaagtaagtcaaatctgcagaaatgtgtagccctatcctcaatattgggcatatatggatataattattctggtctataatagattattattactactattttgttcttattaatcataacaatgctgctaatttcaaatatacattttctgccatattattatttttacctttaaggagaattattgtcaagatatcaggagggaaatatttgaatttcctttgagtcaagtttcttatttgttcgtcagttcccacctctctgctgagggtcatatgaacctcacgatgttttggtttttataccgccttcttattatctctcttagaaatgcttccttggtttttccttgcctaagcacttagattttgcagctcacatttacccagagtatacttagcttttaacctctcccaaaactggcctccctgtcccaataattatgcacagtaaaagtcagttcaattcagtaaatgattattgagtatcatcaacaaaccagggaatcatcattggttttaaaagaaagaaacaaagaaaagaatttttaaaaccctaagctatcttaggcttctgatctcaagaacttccagtcttatcagagaaactaagcactcataataaaaagtctaacaaaaatttatatgtgtatgtgccaagataggggggtgggtttcctgagggctggagacaggacaggtatgaccatgcacagccgcattctttggcagagaacacacatgattcccccaaatatgtttctggaaacggaattgagtctgttctgtgctgagatctttgactttcttgaggacaaaagcccccttggcagttagcatccttgagcgggggtgaggacagaaacaggaatgagtcaggcgtgagtcacccaagactctcactcagccccaagaggatggagtgactctgagtcatgccgaggcatgtctttagcatgtgctccagcagtgtgcatttatggcaaggtgaaaaatacatttttgcacatgtcactaggaaaatggtaccttcttctcaggcatggcagatgaagtaggaaaatgcccgcctgctctctggtatctttagaaatactcacacccatccagcctatgtaggatacaatgtttttcatgaagttttatgaagattctgtttttcccaaaggagaaatagccaaagctgtgtttattgatagctgtgatgaggaaaatgaaggccaacaggtagcagtggggtctggtgctgtttataccttttagggaggttccttcaagtcttcataccacccattacaaggaaaactttagcatccgcctttcagggtttccagatcttagagctactgtgaaggggatgtgtcttcagagaaggggtgggcaaaaccaggaggtttttgtaatacacttacacagtgtgactatgggaacaacagactcgcttttgggaaggggaaccaagtggtggtcataccaagtaagtgagctgggatcctcctgcacaaatggccacagcacccccatcgctaccctgtgctggagagcctcttatcatatttccatgggagcgggggaaggacatgccattcatcagtgctatatcgaagaaccttaggcggccactgtcccaaatctttgcctgtccctggtttctttcactctccccttctctgcatctccactgaccacactcccattctcatgtaagctgcccctgatcttccctgaggctggatttcagattgaacaaaggaccacagaagtgagagctggaggggaccgtggggacatcttgctcatgttgcagagggacctgatgccagggtctagcatctgtccaagaccgtgctgatggtcagtgcacagcagtggaggggccccagccctttactcccaccctgagtttggtggagccacacactctttgctaagtgaccctcaaacccagtgtgagataagctgagtgttgacagtgcccacctgctaggcaaccaagtactgagttcctgccccagctcaggactgtggcgcaggccatgacctccctgagcctcagttttcatatctctgaagtagacagcatggtctctgtttcctcccatctttcaaaaattctatggaaattattgtgacttttttctctgtaattgtagggtttcacagaggcagggccttgtctgagtcaaggtcattagaaataaaggaatccaagggctttggatgccttggcctaattctaggtggtaaagagggaaggatgaaagcacaaatcacaggaagtgcctaaatcctgcttggatttagtgttgcctcaaacagggatatgcagaaatccaaccccagggtctcccataggaagaagactaggagtgggaagtgccaaagagctctggaaaggaaaagagaacaaggagcactctgagaaaaggaggtcagaacagcttcaggaaaaacgtcacataaaatttcctttgctctctgtcctcgcagcactttcagaagctccttgcatctgactaaagagtagcagagccagaccctcagaatgtctgccccaagcaagcagagtgtggtgtttgtattggggtgctgggagcagacatggggagttgctgccctgcttctctgctgatgggaaggtggtattttcccctgggtacacgggggccaaagagctctccagtccccagcccctggctcccgcccctgggctccagcactcgggggctctaaggacagcagtaggagactttctacaactcagagagtattcaggagggtttcccaggatgttgcccaataccatggggcaattggtagagggaggtcacatgaaacaggttttatcaaaggctgtcctcactgtgtgcatcaggaggaagctacatacctacatttggaagaggaaccagccttattgttcatccgtgtaagtattatagaaatgatcaagggaaattttgcagacagattatattatggaaggatactgtagtagtgagagtttgtgttgtgatctattccatcattaaaggagtcctttgttgcctgggagtaactatcagtgtcaggtctgatgagatgattgaggctgtgccggacaagggttttgcacaatgatttcagaggacaaatccccaagttgtgaaaaaagacttcactcttggttaggtttctaaaacagaactttcttcttggcaaccaaggggtctactctgccccctcactcctatgtctcttccacctgagactctgtcaccacctcccctagaatccgtgagataccttcccctgaattagagcataccagccagggtgctgaggcactctgtggtactggaatggatggtacagggatgcgtttctgggcttctggctgcaagaagcctcatcctttcccccagtgtaaagcattgctgggaatcatcccattatgagctactatttactgaatgcctgacacgtaccagtggccattctcttgtcttttatgtaatcctcattcagtgattacacacatcctaataataggtagccgatattttgcccattttacaggtgaggaaacagaggcttgggataagtaaattatccaagattatatagccacgaatgacagagctagagtttaactcaaatctgtttgactctagggccttgttattaaccgtgccaccaccatgcctcctgcattctgtgaaggaagacttcacacctcaaaggccatctgtttggcctttggtttgcccatcctgagccttcttaccatagcgaccatggcatggtgactcagcacttctgaagagatcagcagagtcattgggttgggtggcagaatacaggtatggcagggagggaaggagaaacttagggggactgtttattgcgcatacagttagagagaaagaaaaatgtatcatcaaaccatagaataggctgcttaaaagtttttctcccaagaaactgtgagtgtatgagggtcatgggcagctgcccccagctggcagagggcaggattttgtactgtgatgtaccagggtgtggacacgggcaggagagcacttacttttgggagtggaacaagactccaagtgcaaccaagtaagtacccaaacttaggctctggccaaagacacagaaaggccctactctgctttcttagatgatgaatctgtacttcctgaactaatttttcatgtttctttatgaggcttgaatatcttgaaattttaattcctagccactagcttaatagtctgttttctaacggtagtatttgccaatgggaattggccatttcatcattgcagagacagattcctttgagacaaaagatctttatcagaaaagaaactgtgactgattatgccaaaagatttatttttgttccatttagttttcatgaaaggtgatgaattatgcttcccaaagactctgggcattggacacactttctcaaaactgcacatccaattgagagatataggaagaacttagagcctaaataatgccataaaaataataaaaagtttgtaaaaaggaaccatatagaaattaaagaagaaatgaaatagtcttaatgaaagaagataacagaactgcattagaaacgaatggaaatatttagagggtttatgtattcaacaaatatttattggacaattattttattccaagcactatgttaagtgtgaggaagggaatgggagggaagggaagggaaggaaaggaaagaaaggagaggaagtagaggaaggaccgggagggagggaagaaggaagaaaaggaggaaaggagggaaggagggaggttctctttcatccagggaaggagggagagtctctgccatctgggagctcagagtgcaaacagacaactatagcctattgtcaccacgtcatagtggaggtacatgcaagttgcaatggaagcacaacagaagacatgactagcctccaattctcattgcctggtacatacacacatcctccactataccttaagctccatgagggcaggaccctttttcatcctcacagctctacagctcagcacaatgcctggcacataggtgtcaccaaacaaatgattgtggggaaaaaaatgccttctggctagatgagttatgatttatacattaacaaatattctctaacagagagagttgttagacctcaaaaccaggagattgcagaatccatccagatgtctgtggtgggagaaggcccatctctcagggaagagcacctctgtatttatctgttcatatgtgtgcttcatcaaagcctcttctcagccatggttcaggctgaatttataaagcttgaaacctatcgtatttctcaagaatcagagatcagaggtggaaggtttacaatatctcgataagtaagcagtacaaatgagttctagcagtaaaaaagaaagaggtctaatgataaatatatgaagcctgtctccacttgagagacctcctagaaaagatttgttctaaggaaacttttctccattaggagcagaatcatcttggaaatatacagctccaagttgtgttagaaaggtgtgtacaaagaagaccaaaaattcacatttggaataaggcattaaagttgccattgtttctagtagggaaaccctgcaaagtgttggggcatcgtagatcctgcatgttgacgcctgcaactaatctgccccggagctgttccgacagtggctggagcatttgctgcacagttgcataggtgttcaacaattgccaaaataaaatgaagctatttcgtgatgattagaaagaaataatcagcatcaatgaggcctctgatgcatcttcaggagtgagtaggtggaatgaagacctggtaggtgagacttttctctcttgtcagagaaagtttgacttgggggagcctggaaaacagggacaggagatggagtgccccagccaggcttgccctgcccaggtcagagttcttgtaaagcaccatctgattgtgtgttttctggtggctacaataagctgatttttggagcagggaccaggctggctgtacacccatgtgagtatgaccctgcaagtgaccagtgcaaaaagaactgaccacttgtctatgagaaaacaggtgatgatctatagcaaacttggggatatattgagaagcactcattttccattcctacaagctctcttggtgacttaaaatgttcccatttctcatatgaaacacagaagtgccaagagccaattgcgtaaatgaaaatctgagcagaataatttatagaaacataaaaagagttccaaataatgagtgctttcaagcgaagctgataatatcggcaccagataatctgaacattcaggaaattagctaagtgcccttgggggaaagagatgagttaatggcaaacacaaattctcttttattgcagcatgtagctaaattccctggattggctaataaacatggtatggggatccctactcatagaatcttcctctctggagttaggagagttttcagcttcctcctaagggtaaaagtggcccagacccctaactgaacggcaagtataccacatgcaattacaaggtatagaggcagcaatgtagagggaggcccacagacctggggaaaatctgggctctactctcactggctgttttcaataaagcctccactttctcagcagcaaaatgactataactacatcataataatatgagataatggccagaatgtaaaaagtgatcaataagtagtagcttttctaaaatattattataattattattattgaggctttgcttatactaaggtttacactatcataaagggaaaggagaatcgcttccttgggaaataaaagatgtaagcaacaaagacccaaggagccttttagaatgttgctctgggaccccagtggcttccagcagattagcatcaagaaggttatctcaaagaccttacccacagtgggggtacagcagtgcttccaagataatctttggatcagggaccagactcagcatccggccaagtaagtagaatgaagcaggagagcaagggaggacggacaactatttcttctttgtccaaaatgccaacttgaacccaggtattttcctctgtgggctccaaaatggtttcttccacccatccccagaaaatcctcccatccagctctcggtgctctgcagacatcatccttaggctgggaccttaggaaccatgaggcaggcaatgagcgagtactcctgaaccttccacaaacatatccaagatactgctgcctggaattgaggtttttgttctagggaattattggtttattgaaatcatatgaagtcacaacctcagcccagggaatcacagcagaatggaacaggaggagaacttttgtatcagaagcgaaatttcagtgcaaaagagcagaaggtttaggcctggcgtggtggctcacgcctgtaatcctagcactttgggaggccgaggcagggagatcacaaggtcaggagatcaagaccatcctggctaacacagtgaaaccctatctctactaaaaatacaaaaattagccgggcgtgatggcacgcgcctgtagtctcagctactcgggagactgaggcaggagaattgttgaacccgggaggcagagattgcagtgagctgagatcgcatcattgcactccagcctgggcaacagagcaagactccttctcaaaaaaacaaaaaaaaaaaaaaaaaaagaaggtctaacccttaggagtgtgattatcctgttctcctgccttgtgggggagatcagtgtttctcttatttaagtaataggtaggtcctgtgagtttgtgcaatggtgtcacctacggtatgaatactggaggaacaattgataaactcacatttgggaaagggacccatgtattcattatatctggtgagtcatcccaggtggcaccacgtgcaaccccatgggccagtgtcactaatcctttctctggagatatcacttattactatggtgaggcttgctgtagatgttgtaactaattttcttacagaggtctgggaagggaaaagcattactatctatcttgaatattcatgtttctctaggtcaaacacattaaaatttgactttaatcattcaatgggtattgtaaaatgccttctatgtgactatcactctataaaatgttagactgagtatgaagtgtgagatagattcctgtcctgtcctcaagtggtataaaaactagacaaaggtactgaactattgtaaattaagcagccagaaaactattttagtattgaccagttgatgatgtcaatggacacaatagagattcagaggggatagggtgctggctgagaagttggcctagactgagaagtttcctgtggtacaaaggattcattgagccctgaaggatggataagatctgtatgggcagagaaaggagagaagggaagttctgggcgtagggaacgacaagaaagaaggcatgatcttgggaataatcaaggcacatgcaaagtagcctaagtatacatctgataataaaattggttgaaaagtagtcagagaagatgtctttttaggcatggaaaaaggaaatactagagcattcaacagaatacagaaattagggccagggccagccattgggaaactgagaatccgatttagagatgcagactagaagtgaaggtgagagcagccagctatggtgccgcagacctcccctctccttcctcagtgggctctgagaggggtcatcccacaccttagaggaggagaaacctaagggattctgtaatagagacacggggcatggtatgaaagtattacctcccagttgcaatttggcaaaggaaccagagtttccacttctccccgtacgtctgcccatgcccagagtttcctgatgctcactaaagcctcggtgggacccagagtgactgtcactaattctgatttctgggtccctagtgcccaaacacaggggacagatttaatggtaaggaagctttcaatcactgctgtgtccctagggatctaaagcactagagcacatgtgcttctgcagttcattttgaatttaaaggacagcttaggatctagaatagctgaatttccacctcaaaacattggttccgtcttgccaagcctaccttctgatatcatcagtgatgggatgtgtttttcttactagggtagaataggatgtctctccccaaaggactctggcagacagacccctaaacacctccaaattaaaagcggcaaagagataaggttgaactagacgtacatggggataaaaagtataaaaggtacatgggaatgaaaggataaaaaggctaaaaaaattaagtacctctaactcagcccctgttgccatttctcagagtcttgtgttctgtggcattgcgctttctagaccaacagtgtccaatagaactttctgtggcaatggaaatgtcctgtcaatctgcactgtcccatacaatagccaccagctacatgtggctattgagctcttgaaatgaagtttccatttttaattgaaagcattttatttcacattgactaatttttatttcaacagccacatgtagctagagactattataccagacagagcagcctagatcttctccagtctgacacccaccagccccaggacttgagtgagtgtttaaccaggactcaaagttgggtttctgccccacaaggccaccccctttcctctttaaagccaacctgcatctggtggcccctgatcccctgccttgaggatcggcacttccagactcctctccccctctgcagtgctgtccagtacccccactgatgactaacaatcagggggatgtgttggtagagctaatggctttctgtctgtcccttcccagcaaaggaactatgccttagggccttcacccagagtgatgtcaggctgcccaagcatgaggagggaagtaggcagaatcctctggagccaaagctctggatgtctctcccctctgaccatggagcccacccctgctccactgctccagggacagccctatgctgcaggcagctctgcccccactcagcatcccaggggctgatttctttggttttggatccagctggatgtctgcattgccgaggccaccagggctggctcagcaactgtcggggaatcaccagggtctgagaaatcttgtgcgcatgtgaggggctgtgggagcagagaacactgggtgggaaattctaatccccaccctgctggaaactctctggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcaagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggcgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggccttctaggccatgagagggtagacagtattctaagtacgccagaaagctgttgatcggcttcaagcagggaagggacacctaatttgcttttcttttctttttttttttttttttttttttttttttgagatggagttttgctcttgttgcccaggctggagtgcaatggtgcatcttggctcactacaagcctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcacggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctcattggactctagaatgaagccaggcagagcagggtctatgtgtgatggcacatgtggccagggtcatgcagacatgtactttgtacaaacagtgtatattgagtaaatagaaatggtgtccaggagccgaggtatcgtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgccgaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgaggtgaggggccttgaagctgggagtggggtttagggacgcgggtctctgcgtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgaacttctcccctatgaggtaggaagaacagttgtttagaaacgaagaaactgaggccacacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctcccccagggtccccagtcggtcttgctgacaactgcatcctgttccatcaccatcaaaaaaaaactccaggctgggtgcgggggctcacacctgtaatcccagcactttgggaggcagaggcaggaggagcacaggagctggagaccagcctgggcaacacagggagaccccgcctctacaaaaagtgaaaaaattagccaggtgtggtgctgcacacctgtagtcccagctacttaagaggctgagatgggaggatcgcttgagccctggaatgttgaggctacaatgagctgtgattgtgtcactgcactccagcctggaagacaaagcaagatcctgtctcaaataataaaaaaaataagaactccagggtacatttgctcctagaactctaccacatagccccaaacagagccatcaccatcacatccctaacagtcctgggtcttcctcagtgtccagcctgacttctgttcttcctcattccagatctgcaagattgtaagacagcctgtgctccctcgctccttcctctgcattgcccctcttctccctctccaaacagagggaactctcctacccccaaggaggtgaaagctgctaccacctctgtgcccccccggcaatgcaccaactggatcctacccgaatttatgattaagattgctgaagagctgccaaacactgctgccaccccctctgttcccttattgctgcttgtcactgcctgacattcacggcagaggcaaggctgctgcagctccgctggctgtgcacattccctcctgctccccagagactgcctccgccatcccacagatgatggatcttcagtgggttctcttgggctctaggtcccggagaatgttgtgaggggtttatttttttttaatagtgttcataaagaaagacatagtattcttcttctcaagacgtggggggaaattatctcattatcgaggccctgctatgctgtgtgtctgggcgtgttgtatgtcctgctgccgatgccttcattaaaatgatttgg

SEQ ID NO: 37298 - DNA, 658350 bp, Homo sapiens; identical to SEQ ID NO: 37297

SEQ ID NO: 37299 - DNA, 22777 bp, Homo sapiens
ggcagagggtgggccttaggacgggtctcccttaaactgggcgatcaggcagcgaccctagaggcgtctgtagggtaaagctgggggttctgtagccggaggcggcggcgagtccagaacgtcctggccttacagggagaaggcgtcactcgcggttacaagtgcctgaccctcactccagttggcggaggaggagaaggaaggggccgggccgggtcccctcccctcgcgccccggatggatgtgcccggcccggtgtctcggcgggcggcggcggcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtacgcgcggcggacgcggggcgcgggaagggcgggcgaccggcctgcgggtgggcagcggaggaagagaggaccgagaaaagcgctcgagccattctcggcagagatttctgattttgccagttggaggtcggcttcgtgctcttctttgtgttcatgattttctgttttcttcggctctgtaggacgagtctcctgcgaagggctcagaacacgcgtccagaggccccgtgccttgtgcgtcaggcagtatgctgatcgtgttgtaatgtggcttagcgtgactgcccagactggtccagcagttcctgctgggggcgagggggcaatattttgacaaagaagtgaaaacagcaaagtgtactttggacacggcttagtaaatattcattgactgaaagtaggcaaccactgcttttctgaaaggatcttccctctacctccttcacctgcttcctgtccataccttactttgtttgcatttggcagaatgggtgggcttaatcaagtaaggacaggacagaagtacagaacatcttaatttgtcttgatttttaattgggtgaggttgtgtccaaggatatcctgcccctctctaccttaagaccaacctccagggataaaggcagatggtgaaacataattgacttttaattatagtgtttcttgtattgcgaattgttgcttcacagatgttagttttgcttctcagatacaaggtgatgtctttgaaggccttctgtgatgttcagggtaattgagagcacgtagtccatcatcaagagtttcttgctgattgattttttccctagatgagggcttacaaataaagtacttcagaagcgcatagtgtactttagaaatgtgctgacctatttaagtgcatggtcaaaaccagcacttgatttttgcagaagaaagacaatatataaactgagaaagaaattaaacccaaagtacttccacaaaaccgaaataaagccgattcaacaccctcttccttgaatacaacaaagggtgaaagctgaggtctcatgttctttttcctactatcagtcaaggggccacttgagagctttttcttttttcctacacctgttccttccaccctgcctccttgccccaggtgctgtaaaatactcctcccatttaaaccttactcttctctatgtgggtagtagtcagtcacttcttttgagtagccactcagtaaccctgcataacaggtcagaacaagagatggcactaccggaatcatttgcacactggcgagatatagttactcatagtttgttgtttgcagtttgtttgttgcaatgctccgtcattttcaagggcacttgagagagaattaagaatcagtattgacttacgtattgagggtttcacttgagagtctgacatttgttcacttctagcaagtatcactgactttttgcctggccttaaattaccctattgacctgccagttgtgggatggagtggctgggccgtttctcagtcttgtggatcattacataagcgaccgtaacagttattcataacctatttgagttttaatactgatttaaagcaataatgtcaaaacagccaaatttcatgacagaatgattttacaagaaaattactgcactgatatgagaaagtatgattctggagacccaaaacaaccactgaatctgaggtgtagccactgaggcagaattgatactgctgtgaacagctgaccattaaagtttcatgtgaactgccatgtgatctgcacagtttgtgcgcctttccggatagtgaaacacagggagagaaacatgttcccagtgttgatatttgaaagctgatctgttttgtcatgtgctctgggtagaaggttgctgtgtgacgtgctaccaagatcatgtgctctgtcctatcagaaagcttttcaaggtgagtgaagtgtgttcagggggcacagaaataaagcagagttgccaggcgtagtaactatttgctgattgtgtaacaaaaaacataagtgtacttctcttattgcaaattagttgaggaaaagcgtgggatttgaagagaaatctagtagtctggggaaggggtgtcttctcagaggaccaccaaatcatggctgattctcctctgcttaccttgtggcaaaccctacgtttttttgtataactaataattgaaataaatagaacaacttattcattacttactgaatgcttgttttttgccatggacagttaaataaaaaaaattacatgatttttaagcaaagctaatgctaagtcatattcagcgacatttgtattaaagtttgtatttgctcttagaagactgcagaagggccaagttggtttgaatagagctattgttaactaaatcctaaaacaaaaggagaggagaaaaagatttcttctgtctactctcaaaagtttttttcttagatttcaggaaaagcattaattttaaaacagataccagtgtgtaagttttaagcaggctaaaatttgactgtatgttaatagttgaaggccagactttcagtaaaacagatctttatctctaaaaacttttttatcctttcatcattgtagcatgtgttttgacagacatttactacctttcttagatttttttaaacattccacctattttgcctgatattcagagcctcacgaagtttggtttttacctccttgacagccttatatcctactacaaaccttcttccccttaccacttccacataaccaagctccattcatattaatctaatagtcttaagtccagcatatccacagtctcatctgttgacatgtactcaaagacttattctcttcttggaataatcttcccatatatatctgttgatatctttgttagcctttaggtttctcatccttcaaggtccattttgaagaaacaaccctgtatttcctatttccattataaatactgcatatattatatattcctcactaggttcaatactcctggagagctgaggatctcagtttatttatttagagacagtcttgctctgttgcccaggctggagtgcagtggtgcgatctcggctcactgcaacgtctacctcccaggtttaagcgattctcatgcctcagtttcctgagtagccaggattataggcttgtgccactactctcagctaattttttatatttttagtagagtcggggttttgccatgttggccaggctggttttgaacccctggcctcaagtgatctgtccaacttggcctcccaaagtgctaggattacaggcatgagctacagtgcctagccttattttattcttttttttttaaattttttaattttaattttaatttttattttttgagatggagtttcgctcttgttgcccaggctggagtgcaatggcgtgatctcggctcactgcaatctctgcctcccagattcaagtgattctcctggctcagcctcccaagtagctgggactacaggcacacgccaccatgcccggctaatttttttgtatttttagtagagatggggttttgccatgttggccaggctggtctcgaacgcctgacctcaggtaatctacccacctcggcttcccaaagtgctgggattacaggcatgagccactgcgcctggccattttattctttttgtcacctccgtgctggttgaaaacaatgttgtgcaaataactgcctattagttgtttaattgaaacttgattctaatttaaagcctaaatctaaattagaacttaaaaatgaacatctgttttcccttgactttgtagctcaagaaaacacaagcactgatccaaagagttgtgaaaggcaccttggtcataataaaatcaattcccgttgctcacatagcagatgttacgtgaagtgagaagttggagtatggacaattaataagggtctgtaattggtacatttttgcctgtaggatgtttcccttcaagattcaaaatatcaaggaagcattttttgctgtcattggaaacactgaaaaagaaaaggatctgccttggagacccattagttaagtgctggagactgtagtctttatctcttcatgaatgccctgtaaaagcacctcagtgcagattggaaaagctactgcaagcattagaattaacctggaagatagtagatgattaatagcagttttctgattgaagaaaccaggcattttagtgtggcggattcagaatttatgaattcagatccttcttctgccaatcctgtgataacttgggacaattcacttaacctttctttaaggccaagtttccttgtttgtaaaatagagatgatagaagcatttaccttaggtttgtggtttggattaaatagagagaatttagagaaagtgcttagcgtggtgtgtaacacagcagtagaggtttgttattatgatgctgataatagtgtgagtggggcattccccctgggttgatgtcttttaaaggagaaaatgcaggtttcttatttagaataagttaaagagaaactatctggtcttccccctctcccctatttgcctttctttttgtttttagttgttattgcaaggttggcagtgttactctcctccatcttcattatctaaattgtagttttgtaatagtagaattagactcatgagtaaagatacgttaaattgataatttaaaggatgaaacttagacaatgaaaacttagcagttaatcattttgggacaactatggttaaaagttatgtaacatgtctaagcacagacaatattattggagtgaagaggtcatccaaaatcccaaaacaaaggaagatgaactattgaagggagcagtagaggacatttttaaaggaaaggtttaatggctagtacttcatggtgctatgttggggaaattgtgaaggtgacacttagtcaaacagaggaggcagtttcaaactttagaaaatggacaggctgggtgcggtggttcacagcactttgggaggctgaggcgggcggatcatgaggtcaggagttcgagaccagcctggccaacatattgaaaccctgtctctcccaaaaatacaaaaaattggcccggcatggtgacaggcacctgtaattccagctactcgggaggctgaggcaggagaatcgcttgaactcaggaggcagaggttgcagtgagccgagatcacgccattgcactccagcctgggtgacaagagtgaaactccgtctcaaaaaaaaaagaaagctgacagatagtatctgtaaaagtataggccacaaaggaatgacaagttgttaattagaacacaactggaaatctcaagattacccttacctgctttggttttctacttagagttatttaatgcagctaagggcacttttttcctcatttgctaaaatttccacagttttgaatacgaatcatttctacatttcttgattattcgtttaggcacatagtcaggtgcaacaaaatttcctgatcaagtggagcttgctaactgatttaccaacacaaattagaccaaaattcatgaaggtgaggccattaaacagatcacttttgtctggaatgtatttcagaaaacagggattatgttttacttttatagctatgctctgcactggcaagagattttgcaacaattttttattgtttgcctaaaaccttagaaccttagctcatattagacttgagtgaactgagatgtacaggaaagataaaaagaaagttactattggtctcagaatgtaaaagtctgggattaggttgcttcatcacaaagtattcagccttttaccaaaactacctttcaaaaagcacttaaaagttgaggccactgacaaaaggaaggaaaaatctcctacagtgattgttgttggaagaatgggaatgatagctcaattaatttagttaattcatactgccccagatgtccttgtcagcttgtcctctagtcttcagactttgtgaataaatcaggtggagtaagtaatttacatgttgtgtctcatttactttttgcaacaaacaaccgccctttactgataatggagattaaggctaaggggaactaaaagaatgttgtctacaatcacacagcaagtgatggaactgaaattcctgttggggtctttctggtttaaagtttattttaaagatcatttctactatatcccaattttaaaatatgcattagaaagaaaacagcaaaaacttcttttttctatttaaaaacaagcaaaaagaaggacataaaagttgcctatattcctgccatctagagagacttaattctgtcaagactgtaggacacattgaccatctttatttgttcctctgccccaaaagaaacaaaacttaaagtcagagaagcttaatgaaacagtaggataaaggctccctatcttgtgtctagaagtaagaattgacagtgattccgttttcaaagcatttattgaatagtatcttccaaacagtatgctggcttttagacaggttatacaggtgaatgtaggggtctatccttaaaaagcctataaggcagttgttctcaactctggctcatttaaaactctattgggaagtttttagaaaatatctgtggctgggcattttttttttttaaagagacagagtcttgctctgtcatacagactggagtgtagtggtgtgatcataagtcactgcagccccaaactcctgggctcaagcaattctcccacctcagcctcctgagtagcagccataggcatgtgccacaacgcttggctaacacatttttttaaagcttcttaggagatgcagccatggtgaagagccagtattatgaattaattggggaaactgatgcatatagatcagtattaggagagtttgaggctaggccagatggctcacatgtctgtaatcccagcagtttgggaggctgaggctggtggattgctttgagcccaggagtttgagaccagcctgggtaacgtggtgaaaccctatctctaccaaaaaaaaaaaaaaaaaaaaaaaaaaaaattagctggttgtggtagtacaggcctgtagtcccagctactggggaggctgaggtggaaggatcacctgagcctcacctgaggcggaggttgcagtgaaccatgattctgccactgcattccagcctaggtgacagagggagaccctgtctcaaaaaaacaaaaaacaaaaccaaaaaaaaaaaaagggtttgaatgttgtaatacaagtacttttggcttccgcaaagtctttctgaataaggaagtctttgaactaggccttgattaatgggaagaatttattaggaaaaagatgatggtattggggataggaaaggatatttcaggctgggcgaggtggctcacccttgtaatcctagcgctttgggaggctcctcatttgaggtcaggagtttgagaccagcctggccaacatggtgaaaccccacctctactaaaaatacaaaaattagccaggcgtgatggtgggtccctgtaatctcagctattcgggaggctgaggcaggagaatcacttgaacctgggaggcagaggttgcagtgagccaagatcgtaccactgcactccagcctgggcgcagaacaagactccatctcaaacaaaaaagagagaaaagacattttcaaagttatctgaactgctgttgtcaaggttgagatctttgaggtatttgtaggttgttttttatgaataaattctttatgagtattccaggtcctttcatcactaatgttttttgttttttttttttctctttctaccaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggtaagctcagccttaaatatcttgtaattgctactatgggggctggacccgtggtgaaaaaaacagcaaactccctcttggtagatcttgtatttatttggattcatgttttatcctgagttggtttattgctttattcattcattcattcattcattcaagctatggtttatttatattagggatgacacatttattttttcctggagtgcgtgacctccaaagtcagactgatacagcattatattgttcatgtcagagatgccttggattgcaagggctgtgtcttcatcttttgagtgtttggcatataaataaagcactcagaaaattgttgctaaatgagtagatgaaatgattctaataaatgattaagtatctacttctagtttctgaattgaagcccaaattattattattattattattatttttgagacagagtcttgctctattgctgaggctggagaacagtggtgcgatctcgattcactgcaacctccgcctccagagttcaagcagttctcctgccccagcctctccctagtagctgggattatgggcgctcgccaccacgcccagctaatttttgtattttagtagagacggggtttcatcatgtgggccaggctggtctcgaactcctgacctcaagcagtccaccagcctcagcctcccaaagtgctgggattacaggcgtgagccaccgcacccagtcatgaagcccacagtatttaagggtaagaagttaatttcctcttctgtgctagaagggatatctgttatttatttttcaaatgacaatttgctgaagtgaagtagtaatgaataatacagacgaagagatcacaagaggacagtttgaggtggtgatggaataaatagtaaaagtgtgttatgaagctgtctcttggaagagagaggtatggcattaaaataatttatccatctgttctgtctagccaggaagatgaattcctttccctagacacccacccttttttttttttaaatattcaagtgttttttttgtttctattaggttataagctgtgaggaacaaagttaattccagccacactgtagtcttagttttcctgggacatgtttggaaataagcctattaacattccagctttgtaggtggcctcagtcggactgagctccataagctttgtaggctggctgataataaagaaccattatgagtaaagtctttcattctctactgagagttaactgaattgtttaaatgtggcatctaatgtcctcattgaaaattactctcttttctctatccccgttcttcagctctcaaattactacttgaaatttaggttatcatcccagagagcctgggtagacttgtagagcctgggcaaccctcatcatgaaactcaccttgattaccagggcacctgtgagcactttttgtcagaatgaccaaggattaagtggcaatgaaatgctgatttttttcatagtttgttaggtgatattagagagtcaacagagggttgatgggggagggaaggaggtgtgtaatcatttcatagattttatgaagtggaaaaaaaataaagacacttctttatctgttttgaatgtgttacagtggctttagctaaaattaacgtatatacagataatatgtgtataaatatatattttagatattaacatattgaccatagttctaaagatttttatagacagtttcaaacttttttgaatataagtaagaaacatagaaaacattttacatagaaaacctgtacatacataggtatgtatatattttatatataacagaaacaagttttacaacagtgttttattctgatacattcttttattttttttaaattcagttcactgtcctctaaatcaattttattgccaacttatgggtgatgacctatagttttaaaaactgttctagatcaacttgaaatacttgtttatagatacacagtgtgtcagtattttatatactgaagaattgtagaattttagagttagaaatgactctaatcacaagtcatagaaaaagcagagcattttaaaaagagattagatttcatcaagactgtccttttagagataaggattaggatcagagattagcaacttatgcagaattgtacaaatatactcttgaacataatttaaaagtgtgtatgagatccagttctttctaaacctttctcggtgaagtcttttaactggggtaacaatgtcagaaccatcatgtcagttacactgttttcagaattaggattcaagtcagttccctgatatcctaggctctgctactgataccatagcagatgggcagtgctgcttggtattggcactgactggccctaaaatgctgctgtttttctttggcaagcatgaagaaaattcagaatatggatattagggatcacagagctattttaagttgacaagacctataattaaaccataaattataattgtggtaattattgaagagtaggtaggtaggtggttttatcttgatttttatagaaagagaaaatgaagtaagaggagtctaagtgatagctcattctacaagttaccttagagtatttgtgagttatttttaaagagagtctattgcattggggcaaagggtgctgatcttgcagaaagaagaaccaaagctggtgactttcttttacaagcagagctggattcattatgtagttggctgattggtgaaactgatttattttgagttcttcatctattagaaatgacataaattaaaccacttctttagcacaggttctgacatgtaattaatacctagtaaatgattctcttaatatagccatgcttttatttgtagtttgatatcttttactactagtaagtgttctttctgtgtctgcatgtctaaggtctctaaacaatgacaacagtgaaattaatgcttccactttggtattaaataatgtcatttctagcagcagggtgtagtgagttaccacctacctccctcaccaaaacccataaaaataaaaaactacaataaaccctgagaaccaaaatgaacgaaaatctattcgcttcattcattgtgagtttttaagaaagtgaagtccaaaccctagttctaatacttgggcaagttacttaattctgtgagatttagtttccttatgtacatatctaccttatacagttattttgagtatttaaagctttcaaatgagtttacatagtaggtttccaataaatggtaattgctattattactattatcattatcattacacgtgaataatccggaacagctctgtacttttatggtagatagtcatgtatttgtgaggttgtaaatagagcaatctttccttttctctttgaattaatcacccctggtcatcttcatcatcatcatcatcacacctcctgtttattttgacctgggtatcagatactgtgctaagaactttagagtcagtatgttatttgattcttattaaaactcaataatgtagatatttgctcattttacagaagaggaaactaaatttagttaactgacttgcgcaaaggcacataggaagtggcactttaaaactttccaactcaggctgggcatggtgactcacacctgtaatcccagcactttgggtgggcaaggcaggcagatcacttgaggtcaggagttcgagacgagccttgccaacatagtgaaacacgatgtctgctaaaaaaaaaaaaaaaatacaaaaactagctgggcgtggtggtgcatgcctgtaatcccagctacttgggaggctgaggcaggagagttgctttaacccgggaggcagaggttgcagtgggctgagatagtgccactgtactctagcctgggcaacagagactctgtctcaaaaaaataaataaataaataaaatttccacccatatctagttgactcaaaaaccaccactacagtagaaacttccattccctgatagagggaagtaattgttaaagatttttaaatttataaaacagcgtcaaaatcttatgttcaaatgaaatctgaaactagatgcccgttatgataagtaaataaaaattgagcctttctgattgaaacaggaatgcaggtctgataattttacatacttgagcctgttattcatcccacatgaaactcttaaagctccatggaacacagtgaaggccacttattaaattagagcatgcatgattaactatgagcagctcagagttttgatgtaatagaaataaacctttgtttgtagatgtaatttaacaagaaacataaaaggtaatatgtcaaatgctactttataaagtgtgattcatataagcttaacatttgaagcctagaaaacagcatagaaggaagcctgcagattatagcacgaggtgctgattttataaacaggacctgccatcttttctttttggcatggccagataatagattgagtagttattaacctctgtgtgtggaattcattattatgtaatagatctaaagttctcaaatgcattatactgggcattattttatgtatgccatgactttttaagctatgcaataaaaataacactaattgagcccctctataataaatatatacattatctagtgtaactctgtataatcttttgtggataggttttattgttatcattttcattttctagatgagaaaagtaaggctttcttatcagtttatggtaggatttctaatagaaacttgtgaatccttttaatagttccattcttccaggaatatactttcttttcttataatccttccagcatccttgaaagttttagatatcccagttgttttccaagttatattggttaagcaactgaagctaaatagtaaaattctgatgtagttcaataaaactggtggaccttgaataaagacttatgaaaatgtgcttggtaccattcactcactcttagcaaattcacattatatatgattaacaattgtcttgtgatttgtttaaattcacaaggtttgctctcatacacagtgccaagaaatcaatcttgtaacagcagtatgttgtacttctaggtggttatcttatgcaaattcatcaagtagaattttcaagtgtcggtacttctttctctgagttattttgattaacctcagtactcctccctgaattttggaaaggggctgtagtaatggtacttgaaggatatccccctctgggctaaacagcacaaagaaggaagcaccacactggggttgctttgggatggtatgagaaggtaaaacaacgatgaaactcggattctcagtccagtgaggttttctagcctctgagggagaaaatggcctttatttaactaatgttgatggtcactgttactgtatataagaggagaaaatatctattaattttataaaaatgatatatatggtgtgtgtgtatatatacacacacacacacacacacacacgtttgttttttgagacagagtctgtctctgtcgcccaggctggagtgcagtggcgtgatcacggatcactgcagccttgatcttctaggttcaagtgatcctcccacctcagtctcctgagtagcagggactacatgtgtacaccaccacacccagctaattaaattgtgtgtgtgtgtgtgtgtgtgtgtgtgtgtgtgtgtgtgtgtgtggagacgggatcttactatgttgcccagcttgatcttgaacttctgggttcaagcatttctcctgccacggcctcctgaagtgtgatgattccaggtgtgagccactgtgcctggcatctacttatttttttaaattaaatgttacagaaagctatataaaaaataaaaaatcacctgaactactaccacccaaagattagtgaacttcttttcaaacatctcttttcctatatacatatgtacgtatacattttatagtaaatgaaattgtgatctacatgtagtcttgtaacttgctgttattttactcagtggtatattgtactcatctttccatggctctcattttgcctttccatgttagccacaaaagtaaaattttctgtgggttttttttttttttggtagagataggatctcactttcttgcccaggctggtcttgaactcctgggctcaagcaatccttctgtcttggcctcccaaagtgctgagattatagacatgagtcactacacccggccttcccatgttctgagcaaggcccagggattacagtaacctttggtagattagtcctttcatacagttgaaatcagagatatctcacagagtgtctgacatctcatattgacttcttgggatagtgcgtagctcagtaatgtcttgcttcactcaattataagcccagtagctttatttattactttattataatactatttctcattgtttaaatattaagtaatataaaaagtttaaggaagaaaatttaaatcactaagaacccaccacctagagagaactgctaatattttggtctacttctttccaatatttctatcttaactgttggatcagtctgtcaattataacgataggaggccttaactgaatagtgatttattagggttgctagtctgttgcttattattattcttgttatgttgtttgccagtttatgggagatgtagattacagactcccattggctgaagcctgcggtctcttttcatcatcttcattttgtaaacagtacatcttttgctgggttgattacatacagctgtgttaatgctatagtgcatttaaagcaaaaatcctatgagaacatatttttcgccagaggggataaatgtatttgttaataagtttatgaagtaagcagttagttttcacaaggaaaaaagtctgttaggtaagtaattgggcctgtaaattgctttctatataattgccttcatcagagtttgagcattgttcccttttgctatgtaggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtaagcaatgcaggataatagagggtcgtggtgggggagggattcctctggtagttaagccagccataatcagatttattcacccctcccaaatttgaaatagcctcaaaaaatgattattttgagctagattttacaatttaggaggacaacttagaagtactcaagtggagcaggactatgactaacaaactggaatttttttataagctttgagtaaacctaatataataattttcaagattgtttatccaagtttccattatctctgtatttactgggtagttttgtcacttgatgtgaaattttgaatggcaatatataatagtttataacaatagtatctaatatttgttgaatgttaatatgtgctaggtactgttctatggacattatatacattaactcaatcctcacaaaattcctgagataggtagaatttatccccattttgcaatggaaacttgggactggtaggttaataacttgctcaaggtcatatggatggtaagtagtaaagtcaagacttgaactcaggcaggatggcttcagagcctgtgtatttgaccatcttactctattgttcatttctaatttgttgacctacctcctgaggttgttggatggtgttatatgatttctgtaaacacttattatctgtcttggccctcagaaaacacttcatagattttagctatccttatcatcatcactgttttaccaaaaggcagagaagcccttttgccatgttctagactgctccttggtttgaaggagagatgactcatcctgccatgatgccaaattagaagctatggttctttttgactcttgcctctgcttcagctgcagcattttttttccttagcaatgtccctgtgtctttgtcctgcattttcatctcattgccacctctcctaattcagtctgtcatctcagtggctccattttattgattccatcaagttcagaaatttctgtgtgagtttcaaggccctccataatcttgagctattctgtttataagtttgcagattttaaaatttaataatctaagctgagtttttaatttattgcaacagcatttgtgtagcaaaataattggattttttttgtttgttctgtaggtgctgttgctgtgtttgcagttggttatataaaaatatcctggtcaacttggggagaaatgacattatctctcttttctctcctgattgctgctgcagtgtatatcatggacactgtgggtaacatttgggtgtgctatgcatcctatgttgtcttcagaatcatctacatgttactcatcacgatagcaacgtatgtattttggctcatagaagccttaggaaaaattgtaacaggataaattttttggtttctttacaaaccaaaatattcaagtttctagttaaatgaggcaaatgggaggaagcattgtattatatgtgcattatcagtttttctcctgaggaagcatttaggcaagttttgtttattcccatgtttgtatgttcctactgttttcagatgtttgcatgagatttatatcatttagttgcagaatgttttcatttggttggaaaggcaattgacagtagaaagaaggactcttcatgtttaaagataaatgtttacttttatttagaataaatattataagtactccagaagtaattcttatttattcactcttttatttttttttaagttttcaaattgctgcaaacctcagcatggaacgctatgccctagtatttggtgtaaataccttcattgccctggcactgcagacgctgctcactctaattgtggtagatgccagtggccttggattagaaattaccactcaggtaagatctctcctttggcatcgaaggtagtatgtgtgacttgatcagggtgacagaagtatatgtatgcttaatgaaaacaaatccaaacaatagggaacagatgtaaagtaaaagcataccctccttccttcattcaacatcttctcccctatccttagttcttttctcctgggagggtgttgggattgtcaggtcttagaacattcccgagtgtaactcatcagcccaatggggctgtttcagctgagaggtaatattgattccttacagaccaagaccttctgcttcctcatccattatttccctctatacttaaatctatgcttggaatactgtatcccatgtttgagattccctgcttcatctcacaactctttaagtctcctcccttctttatttaaaacacccctcacccaaataccacggtaatgccttgctgctgatgaacaacattatgatttgtaacttatgactattgagaaacttgcaccaacacccaacaacaatgtgaatactttttacgttcaggaattgtatagttgtatatgccttcatgcattgtgagttttaagtatatcttgttttgtactttggtaaaatgggcaactgaatgaatcaagaagtatttactcccacccccatcccaacccaaatgatttcttcccaacatattagccgtaattaactttgtttttactgaagcgatctaagagagaaatagtaataatagacaatgtgcattgagtgcctctacgtgtcaagtgctttatataggatttgtagggttgctgtattagacatgaagaagatgagtctgagagatgttaagtgacttgtccataccatcactagtagtgttccagagcttagagttaaaccaacatctaaccccaaaacttatttcaggatggaaagtaggagagaaacttaagtgcttgccatcctccctgtataagggagagttcccaggactattacagttgagggaaacatggctgtcattggaagtggaaatttgtcagcagattcttatagaaatggtggatttaaacacgtggaataataggattttatgggtggtgctgaaaccctaactgccatgattgattaatggcttcctgcagaagtgtagccaacattgaaagaaactggctcagtgatttaaggccatactctcattgtacttttgaaccagtttgtaagtatttagtatgttattttaagaagatgatgatgatgatgatgttaataaaccatatagtcacattaaaatttcgcttagggcatcatccgccgcaaactaacacaggaacagaaaaccaaacactgcatgttctcactcataagtcggtgttggacaatgagaacacatggacacagggaggggaacaacacacattggggcctgttggggggtgggaggcaagggaagggagagcattaggacaaatacctaatgtatgcagggcttaaaacctagatgatgggttgataggtgcagcaaaccaccatggcacacgtatacctatataacaaatctgcacattctgcacatgtaccccagaacttaaaaaaaaaaaattgtcttagggaagaattcttacattaagtaatcctgtaatggaatatagttgacctgccgctgccctcttctggggaaaaatagagaagttcttgatcttcagaatttggcctatttgtacccacctatcagcttgaaggcagagaccaggactgaattataacaataacagcaacaacaataaaagtaatactaacagcattagcattgtgctaataagcatttatgatctcactgatgggtaccaacatcgctgtaaagtgagaactactatgaattccattttgtaagtgaagaagggctcagagatgaagtatctcaatcaagttcacgcagcttgtaagggatgaagtcaggattcacactcaggcagtcaggctttatttagtaccaccgtgctgtgatgctgctttgtgtcttcagggtctggcacgtggtgtaagtatgcaatattttttgaggctttatggacaaattctgaatatactttattatagagtaatcctcttgtcattgataattcaataaactgcttttcccccttctagtttttgatctatgccagttattttgcactcatcgctgtggttttcctggccagtggtgcagtcagtgttatgaagaaatgtagaaagctggaagatccacaatcaagttctcaagtaaccacttcataatatactgctgaagggcttcttcttatagcaagaactctgcacagcaactgcctggatgtgtttgattttttaaagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtatattttctctttttaatcaaaattgttttaaatttatcttctatttcagtaggagctttagattatatctttaaatattttaataatttatcctaggacaaatttcatattaagtcttcccctggtctaacttgcctagttaaccttttgttatctttttaattattccattgctttgtgatttttacctttgactcttcccccttatttcagatgttttcccccttttttttggcaccccgttgcactgtttttttttttttttttggttttcatgttggcactgctcttatctctttttaaagcattcttccttaaaaaaaaaaaaagacactctctttgatgttaactgaatttttacaataaaggaaattaaagcaagagcagaaaataccaccttgttctgaaacttcatagcctctttgttccacctcaaattattctgatacccagggaggaatcttcttgccatgagttgagaatcatttgtccattatatcccagaaacctaatcagtattttcttacagtatccaaatgagtaccattttttaatataccatttcaaaatctacttaaggcattgatttcgctgcttatcaccaaagtcctggaaatttttcatgcaaaaataaattttttttttttgagacagtcttgcactgttgcccaggctgcagtgcagtggcaatctcggctcactgc

SEQ ID NO: 37300 - DNA, 384241 bp, Homo sapiens; identical to SEQ ID NO: 36955

SEQ ID NO: 37301 - DNA, 14939 bp, Homo sapiens; identical to SEQ ID NO: 36454

SEQ ID NO: 37302 - DNA, 7595 bp, Homo sapiens
gtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacaggtagggtgtgcacacaggtacagcggcgggcggtgggcgccgggccccggaacgtcaccggggcggggccggcgggcgtgctgacgtcgggcccgggaggggcgcgggggctgctggggcgacgcgcgctggtcggcttcgtggggcttcggacggcctccagcatcctgatgggggctggagtgtccccagccctggaggggtgggggagcttgatggttaacggagccgactgcggagggcgatggcccacgtctgggtgcggggcccacacccggttctgcgactcgaagaaacgtctctgcccctaggagtcccttggtgtagaccacagggttgctgtgaaactcagcagtgttaaactcgcctatgttacacagtacctggcgcggcgtagacactcagtaaatgttagctaatcttgtatgccaggagcattggccaccatatctaatgtaattacaaggcaaattttagccccttttttaccaaagactggatgaacccagtccctggtggtctagtggctaggagaaaaaaaaaaaaaaatgagcccagacgttcagtttccgaagcagcatagttgggatttgaatcccgatcatacatactgcttgcatgcactgacgagttgattttgaggaattttaccacgcactaaccagctccaccctctggccctccgtatcgtcgtctgtgaaatgaggatgaccatcgctatctaacaggattcatccctccattcgctaaaccaggttttgtttcgtgcttgtcagggcttgtgctaggtaacggatgcatcagggatcttgtatggggtttccaatctggcctattttgtggagggtacactgagaaaattttgtgcaaaagactttagcactctaaatacaagaagtggctgagcaggagaaagtgggggtgtgttattccattttgcattgccacaaaggaatactgagactggtattttataaagaaaagaggtttatttggttctgcaggctgtacaagaagcatggcaccagcatctgcttctgttgaggcctcagggaccttccactcatggtggaaggcgaagggcgagcaagcaggcaactcacagggcaagtgagggagcaagagagaggagaggaggtgccaggctttttttaacaaccagctcgcccattgactaatagagcgagaactcactcattgcttcagggagggcaccaagccattcataagggatccacttccatgagccaaacatctcccactaggccccatctccaacactggggatcacatttcaacatgacaattggaggggacaaacatccaaactacattggggggaataataaagaggatctcaaaaaaaaggggttgtataataagcttaaacacctgagggtggtaaggtctcatagacgatgcgaaattgaatggatgggtataagtataaacattaagcaatttgttttctgtctgagacgacagccaaagattgtaattttaaaaattcacctgcttggaatattcctcaacagattggtaaagttctcatgaggcagtagttgagacatagtataaagcaagattgctaaataggagacttaccaggtcatgtaatttttttaaattattttttctggatgagtagtttagcttctgagagaaatgagatagtaagccactttgcggatcaccatctatgtttatcattatatgctgttatttcattcagcacttgcctgttacattgtaggcactcagtaatgttgaattgaaaagtggaaggcccatgagcagatcagttgctgtggaacaagggggttgaagttaaggtttgtttgtgctaatttgtatggtacaatcttctaattagggaatatgccatggtttgtgacgtatacgtaagtaataaaatcaacatgatttctgactctccctttggtgagctaaagtaataaattgggaaacttttcaaagatcagtacaaataataaatataaggaacagagaagggggtttgaatgtgatacttgtgtcatgctgacttttttttttttttttggtcagtaaatttctaagtgatgaagaaaacttgaaactgtttgggaaatgcaacaatccaaatggccatgggcacaattataaaggtgagagaaaaactgatgacatttcagcccttcaataaggatgaaagagtattcagcaaatgtagacataaagaatgggaaaacttacggacacagtgtgaatgctttgagccttgaatgagaaattaaatgggagttcagaatgaaaggatctgttgtcttggttgggtgtgtgttaagttttaccttgcaatgtcaactcttacaaacagtccaaaacaatgaatggtttaaagcatttttctttgtcctagagtacacaacaagtttctttctgattaggtatggccaaggctaatgttaaaattagattttattctttgagtaaataatgactgacaaaaggggaatgttgcctaggaatgtaatgtatggcagaaaaataggtttggtctaaagctttgccagcagtgttcgaagaaagtaggtaatttgttcaaggataagagacttgattctttgaggtacagcctgccttaaaaaacaggtacataagtcgtagagtataaaacagtatgtggtgtggtggcataaaaaaaaacagacaaggtgtcaggagattaggattactggtttagctacagcctcttccttaatctatggtatctcagtctcagtgtactcacttacatgtaatatctaatggtatttgtacagaactaaaatacataaattcataaaagttattaatgtgtaaagcactgataaagtttttttttgttgttgttgtttttttttttgagatggagttccactctttttgcccaggctggaatggtgtgatctcccgtcactacaacctccacctcccaggttcgagcgattctccagcctcagcctcccgagtagctgagattacaggcgcccgccactatgcctggctaatttttgtatttttagtagagatggggtttcaccatgttggccaggctgctctcaaactccagacctcaggtgatctgcccgcctcggcctcccgaagtgctgggattacaggcttgagccaccacgcctggccaagatttttcaaatgcttctcacaagcactttttaatttacaaagcattactttagactttgtatacattcatgtgagtaaggggacaagaatttaaggcccagtagtattgcttgttcagaaaggtactgctcagtattggaccagcttgctgtgtagctggacacctgaaagacattttctacttctacaggcagagactgagcagcatcttgatgctccctagtgcattaacataagcagaatttacacccttttcagccttggccgagtgcctctgcttagccaacattcctactaagctcctttgtctcgattgtgtcttgctttggttgctaaaaaaaaaatcttaactaaaataacagatgttttggggtaaatatttaagtatagcttttggggacagatctaataatttatgttgccaacttgtgcttgtatgttgctaacttgtgcttggatgttgatctgttgaaagtcatgctgttttttttgtattttgttttctttccatagttgtggtgacagtacatggagaggtatgtgcagaaaatatttgtgtggtttttgcagattgctgggctctctttcagccagtgtggtggattctgtgttgaaaactgttccagtcagtattgcttcattgttggcccttgtatatgtgtgtgtggtgagctgccgccattccaggcctctcctctaccaaagtgttgtctttaatatgctgtatgtggacaggtagaagggctatacaatgaaaaggatgcttgaagtacatggtgcttccatgctgaggtcaatgattatctctgggatgaaggcaaatgtgcaaatgtgggcacagtctctgcacattgtactgcctttaataatttgccagccgtttaatatggagagcctatcacagtaatattcacctttgtttattctttagattgaccctgctacgggaatggttatgaatctggctgatctcaaaaaatatatggaggtaatggcatgttgggtgcttattatgtgctattccctaactgtaatatttggtggccccctatctacctccccaaccagttatctcctaaggttccatgactttgtgaatagaactggatgtgggtgttggggaatagttggaagaactgctcgcatggcctctaaaggtgttttggtgacttaacggaaattagtcacagttgtgttacagcgatgggaggaaatataacatgctcaccttgtattccttgttggaatatcctgatttccttcagttaacaaattctccatttcttttaagacatagctttctccttgagacttactgtctttctttttttttttttttttaaataggcacagaaccaatgcaaacttttctttttggtagaggtaggggtctcactatgttgttcaggctggtctcagacacctcctgccttgacctcccaaagtgctggaattacaggcatgagctactgctcctggccttctccttggagctttctcttccctctctgaatattccttgtacctttgatcatagatttagacaccacactgtgttgttcattctagctttattataaactcaccagagcagtacctcatagagataacacacaaggtgttcaatgaagaacttaactgattgtgtcattatagaattcttgcactgtaagagactttggagattattcagaccaacttcttcaacccatagattaagattgagagatgctgaacagttaactgacttgccccaggtcatatggctagtcatttgcaaagctgggagtagatttctttccttccagctgttttattatgctgtcatttcacttgcagcttaggtttgttctgagatttgacatttgcttgattaaaatgatgttattagtaatgattacttctttcacattacttattcatatattcaacaaatttctctacttcgcatcagtttttgagctaagtgtacaaagatgaatgagatgtagcccacagagtgtatacattactttttctaggaggtgaagaatattattaaataactgttgatttaataaatgagtagaagaatgagtgaatgaagaaacagcactatgctcaaaatactttaggaaagttatacagatagggccagcatgcatttatggggcaggggttggggggcaggcggagagagagagagagggagacagagacaggagaagaggagggggaggggaggacaggggaggagaggggaggggaaagaaagaaaaagaaaaagagaaaagaaaagaaaagaaagaaaagagacaagacagcaacataaaaggcctcaacatatgactaaatactggaggagggcttctctatgctgttttctgcttttgtatgcctgaaggacaccacacactttcatcagtaaaagtggcttatcatggcatgtagagtaaagttagagctctaccgtggggggaggattgcttgagtccaggagttcaaggctgcagtgagctatgattatgccacttgcactccagcctggatgacagagaccctgtctctaaaaacaaaacaaaagaaaacaaaaagccctgcataagaggctttaatggagaaattgggactggaactgggattgaagatgaagcaaggatgcccgttttcttgttattcatgtggaacatcccttcattggatatatttcaataactgtttgatctaggacttactctttttgtatgattctagtttttctcaagaaatgattgctgttactgttattaatgtacccttcttcaaactacgtcctatggaaaattacatttttttttcacagatgcttagattttttgcaatagctaaaagcaaaaacctagaaagaatgaggcaatttaatccttgctgatgatgaggaaaaacattatgttaatatacacgagcattagggagtaatagtctttacatatatatatttttccttctatgagcccaagatcattcttaaattattcctcatagcaaaaatttagaactacttacataatttcagtctaggtctgctttataaaatgtagtagtcactggatctttgtccttatgatattgtggcattgttccgtaggtgtgacagtgttatggaaaaatatttgtgctaactgtttggacaggattcacaaagtgttaaactgaattctgaattacaatggcttgtgttgcgagaaagctccaggaattctctgctttttggtttctcacctctttttattcagtaacaaggattcctaatcattaccgacagctgggcctgactttattttacaacttgaaattttgtaaagttgccttgtaagactcaaatctagtacttacaaatatttagttagtggctaagtgataaggtgaggtttagaggcataagtggaacaatttggaatttgagtcgtaaatggagtcaatgatattttcccttggttttgtctctaggaggcgattatgcagccccttgatcataagaatctggatatggatgtgccatactttgcagatgtggtgaggtgggtggcactgtatcttgccttatgtggattgtaaaacaagaattgatttgaatactttgattgttgtgtgatttctgaagttttaatttaatgaaatctttcgaaactagaatttctattttctgtaaatattaaacatgaaattttattgtttgcattttgaattttttttgtttttgtttttttttcttatagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaatgttttggtgtgggattatttgaaagcaaaagaaatctaattttgttttctccattacctcattttagtattaatttttacttggtataatatacatggttaaaatgcttatgtgacttcgagtaggtgaatcttaaagaaataaaattcaagtgaccac

SEQ ID NO: 37303 - DNA, 9614 bp, Homo sapiens
tgactatccagctctgagagacgggagtttggagttgcccgctttactttggttgggttggggggggcggcgggctgttttgttccttttcttttttaagagttgggttttcttttttaattatccaaacagtgggcagcttcctcccccacacccaagtatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgccatggctcggatgaaccgcccggccccggtggaggtgagctacaaacacatgcgcttcctcatcacccacaaccccaccaacgccacgctcagcaccttcattgaggtgagtggagacggaggtgtggcaggcaggtggcccaggtgtctgggaagcccggctgagctgccctcaggcctcgcaagaggggtccccagccccggctggccagacagggctcacagccttggaacaaagcccagtcgcctgttacaggatcctggaggagggagatgggggtgccccgggggttggggttgagggtgttgggggatcaacggggtcccctgggaggcctgcagggggctggcgtgtgataggagggactccacgctgtgtggatagaggcagggggtgaggcagggggatacatggaccaggctgtgcgtgctcagccgtggcctgggctggggccctcccgagccctttgctgtcccagatgttgctgggctctggatgaggcctcaggttagaccaggctggactaggggcttcagggcccagatctctgtgtgaggagggactgagcaagggtcagcgctgaccacaggagggagggaccactgtgccctggagaggcagcagagatacctgccgctggcaaccctggcagatgggacgagatgcgtttacagaagctttcttgggagtggagtctggagcgacctgcatggcctcctggaggagcctggcctctgcagaacgccctgctgtttgcaggcctggggccgtttgcagcgtctgcagttgtgtgcggggccgttgacagagcctctgactgtgccaggctgtgtgagaggctgcagctgtgtgcagggtcatttatggctgagtcctttcccctgtgacatgagataagccatcatggtcttgtcataatgaaacagatttgggcgtgagagggcattaagaactgtagagcagcaggaggcattgggcaccttgccatcagggagcctggaccctggacactgagccaggtgccctacagaagatggctgtccctctcgcagctgagacccctgagataacagcagcatctacagaaagattggcgagaacagcacggtgagtggccagggtgaggcctcagaatatgactgggatcagggttaagtctgtaaccaaggtcaggtctcagtgtgtgaccaaggttggggctcactgtttgaccaggatcagggctctgtgtgaccagggtcagggttcggtgtgtgtctgggatcagggctcaatgtgtgaccagggttgaggctcagtgtgtgtccaggatcagggctcagtatgtgaccaaggttgggactcagtgtgtgtccaggattagcgctcagtatgtgaccaaggttggggctcagtgtttgaccaggatcagggcttagtgtgtgaccagggccagggtttggtgtgtgtctgggatcagggctcagtatgtgaccagggtcgaagctcagtgtgtgtccaagatcagggttcagtgtgtgaccaggattgaggcttagtaggtgagcagggttagggagggctcatcctgtgaccagggttaacgcttagtgtctgaccaggatcagggctcagtgtgtgacccagatcaaggctcggtatgtgaccaggattagggctcaatgtgtgaccagggttgggggctcagcacgtgatcaggattagggctcagaggtgtgtgactatcaaggctcaggacgtgaccaggatcagggctcagtgtgtgaccaggatcaggaagggctcagcctgtgaccagggccagggctgagccgtgggctgggtggccattccctctgctgagggtgcagagggcctctgaggtaccccatggccacagagcccagcaccctgcctgctccctgcattctcagatagttgggtgctggcctctctgtgttccaggtccctgtcccgtgaccagcaagacccatcagctgattcctcacccctcccaaaatagctacgagagcaggtggggtgggaacagcccccgcacgtgacccctgtggagtggatcctccgcagtgggggtataactatcggcctggctgtgaactaccaccaccttttccctggtcgtgtggggcttccctgctggcgtacagggcccagcttcctcctggctgccatctgagcggtgcccaccctccctgctctgaggcgccccagctgatgcccgcccctcttagaccctaaaaactggacccatccctgcggctcagctggggtcgctgttcggatgcaggggctcacacgtgggctggggagtccagttcctgctgtggggacccagtagcttttctggaagaaatgtccttgctggtagatctggggtcctgagcaccccagaggagggagtggtgtgctgggcagctggggtcccagctgccagttaccgtgaatgtaggtggggacacctttgcctctgctgggtggcccaagggacctaggacaggctcttcgacagccagacactacctcgaccagtagtggagcctgaagtccactcttggtggacctcactgcatcagggtctgcctggctggagggtgacatgcccttccctgggggcttcaggggccatgaccctgccccaggggactgaggggacagggctccaccccgagaggtctgaggggacatgtccaagtcctgggtgactgtgggggacacagctgtgccctgggagccctggtgagtgggtcctgccccctgagccctgcagccccagcccagccctgcctcctccgtcctcccacccccaggacctgaagaagtacggggctaccactgtggtgcgtgtgtgtgaagtgacctatgacaaaacgccgctggagaaggatggcatcaccgttgtggtgaggcgcgcgccacggggaccctagtcactgctgccaccgggggagggtggggcggggggctccgggcctgcgcagagggtttggtgcccctcctgtggcagccctgggcatgtctgtgcctgggccacgtgtgtgtctgggtacatcaagggaaggccagggtgttgggccgtgtgacctcaagaaagtcacccttgcgcacccgtctttctgtctctagggtgggccagcacggttcgccaggcaggggtggcacatgcttggtgcatcggccaaggtggcgggtgggctcctctgcctgtctcaggccctcctctgggcctgtcttgggtgcatctcagtcttgctgcctgggcggctggggccctgttgccaggcagcaggctcctggggagggcccttgggcagtttcctcggcttctttggccctggggacccaggtctgggcggggggtggggcggttctgctgcgatatccttgggggggtgggccacagcagctgcaggcccagagccagccccaggggggtccacccccggcccggtggacgactgcccccctggtgcaggcctgcccagctgcgcctgggcctcagtctcctcagtgcggagcacccctcagtcactgcttttcatcccaggactctgcttttggctggggttgcagttttgtgacctcagcttggcggtttggaatggtggcagcgctggcggtttggggtcagacaggccttgggctgcgtcccgcctctgccctccccagccttgcgaccctgcaggtcactccgagccttgggttcctcacctcaaagcgaggctgcttggaagaatgggaggcaaaggcatgtccccgcttctcgcacggggtgcgcccacaccctccctccccttccacagcagcgggagggattggggtcagacgtaagtagccgtgacaccggttgtctctaggagttgccctgcctggaggctggggaggggtgagatgcccccgagggctgtgtgtctgcctcagtgggcccagcgggctctccctggtaccagacagccccatgcctggcacagtccctgcatgaacccgccttcccaagactgaaacgtgtccactcctactgcagcgccctggcccgggccctcccctaggaagactcacgttgcccaccgatctagggcgctgggggacgggacagtgggaagcacaggtcatcttccaagaccaaattaacccccaggagcaatgggccggggcccggtggaaccgcctgtttcgagtcctgccctcagaaatgtgggccctgtctcgccccacagccctgtcttcagtccttcctggcacctgggctgtgtgtggcatgtgccagccatctttgcatgccagcacaggggatgagaccctttgcaccagccgacccaaaacctctcaggctgccaccggcacacaggcgtgagggattgtgaccccagaaccagagctcgggctgacaggtgtggggattaggatttgtgcgactctggagcaggctctattcagaaaggggtggggtggtccaggaaggcttcctggaggaggggatagctgcagtgtacagggaatgatgaggagtctgaagcactcaccatggggtgcccataggcaagctgtgcccctcctgtgtgccctctgggtctgctgcccccaccctagtgggctcctggcaccctctgcctctcagagctccctttcctcgcctgagccccagagccgcctctctaccctccctcagccgggggtcctcatgtctgcttccctccgtaggactggccgtttgacgatggggcgcccccgcccggcaaggtagtggaagactggctgagcctggtgaaggccaagttctgtgaggcccccggcagctgcgtggctgtgcactgcgtggcgggcctgggccggtgagtgtcggggcggggtagggctcgccatgtcaggtggttgggcatctcgtggtctgacagcctcgcttttggatgtgggtcttgaacacacgtccacgcgaccttcccaggaggcccatgcccctagtgctggggctcccagactggtcctctcccagcatcacagagaggaagtgcttcccaaagtctaacccaacttcttcctgctatggttgaaaccatcctgacatcttgtgtaggaaagggctgccgtccccctctccagacacaaagatccccccacacacagctggggcctcagactccctgctgggagaacgggaggaagaatggcagctgggatcggatgacatgaccagtgggacacccccatctgcagagggagacccaggcgagcagagttgatagcaggcatggatccggctcttagcacttcacccgccagctcttatttaaccctcccccagcagatcacagagaggttgcctaggagggagccaggatttagacccagtgctcaggctgggctgtgaggctgtggcctccatgggggagcttcaggcaggggggattctgggccccttgggcccccgtgccctgcatcttcagcaggtgccctgccaaggggacaggggtgcgcaggctccgatgacccccgccctgctgtttgcccccagggctccagtccttgtggcgctggcccttattgagagcgggatgaagtacgaggacgccatccagttcatccgccagtgagtggccgcggtggtggggtgggctgtgagcgctgggggaggggagatccggctgcccacgaagggtggcggcattggctgtgtggttccgtcgctctgaggctgcgtcgatcagcacaagctgggccttgctgcagaaacggggaagcctgaggtgtttctgatgggtggggacagcagcccccgagtgaccatgcagccacacagggacacagcgaggccacccgccacgccgtcctgcccgccctccacagacagagctccttctgtcgcagccatcctgacgggggtggaaggacccccagagccagccagttcagtccctccatgaaaaactagaacctgaaaccccacaccacaccgtgtccacccccagggacgctgacagtgggctagtgtctcaggactactctgagtctagctgctcaccacccctccccccaaccccgagctctccagctcagcccctccccgccctccttagaggcttctaggccagctcgcctgccccatccctgtcacttggtggcctccctggggagggctgccatctgcccactgcccagggggtcctgggggagtctggccgggatggcagggccaactctggaggaacggatgcggcacctgaagcctgcccctgcccagcccaccatgtgtgtgcccgtgagtgtgacacacctgtggtactcctcggacaggcttggctggtggggccatctcttcctcccagaggcaggcttgttcccagccatgccagctggccctgtgggtctgtgtgagagtgtggcccgccctgtgggtctgcgagagcgtggcccgccctgtgggtctgtgcgagagcgtggcctgcaggtgctcaggtctccctggggaccatgggatgtgcacgctcacacacagacacgcatgggggtcatacaggcacacattcacaagcacatgtgtgcccacacagacccaggcatacgcaggcacacactcacaggcaggtgtgtgaacacaggcacatacagacaagcgggtatttgcacacatggacacacatggatgcactcaggcatgtacacacgtgtgcactcatacatgacatgcactctcacacatgcgggtgcacaccttccccgggttctctccccaccccacgtctcaccgagcaagggcttgtctctcccttgtggcttttgctgtgtggctccccgcacctgaggctgcgctggtcaggacaggttgggccatgctgcggaaacagccaggcctgaaccccaacgactcagaacagcacgggcgtttcttgcccctgttgcgtgtctgttggtgggggccctacccggaggcgtggctgagggctgcgccttccccagtgtgccggctgctgggcgaggaaacgagcacggtggagccacacggggcacctgcagctttgctgggcagagactcctcgcgctactgctgctcccacttccttggccagggccagcctgtggccacgcctgaggtcatggcaggtggggatggatgagcctccagaggcgctgggtgggcagcccccgcccctcaacgcctgtcacctcagggcctctcaggtgtggctgcagcatcctctccaggaagtcttcctgttcaccccagccaggtacatgtggtcaaggaccaggtggcggggcagggtgagcacatagcccaggtccctgctgtaaggaccaggtggcgggagcagggtgagtgtacagcccaggtttctgctgtaaggacccggtggcggggacagggtaagcgcacagcccacgtccccgctgtaaggaccaggtggcggggacagggtgagcacacagtccagtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggaccaggtggcggggacagggtgagcgcacagtccgggtccccgctgtaaggacctggtggcggggacagggtgagcgcacagcccacgtccccgctgtaaggaccaggtggcggggacagggtgagcgcacagtctgggtccccgctgtaaggaccaggtggcggggacagggtgagcgcacagtccgggtccccgctgtaaggaccaggtggcggggacagggtgagcgtacagcccaggtttccgctgtaaggaccaggtggcggggacagggtgagcacacagtccgggtccccgctgtaaggaccaggtggcggggacagggtgagcgcatagcccaggtccccgctgtaaggaccaggtggtggggatggtggggacagggtgagcacacagtccgggtccccgctgtaaggacccggtggcggggacagggtgagcacacagtccaggtccccgctgtaaggacccggtggcggggacagggtaagcgcacagcccacgtccccgctgtaaggaccaggtggcggggacagggtgagcgcatagcccaggtccccgctgtaaggaccaggtggtggggatggtggggacagggtgagcatgcagcccaggtccctgttgtaagggaaggtcgcgcagctgggctggaattctgggctcagcccctcccttactcacaggccccccttcctggatggtggaggtgcccaggcaccacccttgttgtctgctcatggccttggggtgggtcctaccgagctagggaagcctgggggccgtagggagcccagagtcagcctggaggaggtggcgctttggtgagtttggaaggcaagcaggggtgagctgcagggggccaggaaagggtgactgtgactctgggagcagccgtgccaaggccctgggacaggaggggcttggccagcctcaaggccttactccagcccactgcactctcagattccagctccctggggcaggtgagatggccgagccaggtccttggatgatctctgttcctgttcccctcttcccaggaagcgccgcggagccatcaacagcaagcagctcacctacctggagaaataccggcccaaacagaggctgcggttcaaagacccacacacgcacaagacccggtgctgcgttatgtagctcaggaccttggctgggcctggtcgtcatgtaggtcaggaccttggctggacctggaggccctgcccagccctgctctgcccagcccagcaggggctccaggccttggctggccccacatcgccttttcctccccgacacctccgtgcacttgtgtccgaggagcgaggagcccctcgggccctgggtggcctctgggccctttctcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttgcgaccccttgtcctgacctgttctcggcaccttaaattattagaccccggggcagtcaggtgctccggacacccgaaggcaataaaacaggagccgtg

SEQ ID NO: 37304 - DNA, 36381 bp, Homo sapiens
ggcctggcccagttgcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctgtgagtcgggccttgggcggtgggccccgtcctgtctgtctgcctggggagcctgcccggcgggctgacgttgggccctctgagcctcctgccgtcagcctctgtctgtccgtctgatgtctgagcgcctctctcgctctctgtctggtagcccctctctccagaagctggctcagcctcactcaagtcctcatctcctcccttgaccttggaggggcccacctgggggtccgtctcacaggtgtacacctgattccatcttgcattcctcttctctgccctgagcagcctgcctcgtacccctctcagccggccaagtgtgggcacctggcctgcccgtcatacccgccctagcctcagacaggaaagtgctagctcaggtgccttccttccccatttcttctttgtcctccttcactctttctgcaattagggacccaagtcaggtttctaatccagttatctctgacctgaaacaagacctgttaggagcgagtgtcccccccgccccccccgcaagcaggctgggaggtctcctgtgtgtccagagcctttaggagcagcagggcttgtgtgcaaaggagctcccgtgggctgccccttgctgggacagttgccatgctgtgccagaaacaggaaacacccagggcttcaaaacccctatcgatttgcaatgatggtgtgtgcagcctctgcccaattagtggaaagctcaaaagtggtttgtagaatggttctgaatgcgctatggagtgcatctcgaacgtcactgggcacaggaatcatttggggatcttggtaagatgtgtgccctccttccatagctctgggacaggtcctgagattctgcatttctaagaagttctcctgtggtgggtgctgcccatcagatactgtttgtctactcatcacattgtgagtagcaaggggtcaagtggagtggagactcaaaggaccccttcttgtgaggttttttgtaagtcacacaacatcctttcgtttgtgttggtgtgcacaggtattttctttttcttttctttttttttttttttttgagatggaattttgctcttgttgcccaggctggagtgcaatggtgcgatcttggctcaccgcaacctctgcctcccaggttcaagcgattctcctgcctcagtctcccgagtagctgggattacaggcatgtgccaccatgcccagctaattttgtaattttttttagtagaaacggggtttctccatgttggtcaggctggtctcgaactcccgacctccggtgatgccttggcctcccaaagtgctgggattacaggcatgagccgccgtgcgcaggtattttctagctaactgatccacacttttaactgaagtgtaactgggttttcagattgtccatacactttactaacattccccgcacttatgcacactataaaaatgacacatgatgggctgggcgcgtaggctctagcctgtcatcccagcactttgggaggccgaaacaggtggattgcctgaggtcaggagttcaagaccaacctgatcaacatggtgaaaccccgtctctaccaaaaattagctgggtgtggtggcaggcgcctgtaatcccagctactcgggaggctgaggaaggagaattgcttgaacccaggaggcagaggttgcagtgagccgagatcgcatcattgcactccagcctgcgcgacaagagcgtgactttgtcttaaaaaaaaaaaaaaaagacgcatgatgctcagagctgacctgaacaaatacaaccctgctacttgggtttggaatgcatttctccattcttaaaaactcttctccgccccgcatcctgcaatctagattccttttcttactggcaggctgtctggctttggtcccacagtatggactggtggaggtaattcatgtaaaggagtggtatgatcacatttatttttgaatattaagcagacatgttaaggaaggtgatgactccattactgttgcctctggcccctcttaataatacattcctaaggattcttattttagaaacatacccaggtgaaatcttaagctttaatttacagctagtataggtggctcacagctttaactgcctttgaggaccagggatatattttaaaaagagggcttgtcgactgggtgtggtggctcacacctgtaatcccagcactttgggaggctgagacgggtagatcactcaaagtccaggtgtttgagaccagcctggccaacatggtgaaaccctgtctctactaaaaacacaaaaattagccaggcatggtggcaggcgcctgtaatcccagctacttgggaggctgaggcaggagaattgcttgaacccgggaggcggaggttgcagtgagcccagatcgtgccactctactccagcctggcgaccgagtaagactctgtctcaaaaaaagaaaaaaaagggcttgtcatgtctgatattgtttaaaaaatgtgtcagtacctttcacacccctagagagactgagaaatgtaagatgtgttttgaggtgtcccactgtctaagtaaccttagacagtgggaccttggatagtgagattttgatggtggggcctggatgaagcatgttaattttggctacgtaaggtatgcgttttatttatttatttattttgagatagagtcgcactctgttgcccaggctggagtgcagtggtgtgataatggctcactgcagcctcaacctcccaggctgaattggtgctcccacctcagcctcccctgtagctgggactacaggcatgtgccaccatgccggataatttttgtgtttttgtagagatggggttttgttatgttgcccaggctggtctcaaattcctgggctcaagcgatctgcccaccttggcctcccaaaatgctgggattacaggtatgagccactgtgcctggccaatatgtgtacttttatactagatagttgtgaataccaggttttaaagaaatactatgttgcactcattgacaaaaatttaaaccattcaaaagaattcaagggaagagtgaaacccaccccatatatatcccatggggtatccactgcaaataatttactgcttatttttccggatactcttttacagtcatataagtttacacatgaacacatatttacatatgcctataatagcagacaaaatgggatcacaatacacatttctgtagtttgctttgttatttaacattattcaagaaacatccattaatatcgggacatctacatctacctccttttaactgctgtgtgctgctcccctgcacacatcatgaggtattgaagtttttctctattttggggcactttggtttttactagcctttgggtattacagtgctgtacccttggaactggtgtgcatgcctggttgttggggtagctgacaggactagatgctggacactgaggtgatcttgtgggaagttcagcgtttggccattttcagtatcacatgtcatcaggcaggtagcatgattctcaagccaggcccccaacctacattcattccaggcattgaaatccagaaagaaaaaccagcattcctgcaaagatcttgttagtgctgaagaccggacctagaagagcatgtacccagagggacggggtgattgcagatttgcaggaacctcactggagccagtttagggagctcacccaggatcattatggaaacatcaggagtttaagcacagagcctggtgtaacctaaagttgctattgtagtcactttcattgctcctgttaaaatgttcatggaatcattgagttttagactgaaagagactcaacagtcagctagtctatcacctcctcatacagaagaggaccctgagaccgaggaagatgagatgacttggcctgtggccgggatctcaggaaccccggattggaggtcttttggccacactacacatctcttcctttattttttagaaatcaattagaattcaccaaactctaaatctcatctattagttaactggttttttttttttttttttttttttgagacagggcctcactctcactcaggctggtgtgcagtggtgcaatctcagcttactgcaacctctgcctcccgggttcaagtgattctcctgcctcaatttcccgagtagctgagattacaggcgtacactaccatacctggctaatttttgtatttttagtagagatgggattttgccaagttgaccagggtcgaactggcctcaagtgatccacctgcctcggcctcccaaagtgctgggattagaagtgtgagccactgcgcccggcctaatttttgtatttttagtagagacagggtttagccatgttggccaggcgacatttttgatgtgaattcaggcttagataccaaggagtcattgctttgggcaaatgtgccctgggagacttccctctgggcttctggctccctccatccactcttgggagagaaactgtgcagatcagaacagtctgcaacttgaagtcaagctgatgaagttgtggttcaaatgtcaaattcgagtgttgtccactttgcattcctttgggagaaagtggtgctccagtggcttcaggttttttgttttgtggagttgacttccctttgtatccatttccaaatcactgactgaagaattcactgatttcattcaattaacaaaatattactgaacatccaccatgtacaaagttccagaagacgagaacaacacagagtttactctgtaggaaaaaatatttgtatcgttctaacacgcaatagaggttttgaaagatgctttctttttctttcttttttttttttttgaggcagagtctcgctctgttgcccttgctggagtgcagtggggcgatctcagctcactgcaacctccgcctcccgggttcatgccattctcctgcctcagcctcccatagctgggattacaggcgcccaccaccaagcccagctaatttttttgtattttcagtagagacggggtttctccatgttggtcaggctggtctcaaactcctgacctcaggtgatctgcccgccccggcctcccaaagtcctgggattacaggcgtgagccactgcgcccggtctgaaagatgctttcgcggtggctcacgcctgtaatcctagcgctttgggaggccgagtcgggcggatcacgaggtcaggagatcgagaccatcctggccaacacggtgaaaccccgtctctaccaaaaaatacaaaaaaattagccgggcgtggtggcgggcgcctgtaatcccagctacttgggaggctgaggcaggagaatgttgtgaatctgggaggcggagcttgcagtgagccgagatcgcgccactgcactccagcctgggcgacatagggagactccgtctcaaaaaaaaaagaaagatgctttcatagaggtgccaaaaatacgattcatggtgaaggactgtggagcgccaagaatgggcacgtgcaggggaagcaaaaggcccggcggctggaccgcagttcaggctggaggtcacagggggaggagtcctgaggtgggaaagtgtttctggaaaagttgcccactcaatttgaccaaagcatggagtactcatggtagggcgttcgtggatgtgaaattgtgggtacattggggaagcatcaaatggcaagggtgaacactttacacttttgggggtatagaaaaggagagatcaaggattttgaaagttttttgagtggggcagttgcgtgactggagacaaatctggagaaggtgtggctggaagtatatcggaagagcgaaagataggatatgggaaaaccagtggcaagggggagccgtcagttgagtagccagcagagctgcagccttggaggggagaggaaggatttggaagaagtctgagcatggattagatgagaagggctgtgagggagtttctgaaatcgctggtcctagcaattgaatgcagagcccatgccaccacaaaacaaaacaacacaaaaacaaaaacaaggaggagctggtttttagtctggggaaggagggaagatgatcccaacattttggaaacgctgaacttgagatgttagagggtgatctgttgggagatgctgtccagctgcaggctgttttgcctgtctgttttggcacgcttgccctgaggcagagaaaagaggaggagatctggaccagtttagcagacaggaatgtgcagggattcagagcacgttttggagagagatggagccaagcttagattcctggccctgccattcaacgtctgtgaggattgggctgttgatgtgacatcactgaacctgtttctccaattgttaagatggagacagcctcagagactcgtaggaggatcaattaagtttactaattgggtaccaatgttattaatatcattgttttcctgaaggctatatttctttatttttcagacagagtctagctctgtcacccaggctggagggctgtggtgtggtgtgatctcggttcactgcaacctccacctccaaggttcaggtgattttcctgcctcagccttccaggtagctgggattataggttcctgccaccacactcaactaatttttgtatttttagtagagacggggtttcactatgttggccagtctggtcttgaactcctcacttcgtcatccacccgcctcagcctcccaaagtgctgggcttacaagtgtgagccaccgtgcctggtctattttattttcatttttttgtaaacttttatttgcatgttttgttcttcatttcttagcagtagcctgtatgctatcagcagggagagagtccaggctagcatgttacatattagaacaatgttgcacccaagagtggctgcaggaaatgtcctcccatcagactcatattatgtccagaagagttacttttatatatggggtcctctcagctgtttgacagaagaaataataaagagcttcagatttcgttttagaatgacacgtcagctaatacacgtttaggcttatcttccaatttgcagtttttggcattaagcttttagaaactttaccagatttattttatgtttcttgaattctcttctccacatgaccaaggagtgaaattgcaagtttgtttgcataaaagaagcgcagacagccacgttccatcctgtttaccagtttaggccccggtgaatgcaagcagaggcaggtatttgtgacctttgaaagcagctctcactagcacctcttcaatgtatttctgaacctttggatgttcctggctgggcaaatggttgattaccatggaatcaagcagtaacaagccagtcttacctttgactttagtgataaggattaagtaataatctccctcccttttggttgagctgcgtgttccgagcccgagtctggttcttctgtgtgctgtgtgaagtgttgctgctgcaatcgtgttactcagtcacagtgacttcgggaggagatggtcctaagtcagcagatccaggcagccctggagggctctagttctgtcagcccctggctccaatccttgtgtccttcagtgttttagagatgctgtggaaggcagcctcccccaatcatcacaaatctgcatgttcagtgtcacaaagtccatggctgtgaaatggttcattctgttttagaaaccatttgtaaacttggaaaacaatgctaaaatttaattaaaatatccaaggatttcaaaatactggccacattaatctatgcttctaaggtgttctccatcatatgaattaaaatgacttagagctctttaaatttttcagtgggatttacagtaaaagtaaagaagagatattataggcagtttctccagttgagttctgctccccaaactccaggaagagctccttcgtatctctggggctggaaagggaaaggacacagagacttcaaccctgcctggtgcttttccactttacttgggctgcagggccaactaatttgaataaaattgaagtgaaatgtcaagaacatctcaaataaataatattcccagtgagattttatcaaatgtaaacttggagcacttttttcttcttttgccagttccttattggctgtcctccaagaagttgcctgcaaaactggtttagagatacctccccttcccccaatccccagatcaacccacacttacttagtggatgcctgcggggctctattgtcatgtggctgccttggtggggagtactatgaaccaggtgcaccgcgcgcattatccatgatccccacaaacatggccagaaacagccactcaggggctttgcacaacttgatgtcacatcatcagtaagaagcaaaggcagaatttgaactgaggtctttctggtgctgagttcttgcttctccgcatggttgtgttatgccaagggagctagaggtggaaacggtaatatttcttgcacacttgcctatgcaccaggcacttttctgaccactttacctgtatcaactcagttatgccccctctctgtagactatgaagcagacacactacattcccatattgcagatgaaccagaggtcacagatgctaagtgactttccccggctgctgagcatggagcagagctgggattggaaccctggtggtgtagagtgccagcctggggccttgaccattacactctagtttcctgaggaaccgggtgaaaggccattgcatttgtctaacgctaagtttgcacagcaaacacacttttaccaagaagctatgctaatctggagggtttttttcaggagttgggagtgttggatggtagaggttatgcaggcaggcattaccaataccactgggtctaatggagtttatgatcttaggaattcttggatccttttattactctctaaatttattcatccatttacattgagaacttactatgtgcaggcattgttctaggtgctaaggatacatggtgaacaaaatattcttttttccaggatcaagactgataggtctttcttcctccagaggcacattcagatgtgccatgtttatgtaagagtttcggtccccttggagtatacactcggcatttacctggtgccctgtacttttgcttcagacctcactagaaaaacctctggctgcctgtaaggttctaatttcgaatgtcccaggtagagggctgtgccatcctcaggatggcccaacaggtgaggtgagctcagaggccctccactcttggcattcttgtacaaagcaggttgggcccaggcctcttaagatcgaggttttaggtagcatttccaggggtggcagccctgtctgtgccctccctcccagtggctcttagaagagagtgggccattcctaaggccatgaagacaatgccccataaaggtcatgcttccatgcctgagggctctcccggtcctctcttggtgggggttgagagactagaccctcccccctacctccccaggagtgggggttatgtgatgtcaccaatgctggtgtctcactcttgcacacattttccaggctcctggcaccatggaagatctcctggaggctggtgccttcagcttcaggctctgatccttccttgttgctttaattatccgtcttaccacccaaatcaattaacaggcttcctagttaacaggcttccattttctaggccaaggcttgagaggtgaattagttcttccaagcagctgtggttttatttccagaagcgcccccatatcaacagctgtgcctattcaatggccatggatctgtgaagggcacgagcaggactcatgctaatcagctctgctttttctatattaaaaaaaacctttggccaggtgtggtggctcacgcctgtaatcccagcactttgggaggccaagatgggcggatcgtggggtcaggagttcgacaccagcctggtcaacatggtgagaccctgtctctactaaaaatacaaaaattagccaggtgtggtggcaggtgcctgtaatcccagctactcgggaggctgagacaggagaatcgcttgaacccgggagggggaggttgcagtaagccaagatctcgccattgcactccagcctgggtgacggagcgagactctgtctcaaaacaaacaaaaaacaacaacaaaaagcctttaattgaaattacccaatagattgcatgtaatatatacttgttttataaacttgatacaacatagaacgagattttaaagtatttaaatatagtgtgaatcatgattagtgtttcctcatcattgttctctttgctattctcaagaaaatctcagcttcaacttggatatatggaaaccaaatatccgggtctctggaacagtgcaatttaaaagcatgtcctagaattttcagccgtggtttgaaagccacctattgattcacacatgcctggaagtagctgacatttgtgcaacactgtgccctgattcggctggggctctggggttctatgcagcccgtttggcctccttgctgtgaggtgcggggcatttaaattctgttgccaacagtagcggccagtggtgctctggcctcagcaggtgccctgttctcttgtttgctgcctgctacttctcaaggaaggcctcaagccactttgctccttatgctctgacatttctcctcttaggcccaatacagaaaaggtggagaaaacctcacaatgttgcctttcccctctatgataaattttttttttttttttgagacagagtctctgtggcccgttctagagtgcagtggtgtgaccttggctcactgcaacctttgcctcctgggttcaagcaattcttgtgcctcggccttccaagtagctgggattgtaggcatgtgccaccacacctggctaatttttgtatttttagtagaggtgggctttgaccatgttggcaggctggtctcgaactcctgtcctcaagtgatccacatgccttggcctcccaaaatgttgggatcacaggcatgagccactgtgtctggccacctctgtgataacttttattcagaaaacatttccttggcagatcaagtcactggctcaatcaaaattgcccttcctgcccctgcatgatcagcccccaactgctactgttgactccttttctggcagtggggctgaggggcagagcaggggagggaggtaggggaagggagctaggcctggaggtttacatctggctcagttcagcccatgtcttggccatttcacctgttcctctcctttaattgtaaggcacagttggcctggggagggcttttttggacagggtcgtgtgatggtttcccatatccctccagcctcatttgctgccttttcccatccctagagaatggcaaattgggagctgatctagaagggagctgggtggtgtgtgcaaggctccagtcgagtcccacggagggtagttggtgtcatcacctctggttcacagctgcctcctggaaacgccttccaaggcaggatggtcttctggatccactgggctctcctggagtcttcctagaacttcagacgggggatggcagccgctgcattcgctagggctcagggctgtctcaccaggagctgagacccacacctgctattgactctaggctgctgagcccgccctctctaggtggtgattggaatatagagtgaatgctcttgttaatctatccttcagggccattcaggaatgatgactgatcagcaggcagacatttataatttcttttctttttctttctgaggtggaatttcactcttttttgcccaggctggagtgcagtggtgtgatctcggctcactgcaacctccgcctcccgggttcaggtgactctcctatctcagcctccctactagctgggattacaggcgcccgccaccacgcccggctaatttttttttttttttttgagatggagtttcactcttgttgcccaggctggagtgcaattgcgtgatctcagcttactgcaacctctgcctcccgggttcaagcgattctcctgcctcagcctcctgagtagctgggattacaggcacatgccaccatacccagctaagtttgtatttttagtagagacagggtttctccatgttggtcaggctggtcttgaactcccagcctcaggtgatccacctgcctcagcctcccaaagtgttgggattacaggtgtgagccactgcgactggccaatttttgtatttttagtagagatgggatttcaccatgttggccaggctggtctcgaaatcctgaacctcaggtaatccgcctgccttagcttcccaaagtgctgagattacaggtgtgagccactgtgcctggccagacatttagtatttctaagggggcttctgaaaacttatggagaaaataaactgcatgtgatcttcagctaattaagtccttgagcttgtttctgaggaatttttcctctctcagaatcacggaagccttgcctgcttgccacttttcattgacctgtgtaaatgtgttactcggggaaatctcaagcccttcttagggtccccgaggtgtgacgggggaggcttgatggagcctgcgtctggtcctgactgctcatcatggctgtgcagccctgacaggactaagccagggtggtgggaccagcacggtgtggccagcttaactcactgcggctcagaggagacctggagacatgagggacacctggacattgttgctatcaacatggcagcatagttggctggcagccgggggaatttattctcttgacccactgtttctaccttaggatccttttcctgtgcttttctggaagcttttcctaacgccaggattaaccaggagaagccttccctcaagatatcttagcaaagttataaagtacgtgaacattgagttggagcagcccagagtaatctatcttcatgtgttctcttacacttcaaagacaactggaggatagctggagaagggtccttcctgctagaagaggggaaggacgcttactgggggtaaagagaagaggcgttcccaagaaaggggcaggaaccagcttaacgcatctgtcaccacccagcggggtcatggaaacgcgaagcaggtggagcccatttcctgccgtggtttggtggacgcaggcagccccatccatgcaggtgctaaaggccctgtgtggcttggtggatgcaggcagccctgtccatggaggtgctgagggtcctgcgtgatttggtggatgcgggcggccctgtccttgcaggtggtgagggtcctgcgtggtttggtggacgcgggcagctccgtcattctttctttttgacggagtctcgctctgtcgcccaggctggagcgcaggggcgccatctgggctcactgcaagctccacttcccgggttcacgcctttctcctgcctcagcctcccgagtagctgggaccacaggcgcctgccaccgtccccggctaattttttgtatttttagtagagacggggtttcactgtgttagccaggatggtctcgatctcctgacctcgtgatccgctcgcctcggcctcccaaagtgctgggattacaggcgtgagccactgtgcccggccccagccctgtcagttctgtggcgagggcctgcatggcttggtggatgcgggcagccccgtcagttctgtggtgagagccccgcatggcttggtggatgcgggccgccctgtccatgcaggtgctgaggaccctgtgccatgcgtccttgcagagtgctgtgtggccccacaagcctaccatcgtgaacggtgtaccaccccttctgtggccctcagcttctctgtgttggttcctctgtgtgccaagggtaggagccatctgagactcttggaatggcagtggggagggctggctggtggtcatgatttgctaagtcacccaccctgacactgactgtaacctctcgtaggtctgggcatgatctggggcaacagaagttgcttctcactttaatctggccaactgctgagtctgcaagctcggaaaatgcagtccactgcatgaggaaatagcctactttcatttaatcccacaaaacaagtcacggtgcccctgtgtttgggacacagttacaggataacttgtctgtctctgggtggtggggctggcccaggagtactgcaaatcagagccatccttacaaggactttctccctccggtctcctctctctgaatttagatgcttcctggatccaggcatcacaggaaaaagacctcaggctttacaaaattacttgtataaatgtgcacatagtacccactcccttccatttggaaatatgtgaaaaatgtacttactgtttcctttggctaaattgctaacaaacagctcttctctggagtcattactagctgacttatttgggcttctttagggctttttcatttcctcccattctttcttttttttatttttttgagacagcgtttcgctcttgttgcccaggctggagtgcaatggtgcgatctcggctcactgcaacctccgcctcctgggttcaagggattctcctgcctcagcttcccaagtagctgggattacagacatgtgccaccacgcccagctaatttttatgtatttagtagagataggacttcaccatattggtcaggctggtctcaattttctgacctcaggggatccacccgccttggcctcccaaagtgctgggattacaggcgtgagccaccgtgcctggcccatttcctcctgttcttttttttttttttttttgagatggagtctcgctttgtcgcccaggctggagtgcagtgacgcaatctcggctcactgcaagctccgcctcccgggttcacgccattcttctgcctcagcctcctgagtagctgggactacaggtgcccgccaccatgcccggctaattttttgtgtttttagtagagagagggcttcaccatgttgatcaggctggtctcgatctcctgacctcaggtggatccacccacctcggcctcccaaagtgctgggattacaggcatgagccaccgtgcccggcctatttcctcccattcttacgaaaaacattcaaagtaccattcagcttgaatgcccccctagagatcttcctgaccatctaaattaaccatctagcctctcatctccctctcctgtcaccttgtttttgttttatgtcagcgagcatctgtcactatctgacatatctttttcattccaaaacacttatttatttcttgtttgtgctcaccccagtagaatatacgctccacaagggcgggatctgatctaccgtgttcggcactgtaaccccagcatctagaacggttccccgtgcacagcaggtccctggtgaatatttgtagaataaatgagcactcagatagctgtctaggaagattttgagtaaaagagaccacatggcctgagtgttcctgagggaagtgcctgagcagatgggacttgggccaaaaggtaatataggactttccttctgcacctgcctcagtgcctcatccgtgtccagtgccttcggcccctctgcccagccctcccggccccccgagctgtccctgtcaggctgcacctattagtgctaggccttttgtgtatgtcatctcatgcaatcctctgacagccgcgtgggggcagacttcacttccctctttggacacatgtgaaagggagggaggctcagaaagagcaggggagcctgggagctgaggcctggacctggtctctgccttgaagcccttcttctggtccatcggtgctatttgccctccggaatcagaagtgagtttgacagtgggctgggcacggtggctcatgcctgtaatcccagcactttgggaggctgaggtgggtggatcacttgaggtcaggagttcgagaccagcctggccaacatggtgaaaccctgtctgtactaaaaatacaaaaattagctggatgtggtggcatacggctatagtcccagctactcaggagggtgaggcacgagaatcgcttgaacctgggaggcggaggttgcagtgagccgagatcacgcaactgcacaccagcctggacaacagagtgacactgtctccaaaaataaaaataaaaataaaaataaaaataatcataaagtgactttgacagtgcaactctcaggctggaaaggagagagcactgctgctagtggggtcactgagggagctgcatttgagctggtgggccctgccaagtccctctggcctcccagattttggctgccttcttcctgcacaagccccagcctcacaattggggtcagaaaaagatcatgtggaaataggatcgaaagcccagggacatggggtggagctcaaagctcgatagacatcttggtcttttactcatgaaataggagtgatgggtgaaaagagaagcagcaggaggagggctggtgggatgagatgtgctttgcaggctggaaagggaatgatgccaagagtggctgaaagacgctgacaggcgggcccgagaagacagccggagctagctcctgagatagtcaggccggaccaggcatgtgggtttggatggtttctaggaggggctcagttttgcccagccagtcacagcgagttatgttttgggcaaatgcacttgcaggagctgaagcagtcacggccactggatcagggaccgtcagttcccaggcgagcgcacatcgccatcatggccaagggcgcgggtgtgcccttaccacccactttcagaggcttgctggtgtcttcaaagacccatcttttccccttcccacatcaaggctctcgccttgctctgtgcatccttcctgtgagacgtctccctcctttctgtgttcagggcaaccccaggctatgacaacctgccgcttctgtaagtctaagaagctaggctgcgtttagacaagccactggattctgggaattctataattactgacttgcaggttgcttaaaaatagtgaaaactccaggatccctgcaacttccatgccctaggactcctgccaggggcccagggtgtcaccaagagagccctggcctgggagtcataggcagggtctcgcctccaccctctgcctgggagtcataggcagcgtctcacttctaccctctgcctgtgtggagaagtccacaggagtcttgggtctgagttttctcctctatgaaatgaggcagaggggccggttgatgctttgtttcttttagggtctttttagttataaagccataaaccccttggcttggctcgcaactcaggctacccccgacccaggcttccttgcttgctgggtctctctattgattcgtttaacccgtgtgtttgggggccaacactggttctttctgggcaaaaccaaaaacacccgcaaactttttatgtaaaaagcactgagacacatactgcaataaacagatatctactatatctgtagtattaaaaatatttcatgggggagtatggttgaggaaaaaatgttctaaaaagctccctaggggaatcataatgaaaacaaagttaagaaacactgatttaaccacaaaagtgtgcagggcaccatgacaggttcgaggtgaagaggcagatgatagtatctcctcctctctagggtctgtccagaccttcctgccttgttctcccaagctgatgtcctccttcctttcttctaaaaatatatatatttttagacggaatcttgctctgtcgcccaggctggagtgcagtggtgcgatctcggctcactgcaagctccacctcccgggttcacgccattctcctgcctcagcatcctgaatagctgggactacaggcgcccgccaccacacccggctaattttttgtattttttttttttttttttttttttgagacggagtctcgctctgtcgcccaggctggcatgcagtggcacgatctcggctcactgcaagctccgcctcctgggttcacgccattctcctgcctcagcctcccaagtagctgggactacaggcacccaccaccacacccggctacttttttgtattttttaatagagacggggtttcaccatgttagccaggatggtctcgatcccctgacctcatgatccacccgcctcagcctcccaaagtgctgggattacaggcgtgagccaccacgcccggcccttttttaaaaaaattattattatactttaagttctgggatacacatgcagaatgcgtaggtttgttacataggtataaacatgccatggtggtttgctgcacccatcaatctgtcatctacattaggtatttctcctaatgctctccctcccctagtccccagctccctgagaggccccagtgtgtgatgttcccctccctgtgtctatgtgttctcattgttcaactcccatttatgagtgagaacatgtggtgtttggttttctgttcctgtattagtttgctgagaatgatggattccagcttcatccatgtccctgcaaaggacatgaactctttcttctaaatcttaccgaacactcacttttggtgggtttatggactcatctacatgttctggtggtcatggcttattttttgtggcttttgttccctgtagctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaagggtgggtctgtacttccaccattgagggttttaatgtagccggtcttcttcccagcttcataattgactccacttgttcagctgagctgggtttctgggagtccctctagatccctgctgtggtcttttcatagcttccacctcactgctgccatctctcgaatcctccctgagccactgtgcagatgagtgttgtggctcacgccgccttctccccagtggactcccacaaactcatctccatttctaactttttattgccatgtttaaggctcttcaaaccctggcttctgttggtcacctcttgtactacatccctatccaccaaattcctgaccttcacactgaccctcctgttgacctagactgcttgaaacttccatccctgatgcacgcattggagtccctattggtctgtctctgcttcttttttttttttttttttttttttttttgagacagtgttttgctcttgttgcccagtctggtgtacagtggtgtgatcttggctcactgcaacctccgcctcctgggttcaagcgattctcctgcctcagcctcctgagtagctgggattacaggttcccgccaccacacctggctaatttttgtatttttagtggagatgaggtttcaccatgttggccaggctggccttgaactcctgacctcaagtgacccgcccaccttggcctcccaaagtgctgggattacaggtgtgagccaccacacctggcgttatctctgctttttgagagcagaaaatgaatcttatttgtctctgtgtcccagtgtctagtgcaatgcctggcacattggagggcctcaacaacaaatgactgttgaaaaagattgttaaatgaaagagtattcccagcttttataaaacaacaattgtaattagaaaaaaaaacttctgagattagaagtgcagttatatgggcttactatctttcccagtttgagaggaactgggaacatgaaggagtagaattaggaaaaaacaatgagaagatgaagaggctgcctgtcctcaccctattaagagggcaggagccacatctgatgaagttgtttttcatcattcctaaaatagccgtacatgccagacttgaagttcatgtttttctcagctgggcctttcaaggtctttggcagctttaggcgtatggcttagatttgttgtttaatattctccatcactcacgccggacttctcttgtctatcatgggccttcatgataggcagcttcctgtgttccagtttccagttcctcctgcattagtgagggtggtctgtgaagagcaagagggcagggaatcatgttaatctgctacagacatttaaaaacgacattgtaaagtggctaatttggagatggaaaactcccagtgatgtgctggtaaactgggtctcaaagcaaacaaacaagtctctgatatgtccacttgcctctgtcaatggtgtgaatactctcccatcgttgattttaagctaccaatgtgatatcactgaaggcagagttgggaagagatgtgcaccgttagctcctgagagccgataccagccagctcctgcacaccactgaaaatcccactcaaaacaggaatctgcggtattcccactaccactgaaagttatctactttgggaattacgctagaaatttgttttgtttagttttgtttttagagacagggcctcattctgtcacccagactggagtgcacagtcatggctcactgcagcctcgaactcctggctcaagtgatacctcctgtctcagcctcctgagtagctgggactacagatgtgcagcatcatgcccagctaattgaatttttttttttttttttttttttttttttttttttacagaaggagtctctctatgctgcccaggctggtctcaaactcctgggctcaagcaatcctcctgtcttagcctcccaaagtgctaggattaggcatgagccaccgtgcccagccaggatatttttgaaaactctatgcaccccaacctcaaggggcatctgtaagacctccatgagaagtttcttatagatctcaaccctagcaaagtctctgcttcacctaaggaattatttttttccttacaaataaaggaaaatgagtgactaaccttctttttcctttggctgccaggaaactcaatgcaaaattatgatttgattatatcaacaatataggaaatcatgacttatctgtattccattaccttcatctgcacctcttaagtggtattttctctgtttaatggtcttgtgtgtatgtgtgtgtatctgtgcattctgtatgccatctcatgccttccatgacagtacaaataaataagacccacattttttgaactttcttctaaattcccattcttagcccctaatgtatactcctttagtgtatcttgctataacattttaaggttgtatttcttttttctgtgctcagggtaaatatgtggtctgttttgatccccttgatggatcttccaacatcgattgccttgtgtccgttggaaccatttttggcatctatagaaaggtaaaacgtgatatcttaagcacttggtttggggacagaagttaagattgagcatccagtcctatttcactgtggcagagcagccggagtggagatcatgaaactgtgagactgaagtagatttgtatctcaagttctgagcttttcagcactaattgcatgacgaagacccactagattgttgaaagagaatatagggtaaaatatgggtgggaagagaaggatatttcactctttttactatgtcttactttttatgatagaaaatgagatttaaaaaagaggcagtagagggtaagtatagtgatgatacgatgtgaactcagagttgagagtgtaagacaacaatagagactatgtcaaaactgtcctttaagtcccctagtcaatggtctataagctatgagccccgggctgagtccagcctgtggcctaatgtgtacagcctgtgaacaaagaataaccatttttacatttttaaatagttgaaaaaaactaaagaacaaagtttcgtgatccattttaagttttactcttcacgaatgaagctttaattggcatttggtcacattcattttttcacatactgcctttggctgattctctgctgcactgtcaaagttttgtagttatgatagagactgtatggcccataaaactgaaaaatttactatctgtctgtctgtagaaacagtttactgagctttgctctaagtcgtagaaagcacacagcataggatgagaatccagccctgctcgggtctcctaacacctgactcgggcagtcacccctcctccagagctgctttttctgagagagagagagagagagaaagagagagagagagaggagagagaggagagggaggaggaggaggagagggaggagagggagagggagaggtgctcaattatacgaataagtgaaaaatagaatgaaaacccatccacccatcaggaaacatgataaaatccaaggtacatcctcttagctttagctcttgttttgttttattttttcaaagtatatattttaggccggatgcggtggctcacgcctgtaatcccagcactttgggaggccgaggtgggtggatcacaaggtcaggagattgagactgccttggctaacactgtgaaaccccgtctctactaaaaatacaaaaaaacagccaggcatggtggtgggcgcctgtagtcccgggaggctgaggcaggagaatcgcttgaacctgggaggtggaggttgcagtgagccgagatcacaccactgcactccagcctgggcaacagaacaagactccgtctcaaaaaaaaaagtatatatatatatagttttaacagctttggggggtacaaatagtttttggtgacatgaatgaattgtatagtggtgaagtctgagattttagtttatacctcacgagaatagtatatattgtatccaatatgcagtttttttatccctcatcccctcccatcacccccttctaagtctccaaagtctaccataccattctatattcagctcttgtttatttcagaactgaaacctcacaggctggaatcgactgaagaggttggttcagctgaactctgttctaggacacaaaggcattaacttaagaactgagacccttggcctagcgagatggctcacgcctgtaatcccagcactttgggaggccgaggtgggcggatcatgaggtcaggagattgagaccatcctggctaacacggtgaaaccccgtctctactaaaaattacaaaaaattaactgggcatggtggcgggcgcctgtagtcccaggtactcaggaggctgaggcaggagaatggcatgaacctgggaggtggaggttgcagtgagccaagatcgcgctactggactccagtccgggtgacagagctagactccgtctcaaaaaaaaaaaaaaagaactgagacccaaatttgcactttatctctaaaagtgacttattgtctagtattatacataatttcctttcaaatatgtgaaaagtagagcccccatggcacagttatctttggtcattggaacgtattttgctttttatcttgggtaagaggcagatccacatcacaatcagtttgaggaatagaagattcaaattctcatactagaaaggcaaaaaggcaacaatttatccattttccaagtcatgccaaggaacataccatttctgttgtagacatggaagaatgcaattttccttgcaaaatatcaaatccacagaatagcaggagaggtttgtagcaaaattcttccttgcagaggaagacatctggctaatgtgttaaccacaactaaagcagtgttgatgtttactaagcccattctccatctcagtccccccaaataatactttttaaggaaaaaaaacctgggaaattgagagacattggctatcaactaaaaaaaaaaaatcaagccagcttgcaacagcagcttgaattatgaatgacagaattctcaacaataaggctcggctgtcttctcaatgaaccagaagtgacttttttaaaagacagaaagtggggcctggtgcggtggctcaccccggtaatcccagcactttgggaggcccaggcgggcggatcacgaggtcaggagattgcgaccatcctggctaacacggtgaaaccccatctccaccaaaaatacaaaaaatcagccgggtgtggtggcaggcccctgtagtcccagctacctgggaggctgaggcaggagaatggtgtgaacctgggaggcggagcttgcagtgagccgagatcgcaccactgcactccagcctgggtgacagagcaagactctgtctcaaaaaataaataaataaattaattaattaataaaaagaaagtgatgatgagtatgacacagacctctaagtcatttcagttttttgaagccttattgattgcttgaaacagctgaaaccagttgagggctcatgaggcataaacatagacatctataatgcttccaaggggatttttcctgctttctgcagagatgattgttggctagaatcgcaccatggtgcccacgcccagtggggcagcatcagtaactgtgaccctgccatggtgaccaggccttgctacacgattcctggaaaggcacgtggaaggatgtgtggtcatgttgcatgcagctcctgccacagcatctttccagggcctaccgactactactatttcttttttgagacagagtctctctctgtcgcccaggctggagtgcagtggcgccatctcagctccctgcgacctctgcctccctggttcaagcgattttcctgcctcagcctcctgagtagctgggactacaggcgcccaccaccacgcttggctaattttttgtatttttagtagagacggggtttcattgttttagccaggatggtctcgatctcctgacctcgtgatccgcccacctcggcctcccaaagtgctggaattacaggcgtgagccaccgcgcccggccacgactactactattctttctctttcttctccctgtccctcccccttctccctccctcctcctccccctgctcctcctcgtcccccccttcctcctctgccttcttcccctcctccttctccctcctcttcttcttccttttcttccttcttcctttttctttctttttttctttttttgagatggagtctcctgtgtcgcccaggctggagtgcagtagcacgatctcggctcactgcaagccctgcctcccgggttcacgccattctcctgcctcagcctcccgagtagctgggactacaggcgcccgccaccacgcttggctaattttttttgtatttttagtagagacggggtttcaccgtgtgttagccaggatggtggcaatctcctgacctcgtgatccgcccgcctcggcctcccaaagtgctaggattacaggcgtgagccactgcgtccggccttttttttttcttcttttttttcttttttttgagacaaggtctcactctgtcgcccaggctgagagcagtggcgccatcatggctcactgcagcctcaccctcccgggtttaagccatcctcctacctcagcctcctgagtggctgggactacaggtgcaccaccacacctggctaatttttgtattgtctgtagagacaagggggtctcgctatgtttcccaggctggtgttgaactcctgggctgaggcgatcctcccgcctcgacctcccaaagtgttgggattacgggcatgagccacggtgcctggccccaccagtgtctggctggagacatcctgacagggcgaattctcctgcaatgctgggtaaccatcatggtttgtccaaatattgagttgaaatctgtttcattttgctcacttggctgtttagagcataagaaaataagattctttgacatgtttggaaacagtgtttctgccctcccaataatgcccaccacacccactttttttccctttaagctgaacatctttcacaggagagggatctgagacttctctctagcctgatcaccctctactggacatactctaacttgcaatgtcctttacagctcccaccacaaaagcagagattcagaaaagtagggtttggtttctgctccgaggaaagaccactgtggacgtgacagtctctcctcccccaggccctccgtttctgtgcctacttctccttatgtgatgacatggaataatatgtgatgacatggagccagtgcctacagcaggtggtggcctcagataggcagagaaaggaagggtccagaggtttctgattttgccaagtgctccgtgctcattggtccctgggcatctgcaggagaatggaatatgtttcccttggaggaaaggcatgcattgctgagcatttggaggaaggaattagaaagggggctgatcccagctctttgggaggctgaggcaggcggatcacctgaggtccagagttcgagaccatcttggccaacatggtgaaaccccatctctactaaaaataaaaaaaaaaattagccaggcgtggtggtgggcgcctgtaatcccagctacttgggaggctgaggcaggagaatcacttgaacccaagaggtggaggttgtagtgagccaagattgtgccactgcactccagcctggcgatagagcaagactctgtctccaaaaaaaaaaaaaaaaaaaaaaaaattgggggctgggctagaaaagaattcctccaaatccatggctcagtgggataattttctcttcgttttgagtatgtgggtcatagacaagtattactattattttttattccgtgcgaggaagtgtataaatgtagagcatttggtgaccgtatgtcagggaagggctgtttacttttgcacctttgccacaggccggcacggatggttctgggcgaggtgaatctctgggaaaaggggcctttattggcagagaactggttacttgaagcctgcagtgggaggagaggagagttagagtcctgagtccacccactgtgtacctggcttcaagggaagctggtgattgttaaaatgagcctctgacaggcagcgcatgttgacaaaggccattaatttcatttttcaaggttgtgcattggcaaaacttggaattattccctcaaagttttgatcctgtaagtttagtctgtgtttagctccactgtactgtctggtgaatacaaaccaaactgaatcaaataacccagtgcaaccagctaactaaccacctccccaggtgaaaactaggaggggcagggaagcggtggaaagaaatgggtttgtggttttctggtttgtggttttctcatttatatgagtagttgttatgcttgaatgtgaagttcttacacttgagtgtgaaggtcaccccttcacattgcatagtgcaatgcagattctcaggccccgccatggaaagtctgacagtgtgtctaggctgtagccccagaatatgcatttcttttctttttcttaaagaggcaggttctcattctgtcacccaggcatgtgcagtggaatgataatggctcactgcagcctcgacctcccaggttcaagtgatcctccagcctcagcctccttagtagccacaggcacatgccaccatgcctggctaattaaaaaaaaattttttttcgtagagatggggtctcccagtgttgcacaaactggtctcaaactccttgcctcaaatgatcctcctaccttagcctcccaaagtgctgggattatagggatgagtcatgaccccggctgtgaatgtgcatttttaataaatatcccaggtgattctaatgcaggtgctctgtgggccacccttttgaaagttatgggaagaaattacctggaatgttttgctgggatgacttccttctccagctgcgtgatacagatgcccctgcttacgctcagctgcaggaatctaggaaaagaataagtgaagttcgagaaattgcatatttttatttctgcttaattcaagcagagagtagttaagctgaaagatttgtttggggctgtcttgatgaccaaagaggtcaatccagtgttaataaagaagatcaggctgggcgcagtggctcacgcctgtaatcccagcactttgggaggccgaggcaggtggatcacgaggtcaggaaatagagaccatcctggctaacacggtgaaaccccctctctactaaaaatacaaaaaattaactgggtgtggtggcaggcgcctgtactcccagctacttgggaggctgaggcaggagaatggtgtgaacccgcgaggcggagcttgcagtgagccgagatagcaccactgcactccagcctgggcgacagagcgagactccgtgtcaaaaaaaaaaaaaaagaagaaaatcattaatagtaagaaatcagtggttaggagctgtctccttaaggggctcccttccctagtgttagaaaaactctggaccacatgacccagtgggctgtgtttttaatgaaaaaatggattacggcacatgccacgttctaagtgtaggtattattttggtaactttttggtgtgtgtgtgggggcactggtttgtgatgtaaaatgtgcttcttcccatgcatcacggttaaaacactggacagcatctgctctaccccataatgactctggggagatattctgagttcctacgtttctgagaatttccctgacgtgtgagtgatatagaccacatgctcagcagagtatgggctgcagcggcaagagctcacaaaactgatttcctccgcagactggctgccctgcagcccagtgttaatttatttaaataaagatggagtaggcaggtgacagagatggatgcccgtaataagattaaattagtgggaactggcaagaaggcatgctcttttttggaactgatagtggagagatgagggaatatcacattagaaaaattggaggagggccctaattggaaagaggaatccagatgcaggaaatctgggttctggtgggaaggctgccgtgataatctaatcaggatattgctgatgtgtaggggaaggcccctctgggaagatgccctatttcattagaagagcaccttgagaatgcctcctgttaatggttgaactgtaaaaaagaatcacaaaacaaaacaaaaacattctttgatttctttcttgctctagaaatcaactgatgagccttctgagaaggatgctctgcaaccaggccggaacctggtggcagccggctacgcactgtatggcagtgccaccatgctggtccttgccatggactgtggggtcaactgcttcatgctggacccggtgagagacctcacaggaggctgggggcttggctggtgtctgtgagcaaatgaatgatatgtgtgggggattggcaggggtatgtggaggtgggaggtgatgcccatggagggacagagatgatgatgtgtggtggaaagggggcaggagaccaagagagagtgtatgcctcccgagcagactatggaggtgagaaatgccatctcagactggcacaagagggggtctttgttccaatgtgaattcctcagagcagctgttactcaaatgacccaaatgccaggtccaggcaggccatagggatgatgaagtgtgctggggaaggaaggccggggggcaagggtggaactggggtgaactgaagagttccagcaattacaattgggaggagggggcccgccttgccaaggcttctattaatggttcaagaaacactggattgtaaaaaacataatgtttctgcatgtgtgcaacactatgttggccaactaaaatgcatttatggacctgatggggctgtagatattctgtttgccataaactgtatccatccatttctagcttttctactttagtcaccaaaaggctgttttcctgagacgaatgggtgtgccaactgaagcagtggacgacattgcttcttcaaaaatagctcccacatttattcgtgtacatttacacaaaccttcagttaactggtgcagtctttctttcttttttttttttttttctgagatgtagtcttgccctgtctcccaggctggagtgcagtggcgtgatctcggctcactgcaagttctgcctcctgggttcgagcgattctcctgcctcagctcctgagtagctgggactacaggcgcctgccaccacacttgtatttttagtagagacggggtttcgccatgttggtcaggctggtcgcgaactcctaacctcaggtgatctgcccgcctcagcctcccaaagtgctgggattacaggcatgagccaccatgcctggccaacttttttaacttttagagatgtcctcctatgacattagtgaactatgtgtaaagtgctttttgctggcaaactgaaccccaggaacagacaaggaacaggaaccttctgtgcgagataggctgctggaggtgaggccgggtctgtgtgtggcaggaaggctaactcaacacaggctgcctttgtcccaggctgtcagggaagtggactttcacctccttggaagcatgggcacttaacaaataaacaagggtagggtaatagcactagttaaagtcgccaaatgtggtgacctgggtaggggtggggtgggggagttagtggcagaaccagagcaaagttccacctgagcccaggatggaatttcgggcaccactgatgtttgctgactgtgatttgccgggccctgactgcttcccattcttctggtgccttctcttgttacctttgagttggtggaagcagagaaaacattcaatcccttcttgtttccagattgcaggggagcatccctgtagggaagcttctgtgtgtttgatagtcttttgccctcctcagtcctgaatgtttggaagcgcaatgcagggctgctgggatttgattccagcccttctgtctgcggtgcctgacggggctgagcctcccgccagggaggtgctaagtgcttcctctttgtttgcgcttgctgcaaagccaggctgacggtttctgctgaaaacactgctacagctgtactcgggtttccagcggcttcaactttctgggagcttttatgttttgtctctgtacacagactttcctcctttgcaccatggacagtctggctgggccctgcgctctgcacccagcaactgttgtgagatggctttcttttctatatagttttttgaaagacatttatttatttatttttctaccaacgataaaagaatattccggtatacttgtggtcaaaaattttgaaaatattaaaaaaggcataaaagtaagaaagaagaatcacttccagtgacacctttcaatggccactgtgaattctcccctccctttctccctgtctgtctggtttcaacgtattccatatgggtaggaaccaatttctgctgtggaataaatggctaggtagagaggtgtcggtgggccttttttcttttcaactcttgtgtcaacgtcaagcccctcctaaatgggcagagcctcgatcaccctcttgccaaaaacacacaggaacccataacaatcctcaatccggagcaataggacttctgcaacacttttcccccaaattcaaatctcctttgaagagcctaaagcttaaaggcataagcttaaccctgggctatgtgggaagaggcagtctgagaaaaacttcacacgccagcgagcaaaggccatcggaagttacgtacgccagactcaaaactcagggttctactttgttctataagaacgcccagaaaggagaactcccatcaaggtagaaatgtaaagccgagaacagcgctgagcacttgggtgtaactcagggactgatcctgcggtggcccgtctctcctgagagcccacctcccgcctgaaccaacccttttttctgtttggtaaaggcatacacatcttatattgctttggacacacggttcttactctcttgcaggcttagcagttgtttcacaagtctgctctccctatttttgtgtggtttctttcttgtttgactgaaatcatatgcaaacaaagtcgaaagtgtctgttatcaccctgatggcttctgcagcattgtcttgcttcccctcaccccattcacagttcccagagagcctggcaggtgtctcggggccccaagatgagtggtgcccgtgcgccgcgaccccagcccagcgtagcccagcccatcgctcgcctcatccaggcctgggggacccagtgcgctcgtcatctctccacctttccttccttgtctaaaaaggccatcggggagttcattttggtggacaaggatgtgaagataaaaaagaaaggtaaaatctacagccttaacgagggctacgccagggactttgaccctgccgtcactgagtacatccagaggaagaagttccccccagtaagtgagggcccggggagggtggtgcaggttctgggcatctggcaccagaggccgttctggaggcaggggcatcccccggagatgaaagggatccttgggatcgagggccttgggcctcatgtggggctcctgagcagtgtggaaatctattggttgatgacttaccctaaaggtgaaaggaagcagggatggagtggattgggcttccgtctacactgagcccacgatgaagttctcacctcagtactggagactggaattctcaccctgagacatcaaaaatcagtctccatgtcagcctttgctactttctcttggcagaagaaaattaggataataaagttaaacaaatgaatgaattcatggcagtaaaacatcttcccttctggggtccatggtcccagatgggatgaaatgtggttcccccactcaaatgcccgtcaagtggtgtctgccccttgctaggcctgcctgaggtgcatctatcagttatctcgagaccgagagtgcccatcgtgacatctccctaaagaggttacaagctagtgaatatgaagagaagaaatggctgtgtggagcttgctctatatggaatatctgattttgtcctttctttgtttaaaagccatcgatggctgctgtttgctagagatgaagctcaaatgtttgcaggacgttcaaggaggcctcagatctgccccaggctttctctccagcttactcatctctcctttcaccttatcctggattcccctcctgcccccaagctccgcacacgcacacccgagtcccacaggctcctcctccaggaccatatccctctccacattgctaagcagacacttgtgcagtttcctctcctgtaaattacacactgcctcccacccctgcccggttccttagcttggtaacaaactttctcagcctttaaggtgttactaaatggtacagtttctgtaatgcctgcctcagccccataaccagaatcaaccataccctcgttggggcttctgtgggcaatctgacctattgtgagatgatgagaggctgtctccatttttccattttctatttattgggaacaggattctcatcacattttttagcacagccccaaatacataccttgtaggtgctcggtgaatggatgtggaatcaaagaaacttaggagacaccaagaaaactctctttcttattttctgcaatcctaattcttgctggtcttaacttgcaggataattcagctccttatggggcccggtatgtgggctccatggtggctgatgttcatcgcactctggtctacggagggatatttctgtaccccgctaacaagaagagccccaatggaaaggtaagggtgtcccctggagagggagtgaggagcagatttcacttgcagcccacgcgatttagtttaggaagaagaaaggttttgctagctattacgctccatgctaggttgctacgtgtgtctgtagcatattcttttgtggattaaaggtaaagccagacgatatcaactaaagataaaaatagtctcttgagagcccttccagtgctatggcaaaagagaatgaacggtcaggacgaggactgaaagtccttagggcttccagtggatacagggcttggctggggcaaaatgaattccattcataaagtgaaatgaaacaacccagcctcacttccaaggcagcgaatcaaatgtgtatcctcagtagaagtcttctttgattgctttcaaaaggtgtaaaacagaggtaactagtgagtcaacatccactacttggaaaacgataccttttaggggaggaaagaatctctggggaaacctagagctttcaggtgagccgtcaccaccgactcactagtccaagcccatggtgttcccagcaggctgcagggtggctgtgctccctcacgctcgctcagagctgccctgctttccttctgccagggtgacagtgtgcttccttcccaagtattgtgtccttcttatgttttcccagtggacagatggctttttaggcagagtcttactcgtcgcccaggctggagtgcagtggcgcgatctcagctcactgcagcctctgcctcctgggttcaagtgattctcctgcctcagcattctgagtagctgggattacaggtgcccgccaccacgcccgactaatttttatatttttagtagagacggggtttcaccttgttgaccaggctggtcctgaacttctgacctcaagtgatccacccgccacagcctcccaaagtgctgggattacaggcatgagccaccacgcgtggctgccttttttttttttaatgcaagaggagaacaggaacaacagttcccttaaacacaaaacctatgtgtttggatgtatttgggtctgtttgcagcatgtggcatccagaatgaaggcatttctatttactgaaaccatcatccagctgtagctgcctcgggcatatcaacctgtgtggttagcctgctttccagcacttttctctaaagtcccccgaaattgttcctgaacacaaatattgaggctccttctttttttttttggtttttcaaaactagccatgacacctatgtggaaatagactcaggaaacacctgcagaaagctgtcgctcagtaggcagactgcatgaaaaggcatacaataaaaaagttaatatttaaaggtgaatgccaagacgtataatacactgaattccaacccaaaagccttcggagaatcgtaaaaggaatgcacacagagttgcaaacaatatcacactgtttggaggagccggtctgctttccagatgtctgtagccagacaccaccatggattttttttattgcttttagaataggcgaagctccatccaacacacacagaatcactcattaagtccagtttccatggtataaagagaaggcaatgatcgcttctgccaaaatgtcattctgtccagtatgcaggtggtctgtctcacatttgcatcaggtaatctattgctggcactggcttgatgaatggttgaatttaaccaaatggttaactgttttgtctcagatgcaacctggggtgggaggaaacttttacagcctcacaggaaggaaaaatacagtattcgttcccttggaaactcccaccagctctgcatgttttgctgcagaaaagtctcttttttacgcaataccttctgatacaaggaggccgctacccggtcttgttttccagctgagactgctgtacgaatgcaaccccatggcctacgtcatggagaaggctgggggaatggccaccactgggaaggaggccgtgttagacgtcattcccacagacattcaccagagggcgccggtgatcttgggatcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctcctt

SEQ ID NO: 37305 - DNA, 28242 bp, Homo sapiens
gagatctggttgtttgaaagtgtgtagcacctccaccttctctctctctctccctctccctctcctgccagccaagtgaagacatgcttacttccccttcaccttccttcatgatggtaagtttcccgaggcctcccgtgccatgccttctgtacagcctgcagaactgtgagtcaattaaacctcttttctttgtaaattacccagtctcaggtagttctttatagcagtgggagaataaaataatacagaaaattggtactaaatagtgaagcattgatataaagatacctgaaaatgtcaaagcaaatttggaactggataggtagtaggtgtgattggaagagtttagagggctcagaagaagatggaaagatgaaggagggttttgacttcctagagacttgaatggttatgaagaaaatgctgatagggatatgaacaatgaagtccaggctgaggagttctcagatggagatgagaaacttattgggaactggagtaaaggtcactcttcctatgctttagcaaaaagattggcatcatcgtgttcctaccctagagatctgtgtcactttgagcttgagtgagatgatttagggtatctgatggaagaaatttctaagcatcaaagcaagcaagatgtggcctggctgcctctaacagcatattctcacgtgcatgcccaaagagattatctgaaactggaactcatatttaaaagggaagcagaagataaatgtttgaataacttgagcctggccatgtagcagaaaagaaaatattattttctgaggaagaattcaaggtggttgcagaaatttgcatgagtaaagaagagccaaatgttaatagccaagacaatagggaaaaatgcctccaaggtatttcagagaccttcaaggtaaccccttctatcacagacctggaggtttaggagagaaaaataatttcatgggccaagcccagggtcctactgctctgtgaagtcttgggacatggcaccctgcataccagccacttcagccccagccatggctaaaagggcctcagatacatcctgagctattgttttagaggatgctagccccaatgtgtggtgacttccatgtagttttaagcctgtgcctgctcagagactaagagatgaggcttgggggcctctgcctagatttcagagaatgtataaaaatgcatggacgtccaggcagaagcctgctgcaagggtggaacactcatggagaacttcttctagggcagtgtggagggggaatgtggggtttgagctcccacacaaaatttccactggggcactgcctagtggagctatgagaagagggccaccatcctccagaacccagaatggtatatccactgaaagctcatactgtgtgcctggaaaagctgcagacactcaatgccagccagtgaaagcagccatggggcctttaccctgtatagccacagaggtagagctgcccaagaccctgggagcccacctcttgcattagtgtggccttgatatgagacatggagtcaatagagattatttcggagctttgaaatttattgactgcctttctgggttttggacttttatggggcctgtagcccctttgtttgggccaatttctccattttggaacagaagcatttactcaataccccatttccattgtatctagaaagtaactaacctatttttgattttatgactcatagttggaagggacttgccttgtctcagatgagactttagaattggacttttgagctaatgctgaaataagttaagactttgggggactgttaggaaggcataattatctttggaaatgtgaaaagaatgtgagatttggaaggggctggggcggagtgatatggtttggctctgtgtccccacccaaattacatgtgaaattctagttcccactgttggggaaggggcctggtgggaggtgattgaatcatggaggctgacttctctcttgctgttctcatcatatggttctcctgagatctagttgtttgaaagtgtgtagcacctccaccttctttctctctctctctctctcctgccagcaatgtgaatatatgcttgcttcccctttgccttcctccgtgattgtaagtttcctgaggcctccacagccatactttctgtacagcctgtggaactgtgagtcaattaaacctcttttctttgtaaattacccagtctcaggtagttctttagttctttatagcagtgtgagaatggactaatacacaagaatacagtcagagcaaagtttcactattctcacatttcctcggtactaatcaaatatgtccatgctctgctcttggccgtctatgggaaggtggggtttgcaacaccttacattgtctggggacccagggctggaattgctccctcagtgaatcactgggggtgggattgacagagatagggggtccatatgcttaggaaagtggatgtaattgggctgtaccaatgaggagtctgtgttagggagggtagttctgtgtctacagaacacagagggaatttatgctactacaggtagaaattataagcccctggggacatccaatgtcagtcttcttttacctaatttgggacataactgtcaagtatgttttcctttatactggagaataatgttagaaatgatatctcctgcctatctacaaaactcctctataaaaatgtagaaaagaaagaaaataattttctcattcaaaaggcattaaaccacactgcaatgtgcaccataggtaatgtctaatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggtaagagaaccaatatctaaactgattccaaatattctttcatgatagcccatgcacacagagctatttgcaaggaaaggggcagataatactaaaattaaatatgcaaagccatgttggagctattggaggtattggcaaccccaagggaaacagctgttagacattgtccatgccatcagcacaggaattccaatctagctagagggaacgctttcactgactgcacagccaggcacccaaccaatagcagtgctgaggtccaggcacctttaattccccaaatagatctgacagctttcaaatcccagtatcctcttgaggataaaaaggctaccaaggacagaggatgtattcaagataagaaaggttgaaaactaaatgatgaaggcgtggtttggatgccaacacaccttgttcaaccaatgccaaaatatacacatgatagcatgcatttcggatgagatgcctcattaactttcttgcaaaaatatataaaaggaaaaggcctgaaggctcacttggaaaggataacacaacagtgagacctttgtgctaaaaacgagcccagtaaccatagcagaggacagcctggacaataggagagaggttttgctttggaaaaataaatttctaaattgactggggcatgtctcaggtatttggggctcacaatacctaaataaattaaaagcagaaactaaaacatgtttttgaagcaatgttagtattcatgataaccttattcataataattctattcacaataatcaaaaggtgaaaatgcaagtgagcatcagcaaatgaaaggataaacagagtttagtgtctacaaagggacattatttagttttaaaaaggaaggaaattcagatacgtgcaataatatggttgaaccttgaggacattttactaagccaaataaaccagacacaaaaggacaaatactgtataagtccaactatgtgaggtgcctagaataattaaatgcaaagacaggaagtagaatggtggttgccagaggatgaaataaagggaaatgggaagttgttgtttaatgagcagagttttaggttgggatgattaaaattgtaatatatgtatactggtgatgcttgctcaataaggttgatggacttaatgctaataaactatatgttttaaaatggttaaatgatgaattgtatgttatacatattttaccacactaaagaaaaggtttaatgacaaataacaaagccaggatacatcgaagatctacacccatttccttctttcctaggccctggagaaatgcagagatgcaggtttaaccaggtccatcagggtgtccagtttcaatcactaactgctggaactgatcctcagacaagccaggactcaagtacaagcccacctacaaccagatgagcccttagggccactggggccatttctgactttgtgctcttcacatacttccttacattagaataatgtaattgttcagtatgttgtgctttaattttttaagaaaatgtcaaaggctagccatgacacggttatgtgtatttcttttaacttttccataaatattaaataatgtaattgttcagaaatagaatcagaatcgtttcataaatattagataaggtaatttttcagaattagaattaaataatgtaatttaggtctccaaaacttttttattttcaatatttttaacttttattttaagttcgggggtgcacatgcaggtttgttatataggtaaactcatgccatggtggtttgttctacaaattattttgttacccaggtatgaagcctagtactcattagttatttttcaaaatcttctcccttgtcccaattttgataaattggtagaggcaacagcctgaatagaggttcattcaagtgtaggaagagaagaattagatacagaagtgtagaaggtattcaaagaatgggttataaatacaccagacaattgagaagtccctgaagaaaacaatgaagtcaaatgacaattttctttgagatgacagaaaaaacagcatgcctatgtgctcttaggaagaatctagtagaaagagaaaaattgatgatgcaggagagagatgagaattgctgaatcacgtttgaattcatttcttatttctgcagtaaaaaattatcacaaatgttgtggcctgaagcaccataattaattttctcacagttctggagatcagaattccaaaatctcgttcaacaggctaaagtcagggtgtccacaaggttgtattttttcttgagggtctaggggaaaatgctattctgggccattccaggttccagagaatgtgttccttggctcatggcacttattctatcttgaaagccaactgcatggcatcttaggatctcttccctatgggtctttccttacacatcctctttgattgtggccctcctgggtgccacttgtaaggattttgagatgacattgcccatccagatgattcaggaaatgcttctatcttaggatccttaacataatcacatctgcaaagtttgttttgccaggtaaggtaacatagtcacagcttccaaagataaaggcatgagttattggcagggcagggggagggagcagtattgagcctactgtactagctttgtggagaacttgaagcaagtaagccttaattttctagccttgctaatagaaagtactatatcactagccactaggtcctgaaaaatctagatttcatctcagatataatgaaataaaaacctgttccttagctctgatatcatttataccctatcatatgtccccttctagatatagtccctttattcccttagtttaccctttctcccaggatttgtgaatatcttttttcgctgtacatgcagagaactccagcattgctgttctttacattctcaacaactgaaagtttctactcatacctagattatacttcaggcaactacttccatgttataacttatacagacaaagaagtacttataactgctctatgaacctttaactttaacacacttcatactaatgaagcctcttacgcttcgattttcactacacatcagttcatcaagttcttgttcattaagggttgcagtcattgggtctctcgtgtttcctctttccattctttcaatccccacacaggtttacatattcagatttgcttacataataaagtaaattgaaatcctcagactacactcattctctctaaatttctcctttaggttttctgctgattggggtctcttgtccttgtacctattgatctgtgcttatagcaaacaaactggatcaatgtgcgtgcagccagatcaaattgccctgcttgtgtttttgtagaccatcttgccaaaagctaaaatcctacaccagagattcttattcattagatctgtagtgaagtctaggtattactatgttttatttattttatttttggatttgtataaaattaaagtttacaagtgcagtttgctacatagatacattgcacagtggtgaggtctgggcttttagtgtagctatcaccagaataatgtccattgtatttacccaataatttcccagcctcccagccttctgagtctccaccagtgggagacagaagatccagtgggcagataccaagtgcctgtaggtgtgcctaggcatggagttgggaaacctctgctctttgatgaattttaaagaggttatttgggttttcttgttattgttgttgttgggttgagttccttataaattttggatatcagtgccctattagattcacaatttgcaattatttttcccaattgtgtaggtcatctgttctctgttgattttttttttttttgctttacagaagcttattggtctaattaagtcatatgcatctcttcctattctctcatttgtgtttttgaaatcttagtctgagttccttgctgagacctacttaggaattttttgccccaataagtttaccttagattttcttctagcacttgatagtctcaggtcttatatttaattaagactttgatttatttccagttgttttaaaagcttgcaaagctattttgaggtataagcaaggttgcacgtctaactttttgaaaatatcaatttttcattacggttttaggggttaggattgccttatcatcaacatgaattttgctataaaagctttgctaaggtcactcatgtttattcccttgcccttggcatgaactacagtgggaagagtgctgcaacccagccctagccaacgccgcatgagagggagtgtgccgagggcttctgagaaggtttctctcacatctagaaagaagcgcttaagatgtggcagcccctcttcttcaagtggctcttgtcctgttgccctgggagttctcaaattgctgcagcagcctccacccagcctgaggatgacatcaatacacagaggaagaagagtcaggaaaagatgagagaagttacagactctcctgggcgaccccgagagcttaccattcctcagacttcttcacatggtgctaacagatttgtatgtgaaatgagacagtttcctgattccccttgcaggacttgcgacaggggtgtggctcaccggttcaaactgcttgagggagggggagcatggagatgggcaggtgcacaggccagggcgagcgctttgggctctggctccatggtagtgtctagtggtgggtgcctgcaaccacagtgttgtaaagctctttcagctttgccatctgcagacggcttgagtctgcagctccatggaccctctgacttatctcaaaggcagagggccagtgtgacagctttctatatcccaagctcttgccaggcatcccagaagagtcagatcacatgtgggctcaaaggatgagggcaagattttattgagtggtggaggcagctctcagcaagatggatggggagccggaatgggggaatgagtaggaaggtgatctttccttggagtcaggctgcccagtggccggactcttctccaatcctcctaggccaaattcctttcagtgtccaatgtccctcctcttctctctttctgtgtgtcattgttctgccgtccatctggttgcctccttgtctcctcacctgctggtctgcccaggaacttaggctttgggggtttatataagggcagaatggaggtgtggtgggccaaaaggcaaattttgggggcgtgaaaacagaaatgcctgttctcatttaggggcacgagtatccaggcttaaaggtgggggcctttgctgggaaaccaccctcttctacccagtatttccctgtctcctgtccatatcacatggagtttaaaccattcagaaatagttttttctcacctggttttatgctaaccaaaacaactataatattaatacttttctctttacaacctcccctgcttgttgacctatctaggagtggtcgcaaggtgtgcaagctgctgagtcaccctgactgcatcaaccccaggagcttgaggggtgaacaatagtattgagcaatagtaaaataacaaacagtgcagacaaggcagacgtctcaaaaagtgctcggtgcaattgtcactcatccagagtcaacattggtgacacagttgtttcttcaaacagagttcactctgaaaaaactgagcaaggtggaatttactttaaatttcatgggttgtgaaatttcaactaatgtcataattaaaacttcctacatattgctttaggcatctctgtcttttccccaaaattttctccatggcatcagcagtacctcagcctcctccacagcctcccagctcttcctttttcctcctgcacggcttttggcatcccaccattttccacagcaatgcaggctaactgtgagcttccacagcctctcacagacatgacttcacccacaaacctctgtgaggctcaagtgtacccctttttgttcacatagaacctcttcaccccagagaattgagtcaaccaaacaggaaatctcaggacaaacagtgctggcaaacatcattttgtttaaagtatcatatcaatatgtatttgttgagaaaatattcggagttctttgcaaactgtaacacttgttcagaaaaaatagtgagaagaaattaggatcatttatttacttgaggcacatgagtgttctttatgtatgactcaaggacatcccacttctgtcctccctgatcttccatcttccatctgctttcctccctcttcccatctccctttcctcatattcctctccctctccctcacctataggactgagaattcctgtggtctcctgagatcagtttctttccaccagattgtaaacaagctgtggaaagttttagttcttagcgactccacgacccacactagtcaggcagaagcccccatgtacaaggtaccccttgagccttggcaaggtgcatgacacacacttggtcactggaggaaatgatgagtagagagtgacaagcagaggaggggagctttgggcctgagtcctctggggcacaagagtggttgaggcttggcacttgccacctagatttcagacaatgtgtcaggaatcctggatgcccagaaagaaacctgctcagggtctggagccccaacataaagcttttatttaggcaatgttgagcactaatatgtggttggagctctgcagggggtctccatgggtgcactgtgtagcaaagctgtgggagaaaggccttacccctcaaaattccagaattataaatctatcagccgcttgcaacttcagcctggaaaagccatgggcattaaactccaaactgtgagagcagccatgtgggctgcaccctgcaaagccacaggtacagtgcttcccaaagcccccagaagcctacccctgtcaccagtgtgcccagaatgaagaatatagagtcaaggaagttgattttgcagctttaagatttaatttctgccctgtcggctttatgacttgcatgaagcctcttcctcttctctttaagctgacatttcccttttgaaatgagattgttcaaccactgcctataaaaccattgtaatttggaaggaaataacttgtttttgattttacaggctcatagccggtagaaatttttcttggatctcagataaatctttgcattttagacatttaagttgattctaaacctgataaggctttagagactcttgaggtaaactgattggattttgtatgtaagaaagacctgaaatttatgtctgcagctttttctcctttatatcctcaactaacaatattttggggtttctatgattctttgctaaaatctggattcccgtttcaatttctcttgtgcataatctgtaattattttctctgtagttaccattggaatgacatactgcatcctatagttataccatccactctgaaatcaatgtgaatttaacttcagttccatacagaaacttcttttccacaggtacgtttctgcttcacattattgatgtcactaattacaactttatatatggtgtacatgttaacagaaagttattcttattgtaatgtaaatcttgaagaaaatgaaagtaaaagcaaatttcacaaatacatgtttccacgtttttcatacacctacctttacgagaggtctttatacctctatatgacttcacgttgctgtctaaacttctttcatttcaaagtgaatgactctcttaagcatttcttgtagagcagttctaatggcaatgaactcctgcagcttctacatcacatagtcttactaactttctaatttttaagaaataatttggctgggtgcagtggctaatgcctgtaatccgagcacactgggaggccaaggtgggcggatcacaaggtcaagaaatagagaccatcctggctaccatagtgaaaccctgtctctactaaaaatacaaaaattagctgggcatggttgtgcacgcctgtagtcccagctactcaggaggctgaggcaggagaattgcttgaaccgggagaaagagattgcagtgagctgagatgtaccactgcactccagcctggtgacagtgcaaaactccgaaaaaaaaaaaaagaggctgaaataatttttttgccaaatatggattcggtgaaatttttttttattgatcacattaaatatatcacctactatatcctccaaagactctcataagaaatctgtggatcaccttgtccaggatcccttgtaccccatgagtcatgtttatcttcgtactttttatttttgttgttgtttttttcagatggagtttaagcccaagctggagtgcgatggtgcaatcccaactcactgcaacctctgcctcccaggttcaagctattttcctggcttagcctccggagtagctggaattacagatgtgcgcccccatgaccagctaattttttctatttttagtagaaatagggtttcaccatgttagccaggctggtctcgaactcctgacctcaggtgatccgcctgcctcggctcccaaaatctcttgttatttaaagattatctctttgtctggcttttagagttggatgataacacatataggtctgagtctctttgactttatgctatatgcagttctttaagttacttgaatttgtagatttttgtctttaaccaatttgaaaaattttgatgattttattctccaaataatttctctactaccatgggtttgcacttccccttctgggaatccaatactatcatactggttggcttgaaggtgtcccataagtcccttaggacctgttcacatttctttattcttgcttcatgtccttagactcaggaatttcaagtgtgctatccctatgtgtattgattatatcttcatcctgctcaaatttgctattgaaacactctctggtgagtttttcattcaggtatattttttagctccaatttgtttccttttctttttataatttctgtattaatactatattgtgattttcttattttttcagattttctgtagttcttaatccatatttttcattagcaattttagcatatttaagacagctgtttaaatgcttctctactaattctaatgcctgtgattcttcaggaatgatttctactgatttatttcttcctcataatggactgtgatttcttgtttctttgtatgccttgtcattttatttttttgagctggagtcttgctctgtcaccagaatggagtgcagtggtgccatctcggctcactgcaacctctgcctcctgggttcaagcgattcctctgctttagcctaccgagtagctgggactacaggtgctcaccaccacgtccatctatttttttttggattttagtagagacggggtttcaccatgttggccaggatggtttccatctcctaacctcgtgatctgctcaccttggcctcccaaagtgctgggattacaggtgtgaaccaccgtgcctggcctgtatgccttgttattttatttaactgggcatttgaaaaaataaacatcttttttactgtatatagatttgttctatgtcatgacagtcattaacttatatgtgcggcaggttctcagtcaaggcatcagccctacgtaaaactcaagtccttcttagtttgtttctgaacatgtacctatgtggactgtgtttgcccttttatatttccccaaataaccaatggcttttgaattgcttactattatgaaattttgcatcccagtttctcctcaatagcttagatggactattgcatgtctcttcccctggccttttgcctataacatctgtatgtgtatagtcaccctgaatctctactgagccactccagaaataaataagtttatttcagtcaattttaggtattttctgatgtttccatgagttatatgggaatcttagaatccaccatcttgttgaaattactctgtgaaaaatttcaatatctttataatattacatttatgtcaatgataacaatttacctatttttcaatttctgtttgttttatgagaaagcaaatagaagcaatcagggcactgcaagttgtgactactccaagatgtgaatcatggatcatgcaaattacaatcttgttttaacctgacctccaaagggagaataaagtaaaaattatcccatgtgaggattattcaccagtttatatgtcattagttaccagtttttctttatgaataatgtttagcaatattataaagtatatctaatagttatcaggtttttggcttgttactttttggtagtaacttataaaactgactggaaaagaccaataaggcactgtttgcatgttacaaattatatccaaagaccaaaagctgttaataagaaatcttccaataaaaccacatcatattttcttttttatttacacccacatcaggattacaactttatcaggactgcaccttgatcaggaagggatgtttctcttacaaggctaataagaaaggaacaataaatttgctgatgaaaaaaagtcatgcatttaaaaattttaactttaatttttaattgagggcaatattttaaagaaatgctcattagtcattcctttaaattgtgtgtgtgagagagagaaaaatgaaaattagtcatttcaaatgctgcaagatgcagaaggaactcatcatcatggcacacacaaaaaagagctgtgccgctagaggtttctatattcttatgtaaagtcacaatttgttctacaaatctctttgagtaatttatgtctcatatatagagatctggaatagcaaaaatacttcagaggaaattaatgagtgtatcatgaccacataataatttacttatgaattttcttaggtaagaaacggttgaactggatgcaatttttatcacagcttgtgtaagactgcctctgtccctcctctcacatgccattggttaaccagcagacagtgtgctcaggggcgttgccagctcattgctcttatagcctgtgagggaggaagaaacatttgctaaccaggccagtgacagaaatggattcgaaataccagtgtgtgaagctgaatgatggtcacttcatgcctgtcctgggatttggcacctatgcgcctgcagaggtaacaataatatttttagtgttgagagttcaaaggagctagagtaagtggaagctgaccaggttgtcaggcttgtgttcctatgttactctgcatgactcccctttaaacgtcagtctttgttctgcaatgccgtcttgtcacagggtcatctactgcttatttgtggcactgttttgtcttctgtttatgtttatttcacagcttgtcagagtctataaaactcagcagaaagaacacggcttgcctgctccctctcttgaagattgattgcaatgggagtggtttctctgtttctttgtatagtcgaacagatatttacttcttccaagaagatacaattcagaggaatttttatggcaaaagttagtggagacggggtggatgaaatctgttgggagagtatcactgttctgatgggcggccttgagcaccacactgtaatactagacctggcctaaagagaatttcccatgtactattctcacctctgggaaaattacctgaaataataaaatatcctcattttaagaaaaaaaaaaaaaaactagaaccaaacaaggaaagtttaaattctttgtctttgttaatatgggtcagatttgtatcaaaatattgtaacagaaaaatttcttgtttctctgacaagaaaattaatggaatatattttattttctagatttagaaatagctaaatgctatttctacactggaagaaaacttgtatctcaagactgtcttgggaatacaatgtgtgtgaataggaactagttatataaaatttgagtctcacatttctcatctataagacataaggagttacaaagggacattttgaagaccattgacaggagtggtttattttgtaatataaattggcatggagaggaagtaaagatgaggataccactgaagctccggccttggtaagcctttgattgcttgcacagcgaagagaagatcaaagatggtatgaggagagggctgtgagacccggtatctagttccttgtaatttcacaggaaaaagcctctgaaatactttcaaggtgggaagatagtttgctttgtttctgtttttgtcatttaaaagatatactgtcaaatctgtatccaaatttgttacataagtcaataattgtaaattttactgcaatcatatgtttcctgacagagttgccttgaatttatggagctgaaccccattttgctaatcacttactccctgcagcctatttcttacatacacaaatcaatatccttagagtatacatctttactcctagtatttggttctgttatgcagacagaatggccaaaacctgggtagaaaagatctaacataatagactgctatccatagatgtgcctatttccaatataaacctgctggcatctgagaaagtggagttctccctgtttcctaactgataagaatggtggctctacgtaactgtttgtgtaaactgtggggtttctgtgcacctgctttgcttttggagactggaagatttgtgtctgctaggcagagtgagtcaatgtatccagtcccagacaaaatcttagcaatggagtatgtagagggcatctcttgtagacaacagttcacatacattgacaaaatatgatgctggataaagtcagtgcgctctgtgcaacatggtgggagaggaatcacaggagcttacactgcattccttcataattccttccatgtggctatttccttgtgttaatttcaccatactaaaaataattaagattatgtctgtaactatagttgcgtcctgttgatttttccaaaaaatcactgaaagtgaaattgttttggggacacttccaagctagtggtcaagcagtgatttttctgggactgcagaagttcctgctatgcccaacctttattactaaatgggaaagacccagtcagactgggatgggcttatgattctacatacagagctcatccaagaaaggaggaaaagctgatttttgtgaacgttgctgcttgtgcccgaactaactctcaggcacattagtcagaaaatattacgtttggttgctcccccaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaaggtactgtgcctatgatgagcttgtgtgcacatgtatttattgtgattgtgtggaggtggcagttctatgactggatccatagttgagggtgaattgtgcttatttatttcgatttattcacacttactcatgtattaaaactaatatcaaaggcaggaagtgaagatggctttctcatctttgcagtgttccaattcatgccttcaaagtgcctttactcttcgagctcagcacagatcaatatggtttaacatagactatagaatgagagataatcttaatcatattatgttatctgttacctcctgggtgagtttcttacatttgttatgattctgagtttccattgtcattttgatcagagagagagagaaagcgatataagagagctcagtgagtataaaagagtgatacctacattgttttaaattgcatccagcccaagttaacatattaaaaactgtgtttgcctcctcagtttccaaaccacaaagatacttagtcttgcccattgggctgaatagatgaaataattacaccactaatatgagttgtaaaacttaccaaagataattcagataatgggtatgcttatgatttgataacaacttttaccttttgagtaatttcactctttcattcaatatatgtactaactatatatccaacatattataaagttcatcatgatatggcagaacaaaaggcatcacaagaagagagagaataattttgcctgtggtcattagttttgaagtagtagaaaatgtctaaatattaggtggagcaaactagtaaaactggctcaagttttcattacacaacttcgtttctctaacctctgcagctttggagcaattcccatcgaccagagttggtccgaccagccttggaaaggtcactgaaaaatcttcaattggactatgttgacctctatcttattcattttccagtgtctgtaaaggtaggcagcttgtgtgatcaaattaatttcacttttgttctcagcataaatattgttttcatggagatttgaactaagctttttcttaggaggacatagggattttaacatggaagaagagccctaaacataactcctaattcctttctatggaacagaaagcaattttgaatccatacttccgtgattgcatgtctacaagaaaagagagtgcagaatcctcaaagcctctgcctcaaaaacttgaggaaatgacaatcatctccttgaaggcacaaggtcttatttatgattcctgatttcacctcttgggatgttcacagacacagagtttcatgaagctgtggtgtccagaaaacctgctgcacatagggtgcacaatgagtttccatcttcttgcctcttttcaaggggcaagaactcagtccgggaatgtcttaaactacaaaccttcatgggaaaccttgttgcttctgcttcctctcttttcacactggaggttttatttttgcttagccatgaattcttgtgtcattcataacttttgtcttaaggtactgaaaactagtcaggctagttaatgcaaaagggtatattagatatgataatgggaaatcaaagccagggctacattaagaatttgataaaaactctaaaaatatatcctttctccacccttatctctgctttattacaaaaggctttttaaatatttgttccaacctttttcgttggtggcatttatggctttggagcactgtcaggcccatgttcattaccgtgagctcctgtgcatctcctaatttccaaactagcctggaaaacgcctccattgaccatgattggttcatggtcctgtgcatggaacatcatatgttcagggagataaagaactctgatagtggcacctgggtaaaaagtacaatccattatatctggatatcaagatcttttgcagttgaagagaggtattgccacagagaaaattataggagcagaagaaagtcaatgaaagtcaatgatgacactccattaggaaccagaaagatggtatttatttatacatataataggtgtaagagattagaggaagcctgtcacctgaagacattccttataccttcatatgtagtacactttgtacataccactctctggagcgctgcatcacctacctcatggaggattagtgtccttaaatgtacctcagagcatggctatgtgtggagaaattgacttgtgacatcactaaactgactgcttctacttcagccaggtgaggaagtgatcccaaaagatgaaaatggaaaaatactatttgacacagtggatctctgtgccacatgggaggtgagtgtttggaggtgagagaacggataagaaagatgaggtaggatacatctgtttcctatcttcttagtacaagtatggaaaatgcaccattggatcaaaaacttaggaactttacaaaggtagtttttgtgagcagcgaggaaaaagaaatgacaggcatacaaaagagagaagtggaggagaagaattgggggtaaggaggactgggatttctttccttgcctgtacattaatctctccactttcctaaggaggaaacagaaattctcactcttgcaatcactatcttcttccccaatttttctgttttattttctcccttttaagaaccacggctagctagtttgattgtcacgtctagacagttgttgctttcacagttctatgttacatttatcttgctcttcagtcgactacacaaatgatacctcacaattcctttttcccaggccatggagaagtgtaaagatgcaggattggccaagtccatcggggtgtccaacttcaaccacaggctgctggagatgatcctcaacaagccagggctcaagtacaagcctgtctgcaaccaggtgagcgccctcagcctcctctcctttctgttcttcatgcccctctttctgtcctattgccaagtatccattcatttagtcccacttatctttgtaaaagagaagattctagagaacaaagcctcttcctagaagggcatggagtcctcttacttgtaccctgcttagaaaagtcttacgaaaaggtgttgtaactttgatgctgaattgtgtgttacatttataggaggtcaattcgatcaagaagtccaaggattgccaattagactcagggaaaggtggacttacccctaagctacgaaagatgaccagagagtggacgggtgaaggtgatttggagggaactgtgcatagatatgaagccatgaagagatggaatgaacagtacataaggagagagtgagagcaagagaagagaaatactagggattcacatgggcttcggatgtctcagtgtctcttgatatctctgctttcacacttcttgaccaagggcatagatacactaaaaattatctgcagacagtgaaggtcatccatggtagaaagagaaaatgacctgtttatggagatatctgttcacagtggatgaaatccacactgaggaaggttcagcagaacatggagctgacctatgactgccccgctcctagtcggctgctttttggagtctgtcatgcaatcagctgcttaaacacatctattctatgcatggttctttcatagcctagagataattccatcttttccttgagtcctgactggtgattccaggcctccttgatcaaattgactgcccccaaatgttacacacatttcagcattaaaatcactacacctttcccagtaacttacattttttgttataattttgttataatttggtataatgatatggtgctgtgataatttaataaaagcattgagaaattaatgtggttttaatactagtagttccccaattttttaatatggccattttcacactttccaaaaatttgataaaaataatactggagacccatgttaccatttatattcaaaattactaacattttgcaatgttatatggagtatatctgcataaatacatataatgtttctagaacctcttcaaggtaaattgtaaagatgacaattgacccctagagacctctcaaagcatgtcacaggaatgaagatattctcccagttccagtgtcattactgtatctaagaacatcatttatagtgcccttatgtcatttggtatccggtccatattttaatttttcattgcttaatcaaaatatcttttgtagctcttctttttttaaccagaattcaattgtttttatattgttgtatttgatatcagttaacttgtttttcccagttgaaggttcctgtaaattaaaagttagatgtgagtattttattacattggcttaaaactttggggcaagaaaatgtttttatcatgctgtgtttttcaaattgcacgacactagactgcatacaatcacagaatgccccactagtggtgaaggtagttttaaaaacttggttaagctaacagtggtcagatctgttgtttttaactcatgttttctctttaacaattactagtaatctgctgggggataattctcaacagaagaagtcatattcccatgacaaattttcacatatgattgagtatacatcagtgatttgaacttttttctactgcatttctgttttcttctttgttatttcttatttgttatttccttggggtttttacataatcatttacaattttaaccacttgtttaactattcttacctgacatttaattaaaaataatttctcaccaagtaaaaataataaactactattcctctaagtgagagtaaaggtaaacttcttccttcaattagcaatgtactgtgaacgtaattactgtaatgaccaccatcagagtagacaaagattgttgttctttttctcattgtcgcactaattgctacagactcacggattcttgtgttatgatttttaatttattttactcattttttaatgctcacatctactcagcatatatatatatattatatatatataatatatatgaaagaagaatgtgatcaaagactcatgagggcaagtgtaaaagacaaaagcacttgtttcatagggaacccactggtgacatttgagatatcaacatacaaatccatcatacaaaaaggaaaagtaatgaaagactgtgaaaattatcagtatttatgtgtatatgtatattttctagttcatctatatagatatatatcatagatggcatatatgatatatatatgtcagatcaattagaaaacatacatatatatgtatgcatttttggtattaattaggaaactagttcttttgtttttcagacctgccctcatgagtctttgaccaaattcttgatttctggcacgatttgatgcccaaggctcaaagaatcttacctcatcccagctctgaaattggccgtgtctccttctagtggtcggagttattgagaaaccaggatagggttcatggagttgcttgtgctcagaaatagcatttctattttcttaggagagaggggcataaaatttatttttatgaaaaagatcatttttgacaataatattctcagttcaaatttaatgctctacattattcagcttcttttactttggtgattttaatattaatgtaacttttggattatctgatgcttttccatcttgctcgtctgcaggtggaatgtcatccttacttcaaccagagaaaactgctggatttctgcaagtcaaaagacattgttctggttgcctatagtgctctgggatcccatcgagaagaaccatggtaataagagatacaggaagtttacctaaaacactggtttgataaaaaaaatttaatcagatcatgctgtttcctggagttcactcacagctgacttggggtgagggaagaatttgcatttctgacgagatcccaggtgatgttgaggctgctgttcgggggcctcgcttgagaagctccggtgcagagtggacgccttagtctgtttagggagccgcctaacaaactatcgccagcctcagggcctcagcctttctgcctttccttccagggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgaggagcggggctgtgggcctcaggtctcctgcacagtgtccttcacacgtgtgcttcttgtaaggctctcaggacagccttgggccagctccatttccctgtatttcctatgcatgaactctttgtgtacgtcataagggtttcttctactctagcacaggagaggcaacagaggtggagagtaataggatgggatcaaaactacagatttgggttagcgttaagtcagtgatatccatatccctctactggggccatgtccttttctttattttttataatgaagcattgattagatgttctttagtctccaactcatggcggatttttcttcttgtatgtttatgtagtataaattccttatatttattctcttagaattttatctttgcgaagtgcttgtttaactctgcctttttttttggcgaggtggttgtgtgtctttatttttatgtgtaggagaccatatttataccaataccttaggatataagacaaacccacttaatatagaggcttaatgcaaaagcatttattgagctcaaggttccatggttagaaaattagcctgggctcagcctaaactcagtccattccttctgttcctggctgggctctcatgtgtgttcagggcagtgaggcagctctgcttcaggatgtccctggggcatctgtgtgagtgcccccctctcccatgcagttctttatcctccagccatccagcccagggttcacctcagcacagggcatgaccccagcatagtgaatggacatgtgcaaagcctttttaggtctaggctcagagacaccaaccattgcttctgggaaattctatcacctaatgcaagttacaggacaggtcagactcaaggggtggggaaacacacaccacctcttactggaaggaactggaaattcatatagccaagcaagtggacacagggacatgtgattgttagagggcatgttcctaattaatctatcatttatatgatatgtgtgaaataatatatcaatagttatatgtatgaatatgaatatatatagatatattatttcatatattctcaagaattcatacaagtctctaaagaattaacatccagaatacatacatatgtgtatgttttctaattagttagatacataaaatatacatcacgtatgatatatattataaaacctatgtcatatatatgacatatatcatgtatatgtatatacgtcactatttactaaaacattaagtaaaataagtgaagaaatccataggatactctgaaatagtgatacagagaacgagagaataaaaaatgacaataatgaaacaattgatgaatctaggtaatggcattcattaaattattttaaaaatatttttggacattagagaattcacaaaacaaaaatgaaaagttatgaaagactgtggaaattatcagtatttatacatatgtgtatgttctctaattcatctagtatatatagatatatatgatatatgacatatgtgttatataatatatatgttagattaactagaaaccatacatatatatgtatttattctggatatgaattctttagagacttgaatgtattcttgaaataacatctcccaaattttatctgcgttgtcatattctctgtggttatgttttcacaaacaaaagtttctatccttcatgtagactaatttttcatgcctctttcttgtggttggtgtgtgttgtgtcttatcctatattgggaatatcacaatattttactgtgttatcttacaaaattgttaatattctttccttataaatttggttaattctaatgggtatgacttttaaaatattatgtgaaataaggatccaaatatgcgtatctaatttttgaatttttagcaaaatttaccatttattgaaaagtttatatttgctcacataacttgaatttttttacctgacacatatatgaaatgtccatgagcaattatctggcctctcttccatcttcagttaacttattcacttttctgtgctataatgttaaaaagtaagtttcacttccagtatggtacaaatatttttctaacttcttcatttatttaataatatcttagctattcttgactaatgtgttatttaaaattttgaatcatcttattaacttccacaggcaagtaaatgttttagtctctcattgacattgtaataagcctgcagatcaatgcagagagaactgaatctttgacaatattgagatttccagtccatgatcataatatgaatatcccactacttattaataaatcatctcttaataaatatatcattaattgcataaatttctccattactgatcattttttttttgagacagagtctcgttctgtcacccagggtggagtgcagtggcacgaactcggctcactgcaacctccacctcccgggttcaagcagttctcctgcctcagcctccagagtagctgggactgctggcgcatgctgccatgcccagctaattttttgtattttagtagagacgggtttcactgtgttgcccaggctgttctctaactcctgaaatcaggcaatcctcctgcgctggcctcccaaagtgctaggattataggcgtgagccaacgtgcccggcaattactgataattttaatagtttttgataacttttcattttcattttgtggattttctaatatatagaaatattaaaagaataatgcaacaaatcttcttacctacattcatcaagtgttacattgctgtcattttttactctctttctctcattttctgtattactccttcagtttccctatggatttatacacttatttgattgaatgtattagaaagagtgacatctttttgatatttagagtctcccaaatttacatagtgagtacccacaccttttgaatgtgaaatcgttagtatttagacaattattggcttgagtgatgttgaaaactgatttttcctattatacctgttcattggagagatagatattcaatgttattcatcaaacctactaaattatgctagacattacaaaatttgcctctagattcttgtgggtcttctaggtacatggccctatcatgtgggcacaaagtaagctctgtttcttcttcagcttcctctgagatattctcttcatctgcagtgttgtgcagtttcaaaatattttatctgggaatggatttctgcttatttttgactggttttcattgaccacttgggtgtttagagaggtctttcataaattttggaaacgtatcaatcttttaagtattgtctctgcaccctactgtctgatgaacttggttgttcccaattggcaatgatgtaatctaaaaataattaaagttttctattactttgataggtgtttgaattccagttgacttcagaggagatgaaagccatagatggcctaaacagaaatgtgcgatatttgacccttgatatgtaagtaattttggagatggttgtcctaatttattttcagaggaggaacgtaggatgggtgttgagagtgacctccacaccaggggcacagaggccaacgtgagacagaggtgagacaggagctttctggaagtctcctcctggattcactccagagctctgttctctggcagggagagtggcctggggtcagcatgggtcaacctgtgcctctgctctcgtgactccaaggaactttccagagcagccaagatcattgctgaatctgcaccttccatgtaggcctgccgtttgtattactgtctagtgtacacactgtggatatggcccatgtggtcgcattagatgtttccaaatctgtgcttctatcttgttcttcccaacctgctcaatgtcttaccagatcaaaggcagttccgtcaatcttgtgggccaggttccaattcccacctctttcacatggaattgcttgctggatcctgtcaatttagcatttttaatcatttcaaacctttttcgtgcctttctttgcatgtttgcccatgagccaaatactgcatttgcctccagaaagtctgtcttagtggagcgaataggagcacttggccttggtgttctgcaatatggagatctcagtgtagagaatgaggaagtgttaaaatcaaatgcagagtgtagatgcaaaagcaccattattggagataatttataaccagtaacagacgtttactattcctctatattctaaggttctaggattcatagaaggtcattcaaataatgagggaaaaagaagttatgtaactgatggcagtggagattttaacaagtaatagagatgatgagataatgtgtgaaaaaaacaagcacaatggtacatcataagtacccaaaatttggtggatattattagtagtattttatccacttagcagaaaatacaaaatgaaaatggaaatgataataagaaaaggaaaagtggcaagcattagaaatgtttacaactgattaatgttttttatgatcatgaaatcaatcactagtgttattttgtagaactcaaatatggtctggagtaaaccacttgcgagcttccaagtgtttgctctcggtgtaatcacaaaggataggctcaattccgtaattaacaagttataactgtatatgtgagcagtcatttatctgtgtctttacattttggattatgtctacctataaaatggtttatgcattgtagctctttgaatattgggccctataacataaacaataatttacgtttctaatctaaccaagtgtgttgcgtatgataggcaggtagtaagtaatatgtaaagtaataaaataaagtacaattactaccagtataattatcacactcaaaattgtttattagtgatgagcatatatcttccttattcctcttcaatgtaaggcagaaggagttcctgtttttagtgagaatttgaaatagaaaaggtcagaatatctctttgttgacagatgtgggatctgttgttgagagatgtagagaaacatgtttgaacatttcactttgtgtgttttatgtgttaagttccaggcaggggaatagaattaaattattctttattttgaaaatacagatatgataaagtcacgttcattaaacaaagaaacacagattctagagcagtcagaaaatgaacttcttaacatctacactagcggcagcttcctagaaatcactgcgctacgggctagtaacggagtcattgccattcagagtgtgcatttttttttctctttccagttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagattcttcacct

SEQ ID NO: 37306 - DNA, 410302 bp, Homo sapiens
gcggtggcgaaggcggctttagtggcagcatgaagcgcaccccgactgccgaggaacgagagcgcgaagctaaggtatgtcgggctcccggggcctggagatcttcgtgcgctgtgagcaaggatcagggaaccggaagggcttggtttgatggcgagcggatgcgcggtgttaaactaagggatgacagggccttgtcagcaagggacctggagatattagaggggatgttacaaattcgtgctcttcaggatgcaggccgagtcttgttggatcggctcaaaaatgagaagcaagatacccatttccttgtccttcttctgcatctattccttggttaaatttgtcgccatccctgtgcctcagtttaccggattctcagatgactgtgatcataccagctgtgctttctcataatggtctctgaggactgagatcggcttagatgaaatatctgtgcagtcagctgtgtttctttggaacaattgtctccgtgaccggctgataacagtttgtgtcttttagcgctgtggatatgaatctttaactacattgctcctctctacctttgatgttcagcttctggtagttgccattccatgggatgaccataataatggcaacagagattttaaaaagcatttattgtgggtcaggcactgtattaagtgcataatatttaaattatttcatatcattgtcacagcagattgcaagatagatattatacagatggagtataaataacagcccagcttcacagatgaagaactgaggctcagaagcattgagtgttttcctttctctcattcccaaactcagatcctgttgatttgtctacgtatattgggaatatgcccactttttttttttttcatctccactaccttggaccaagctaccattatctttttaatagactgttggaatagcctattgattggcctacactcactctacaccctaacttaactcttcttccaccttctctcccttccctcaactaccattctcttctgcacaccatagagtaagatcttcgtgaaatgcaaatataattatgtccctttcctttctccttactctgccaaccacctgtttaaaaatattccatggctttctgttgctcttaggataaaggcaaaacttcacattgcctacaagatcctgcatgatctggaccctacctgctttcacaaccccattggatatgacactctgctctctgcctaccagtcactttggccttcttaaaagtcactcttcactatactttatcgggcttcagggcctttgcacatgtcatttgctgcctactctatgttaggcaaatattggcagtgaataacagtgttaaataacgtagacacagttcttgctttcatagaatttcatcttacacgtgagtctgtttagggcaatacacctaaggatttaaaatataaaatctgctctatattgacctgagttattgcagtatttcgtaagggaccagaagttttcatgcttgagtctgcatatgatgtggataatatattaaagataagcacaaagagggcgacccttctgctttagtctacacagtgcaaagaaacaaatgtcacctcatggtgttgtgcatgatgtctttctcatctttcaggtttatttttaaagtatttcatttattctgtgaagatttgttgagcacctattatttgccataagttgggattataattttggctgaaatagaatcactgcaccaaagaagctcttactctattgaaaccataaccattgcctgtgagggagttactagtgtcatccatattttagagatttagaaactgagacttgtaggtaaatcgtgacttgcccaaggccacttggttgctaggtgaaactagtgctctgagccaggtcttctgactccaaattcaaggcttttcccattttctgcttgtgaaacatgttgaattagtagagcaaattgtcttccttttttctttaaaaaattggctgttcatttaaaatttgtttgcttaatattatttgttagaacaaagtataagtagttgttttaaatcttaaatgtaaagtgtccaatggctcatgaattatcttctctttttctaatcaattttattgaggtataatttacatacagtcatttgcaaccatttttgtgtacaatttgatgccttttgacaaatgtatatacctgcaaaaccaccacagttggcatagcgaacatttctctcctaagttccctctcgttaatttgtggttagtctgtccctccaccttggcccccaaacaaccactgatatgttttttgtctctgtagatgcatctgtattttctagatttcatataaatggaagcatacagtgtatacttttgggtctttttttcattcagcgtaatgatttttttttcaaaatagagatggtgtcttgctgtgttgcccaagttggtctggaactcctgggctgaagccgtcctcctgcctctgctacccaaagtactgggattataggcgtgagccactgtgcctggccagcataatggtttttgagattaatccatgttgttgtatgtatccataatttgttcctttttatcgcaaattagtggcccactgtatggagataccacatgttgtttattcattcacttgttgctggacattaggattgtttctggttttggactcttatgaaaaaagctgtttttaccattcatgtatgagtctttccattttcatttctgtcaaaaaaagctgctatgaccattcacctaagagtctttacatttttatttctgtcgggtaatgcccaggagtagaattgcttagttataggggagttctttgtttaaccttatgaagaaattaccagttttccgaagtgatttgaccatttgttttagtttcttatggctgctgcaacaagttaccacaaacttggtggcttaaaacaacagaaatttattatcttacagttctggagatgaggcattgaaatcaaggcatcaatagggccatactccctttgaaggactctaggggaaactccttccttgcctcttccagcttctagtgtccctggtgttccttggcttgtggtagcatcacttcataacttctctgcttccatcttcacatggccttctctctgtttctgtgtctcaaatctctctctcctttctgttaaaaggatgccagtcattggattaggacccgtcctaaatccaggatgatcctgagatccttaagagcctcaacttaattacatttgcaaggacactttttccaaataaggttacattcacacgtgccgggtttttggattcggacatatctttttggggaacaatattcaaatgcactgcacccttttacattcctaccaactgttagtaggaatgtaaaatgagagttctacttgtttcatatcttttcatcgcttgtcagtcttttacattttaaccattctagtaggtgtgcagtgatatttgattttaatttgcatttcagtgatgactaatgaggttgcatatctctctttttgtaaatctttattgagtgaggtataatttacataccataaaattcacctgttttcagtgtaggactcaatggttggtagcatatttgcagagtcgtgtaactgtcaccaccgtcttattttagaacagttccattccagaagaaactttgtattcatttgcagttatttctcaattctacttcctccctagggaaccacgaatctactctgttctttagatttgccttttctggacatttttatatagatggactcatacaatatgtggtcttctttcacccaggatgtttttgaggttcatccatgttgtagcatatattggtactttgttcctttttattacacagtggatagaattccagtgtcaggccgagcatggtggctcatgcctgtaatcccagcactttgggaggccaaggcaggtggatcacctgaggtcaggataacttagatcaagaccagcctggccaacatggtgaaaccctgtctctactaaaaatactaaaattagccaggagtggtggcacatgcctgtaattctagctactcgggaggctgaggcatgagaatcacctaacctggaaggcagaggttgcagagagcccagattgtgccactgcattccagcctgggtgacagagtgagactgtgtctcaaaaaaaaaaaaagaattccagtgtcaggatataccatattttgtttatctgttcaccagttgatggacatttgatttgtttctacattttgactattatggaaaatgctactgtgaacatttgcaccctagtttttgtgtggacgtgttttcattcctctttggtagatacttaggagtggaattacaggacttatggtaaatctatgtttaacattttaagaaactgacaaactgtttacttgtgtggctacaccattttacatttcccatcagccattttgagggttacaattttgtcacatccttgtcaacacttgttgttgtctgtcttttctattgtagccgttatagtgggtgtgaagtagtatctcattgtggtttgatttgcatttctctgatgggtaataatgttatgcatcttctcatgtgcttattggacatgtgtatatcttcttttgtgaagtgtctgttcaaaatctttgcccatttttttgttggattgtttgtgttcctattattaagttttatgagttctttatattttctagatataaatcctttgtttactatgtgtgttgcaaacattatcttccattcatctaggttacttaatagtttttaagaaaggtccactttatcaatgtttatttttatgattcatgctttttgtgtcatatctatgcagtctttatcccaaagtcacaaagatttcttttttgctttttaaattaaactttgtcatccccataatgggcacttagtttttatttttcttttctctttgaaataacttagatcatattttctctcttgtgattgcttatgctatggacttttatgctgtttccaagtctggagggtgaataagaaggttggaccacatagctttctacgattaacatttatttaatttgtgttaagcacatgagaatactatacggtattcatgcatttttaaaatgaacttttcttctaaggcatataatagaacagtccagataagtatttgatggtttgagttagaaccatggcgtctactatttccttactgtagggataggggattcataccccgtgcctcagtttctccagtcattaatgaggttaagaatagctgcttctgtgggttggtgtgaggacccagtgtgatgaggtctagctactattccaggggtagagtagcatgcccttgattgagtttggtggcctgaggggtcctctgctggggtggggctggccctatgcattttttcccagatgttataatttattattttgaaatgatttaaaacttattgaagagcaagagtagaacctagagctctcatagacctgtttgtccatattcacaggttaacatcttgctgtgttcactttattgctctctttctcgccatatatatccacatgaacaatttttttaatgaaccattgcagagtaagtcggagacatcagtcctctttacccctaaatagttcagcatatatttcctaagaacatggacattctcttgcatacaaatataaacacaatcaattgttaatttcagaaaaagttaacattgatataatgctattatttcatccaaagtccatattcaaattttgctaattgtcctaataatgaattttatagcatttttttcctggtccaggttccatctggattgcatattacctttcattgtcaggtccctttggtctcttctcctttaatctggtgtcctttcatgtcctttaaattggttcctcatcctttttctttcaagacattgacatttgtgatgtgtgcaagctatcttttatttatttatttatttatttatttaatttttttgtagaatggccctgtattcttatttgtcttatgtttccttatgattagattcagattttgcctttttttttttttttttgagaccaagtctcgctctgttgcccaggctggagtgcagtggcgcgatctcagctcactgcaacctccacctcccgagttcaagcgattcttctgcctcagcctcctgagtagctcagactacagacacgtgccaccacacccagctaatttttgtatttttagtagagatgggtttcaccatgttggccagcctgatctcgaactcctgacctcgtgattcacctgcctcggcctcccaaagcgttgggattacaggcgtgagccaccgtgcgcagcccagattttgcatttttgcatgtatatttttgaggaaagatggggcctctagaggtcacatatttataatccacatatgcctcctggctgtaggtaagttttatttggcccaaacaaactaaaagttgtttcagaattattttctaatatttaaaagttgagggatttcacataaagatctgggtgtctgactctcttgaaaaacttaagtatctggtaacagtgggcatgcattttcctaactagaattgaatagtggcttcccttttaggtgggaaatgtgctttccattttgctgtcatccagttttgccccttaagttacaatatagtggtgtagtgtggagctttagatgcagactcctgagattgaattctgctccctcatttacttgcgcaagcaatttaacttctctgagcctccatttcctcatctatcaaataggagtgatatggttctggtagggattgagatattatatagcacataaaacattgctggcatacagtaaaaataaacattgttatcatcatcattatcaccatcatcaccaccaccttcactactgcctatctgaccccagtagatatatattctgtatgtatatatatatatatgtattctgatcccaggacgtttattctgtaaacttatgttgagtgtctagtcaagtggattttctcaaatggggttccattaacttatttcccatgcagccagaatggtactagttttgtaccacctttcagaaaattgagaatatagtcactcaaaccattttctgtgttctgtggttcagataaggaacctgattaagtgtcgagtagtgtactcagcaccagggtaaagatggcagacacagtcccatggaactggctggctgtccatggaaggtaagtaagtaccaacagcagagtggtgagttttatcacgggaggacacggtagcaaagaggatctaacatggcctagtagtcatggaattccttccttagaagatctgtttaaaggtgtatccttatgagaggcctgggattccttacggggtttttcagaaacattaaaactgtttcattagtcatggaataaaaagctatggatgttgaaatccaagttagcttcaaagactcttatgctggcttaggttagataatcttttaaactattaaaaatagaactagtttattatggaaatggttatatacctaagaacatttaataattttgtttgagtaatgtacatttttatcaatgaaggaaaatatccagaatatgtaacctaccgttttaagtaacatgatttaaaaactcttctgcttttggtgatagttgtcttatcaactttaaatgataaggtttattgagttataaaaataataacttggccaaatgcagtggcttatacctgtaatcccaatgctttgtgaggccaaggtggaggaggctcacttgagaccaggagttggaggttacagtgagctgtgattatgccactgcactccaggctgggcaacagagtgagaccctgtctctaaataataataacaataactcaacaaaagaaagtttgttatttatgtttttactgactgggtatttttaccttattttatatttcaaatttggcattttattgaggtcctgagaaggttcttttggagtctacttttattatgggccattctagattatgtcaccagtttatctaaagtggacactaaatataggacagttttggtgttaggccaaagaccaggggacttgaaaaatgaaaacctcacctgacagattctactctgttttttttccttcttcccgaaatccattattattttttgcttaatctctccttcaatatatgggtaagcctttaatcactgtttcggaggtttagttgacttctgtaaatagaagaagagttagtgtatttgatcatagtttccaaaccacttttaatactgtaccttacttgaaaattaaccagctaaactatcgagtaacagtgagttcttgttgctttctgttatttccaggctgtttcctaaccctcctagtactggttttgaaaactaaattagccattcaaaaaaactcttagacactttgagcaaacagtagcttccttgaagatagcatttgtgtctaattcatcttttcatctctccattgtacctggcaggatgtcttccacaaaggagacattaataagtatctggtgaagaaagattaaatggttgagagagtccagcatctgttatgtgatatatgtgacccttcataattatgattctggatccttggctgctaatgagatttactgtggctgagtttagtgatacagattttggcatgtagatgatagtctccaaaaaagtagagatcatgtttttttttttttttccgttttgtcattcaccattttatccctagcccttaagattttgccagacacatggtagatattccatacttgtcaaacaatgaatgaatgaattcccaagagcatcacttgttattggtcagtagactttctaatagtgagagatggaaccggaatttgaaagaagtaatggaaaatggttaagtaccttatgaattttaaattaatataccataggtgtgggcattaattttgagaaacaagactcttctgttcaacacatactttagcaactgtcaacacttgttttcaagtgttctcttccaattttaaaatgccagtttacctttcagatttagagtattttgttgttgttagtttattatggcagttttcttgctaaagttatatttaaagtgtgactttctaacttctagaggagaggaacttttgttaaggtggtacttttggaaccttaatgaaaaacacaccttagagaaggtgaatttagagttctgctaagcacattcatttactcttctattataaactggttttgtaatattttataaaattgtctcactggttgatttcacaatgtaaactgggaggattcttaggattccttgggttggattagaacaggttcaagagatgaagatttgtgttggtaggggcttgtttccaaacgtttgtccttggcatgctctttgttaagccatcacatgtttgaaagttaaaccttgaattggtgccatggtttgcatttaaaaaaatgtattttattatggtaagaacacaacataagatctactctcttaccacatttttaagtgtacaataaagtattgtaaactgtaggtacaatgttgtatagcagatctctggcactgattcatcttgtataattgaaactttatgccgcttgattagctctttcccatcctcccagccctggtcatcatctttctactctctgattctatgagtttgactattagacgtacatttttgtttttgctataagcatctgtcctgttgctatgctgatcatttatttactctgtagttttggaaatgacctgcttacaagataaccatgcctccccttatgttaaaaaactgccatatggataaagggcagttaagacctttacaactggtagaaaccaagtagaaaattcagtttgaaggaccaaattatgttgcagctgctctgaggaggagatttgttgccagagcatgagtgttttcataattgtttgtgatcagaaaattcagagctctgatttctgcattagccctaagtctgccctttggcaccttcatttagtgattggatcattcaaggctgagcctcaagggccagcatttctccagtaataatataaaatgggctgatgttgcaaccttaactcactctgctgaattgggcatgattaaagtctcaaggctgcattaatatggattttctatttctatgtacagccgtccattatctcactattttccagtttgccattttttgaaaacaaagatggaaaattctgctgatgaaattttttttttgtctgtcagcacaacagcattttttgggcttaagaatatgagaatagcaccgggcaaatgaatgcaaacattacagtttatgtggactctagcctgttgtcatgtcaatcttgttatttaggtaaatagtgtgcaatttttcaccaaatcagcagccaatatgctgcgagccatttttgttttagttacattattggctggtaacactattaatgagacaataattgggaaatagtagtcattgttctcataaaacacgatccttgtgttggaaccacagccaggcagaggagttgcatatgcagactgcaagggaggaaaggatgagtagccagtgttcccagcttttaaaatcatcagacccctgctgcttaaattgccccagctgttaatgctggaaccattacagtaatggactcagcaaatgaaggagaacgaagacacgcacactttattaccagaggggcaattttctcttcatatgtaatagcagcggtgcctcatattgatcagaccatcaagatactaatcctctgtaaaattactttttataactgaaaatgtgttaatccaaatcagtctgtgtcctgactgtctacttactattgaatacggactattagatgctttatttttcatgatttaaaggctttgccctgaaaatggttggcttttcccttgcaacactgagtgcttaatcttagctatagcccagggttgtctttttgttttaaacagaacatcacccacttaattaaggagtgagtgtctgtcttgctgagttatgctggtgttttatgttcctctggatttattaagcatcttgttttacattcagtctgcggtttgtgctgtaaataaaaataggcccatcttgcacatattagaaatttgcaggtagcaaatgtcaataagtaccagggatgtaaggttctttgatttatacttcaggcaccaggttgtggtttgtcgattgaacccataggcaggatgcatcttggtgtcttctgtggagcagatgtgtttttgcatcgttgtctgagaaagtttatgtttatttctgcatccttggttcagtagattgcttttcagacaatgaggcatatccgctccgcctcttatgtcttgtgagaaatgactacagctaaacattattatgagaagacccattaaaaactgatttctatcttcctgaatatttggaattttgggaactttgtaaaattcccatttttttcattataatctctttccacataccttatatgtttatttgtatatagactcaggtgccctcttggcagtatatttattctaatatgttgttatagctgaaagcatttgtgtgacattctctgtagagttcattcagaaatacttaattagtgtaccctttgtgtaccaggacttggattacaggctggagacttgaggaagtgtaagatataatctttgctattgaggacctcagtttaggaggaagacaggcatgtaaacaaataattataataatgcagtatagtaaatactagtctactgtgaatgtgtacttcttgggagcatgggcgcaatagtaaaatcagcctcattggttttttttgctgtgttatcaaaagcagaattctgacatccactttgagacttgtttctgaatgactcgtagctgtttgaaagaaatctcttccttcctcactggagacatgtttaccaccctagggggatagtcaaaggaaagttttccaaaaatgttttgatcaatgatcacatctttggatatgtatagagtttcccaaggaggctacttgaaaggagatagtgcttatgttgtttatgttctggcatttatgtataaatcagtcttattgctttagagtatagtttatgaggagaaactgtagcctgtggtggttaagaacgtggaatcctttagctctatttactggctgagtgatcttgggcaagtcacctattctccttgagcctcaatcttcatctgtaaaatggggatcataatagttgtgaagattaaatgatttaatatatgtaaagcatttagaatattgttggggtaagtgctatataaggttattattattatgcgtgtgactattaatgaaattatttttcatatgtagcttatgaaagtcagcttcgtaaatatagaaccacactgtatatataagtatatggtatgtgagatagagaagcatttcttaaatttcttaatgaaattttttttctgattacataataattttttattttagaaaaactaacaaatatggaaaaatatgaggcagaaaaaagtctcatactcttcagagataaatactgttactttatattagtgtattgcttagaatattgttattatgcttatatataatatatacagtatgactaattttaaatatatttatgatctatatttatataagatatattttaaacaaaaattagaaagataacttgcatattttttactctgcttttttttaccatccagtatattatatttttttcatataattccaattgtatagtattttatggatttttttccatcctatcataggttatcctttagtgaacattcttgtacataaatctctgcaaatctttggaatgtttcatagggtaaattaaaaggagaattgtatgggctaacttttgttaagatttttggttctcattgtcaagttgccacctggggaggtaatgccagtttccaatttaaagaagcaatatgtcagaatgcttattggtacatccactctaacactgggaattatcagaaaacaaaaatgtttgctgatttggaggagaagtaggaacttgtagaactaatttgtattttcctaattattatatttggttgaatttcctcccaccatttatattggccaaatatagttcttttgtgatttgtttattcatataggctttgttcattttgctaacgtgttcgtcttttcttactgatttggaaaaatattttgtagattagggatgttatttactaatcatgtgatagaaatatttttccagtttgtttattgcctgacttttatatttttgttattcaaaagttttcctttgtttttaattagaaaaacattttccctgtcagtattagattaacagtcatgcattcttctggttattaatattttatgtttttttcatgtaattgttaaaatgtgtctagaatttagttggtgttatggtatggagtagatgtggaaatttttcttccccaaggccaatcagatatcgctgcctgcatttattgacttatcttttacgtactgatttgaatgcttaaataatcagatctgctttttatcctgtttgtttttactttgacacatcattttaattgccatcgatttataatatctttctaaatttggcagcatgaggcccctataattagtctttactttcaaaaattctgtggctcatctcttgctttgagaagacaacctaaattttttcccaggtaaatttaaaaatcaccttttcaaggtcccccatgtgccccaccagtcttttggtattttaattgttattgcattaaatttatacattaatttggaaataactgaaatatttgtggtaaatcatttttctcattcaataattatctgtctctacatttatttaagttttatgatcttcagaaagctttgtaattttgttcaattgggcaccatttattactttatgtaaaatacgtgggtattttatatttttgattactattttttggttactattgaaaatgggatatttaaaaattgtgttttttaaatgatacttaagaaagttttttatgtgtttgctatttttgtatttggccacaatacagaatgcattcttatcattctaatagttttggatgattttcttgggttttctggatatttacgaggttgataatctacttatctgcaaatataatttgttttttcctctttcagtaattatactctcctctcctttttttttcttctattattaccttgtctagaacctccagttggtagtggttatagcagatagtcatgtcttcaacagttatacttcgggattctagtattaagtaaagtggtagttgttggcagttatctttgattcttactttgtttttttcagggactgaggttgaattttattgaattttaggaacattttttggacatctctttagatggtagtatctttacttctactgataaaatgtaatttattagactttctaataatggttccttgggataaagcctacttggttatattatataggtcttttaatatattgctgaattcaacattttagtatatttcaattaggaaagtaagatgggtcagtatcagggattcttatggaaaccgcagagtggtactccaggggttgagggtatatcagaatctttgaatggggcatatataacatacatgttgaacataattcaagctacagtttgtaaagcctaataaagcatttttggctgatggggataagatcacagtagaagaaggtaaagtgaataaaaatattgagaaactcctttttgtgctttcttttgtcaaatttggtatcgtattatgctagtatcataaaatgacttgcagagttttcctcctccctgtcttcttgggaaccatttacaaagcattaggattatttgcctgttggaagtttgaactttacttcttcttcttctttttcttcttcttcttttttttttttttttttttttgagcagagtcttgctgtgtcacccaggctcactgcagcctctgcctcccgggctcaaacagttctcctgcttcagccccccgagtagctgggattacaggcgtgcaccaccatgcctggctattgtctatttagttttcttcttgagtaaattttggtcattatatcttagaatgggagagttttacatttattgacatggcattgagcataacattctctggtttactagggtagaattgtgtatagttttataatttaaaaaattccatattcactttttccatcttcttttaaattataactttgtacattcttgtcttctctttaaaaattgactatatttgctggtagtctgttttttttttttttttttaaacaagctcttgaatttgtttatgctctaattcattaatttctacctttgtttttattgttttctttgtcctgcattgcctaagcttcttttggcaacatcttgagatgaatgcttacttattcatttttattcttttttgtttaatatggaaagtatttcaaaatcttaaaatagttttatctttttggtttctgtagcaatttgtgcatgtttttgtagcacttattcagtattctaatgatttttttcattttctttctcataccttagttatatagactatactttatttttctttgtaccccaatgtccgcagagtcttgaacacaataggtactgaactaatgtttcctaaatgaataccctgaattcccccattcccctttcactccacacaaatagtaagtagcctgctatagttagtggaagtttagctctccaactaccagtgcacatcactggtggttggagggctaaacttgtagtctcacattccaactaccagtgcacatcactagtagttggaaggctaaacttggagtttcacatatgccacttactacgtattaccttgtatgagtcctccaatctctgtgatgtttcatctgtaaaatggggataataactcccttccctgcttcatctgagatgtcatcaataagataataaatgtaaaagaactttgaatactaacaatgttatgtagatataaatatgatttaaaataggtttttagcattcttatctcatccaccacttctccccctccccaccatgtagaaattatcaagttcttaggaacagaaacttattttgaaatagacaatattgtacatattcatggagtacatagtgatgttttgatacatatcgtgtatagtgataagatcaggataattagcattttaatcatctcaaacatttattatttctttgtattaggaacacagaaacttaaaaagatatatatatatcttttatatatataaaatatatatatatcttttatatatatataaaagatatatatatatctgtgtcttccgaagtatctagcacagaactttgttgacagatatacagtaaatatttgttgactggatgttttctgagatgtacttttctttttctttttctttttttctttgagacagagtcctgggtcctgctctgtcacccaggctggagtacagtggcacagtcataacttactgcagcctcgacctcctaggctcaagcagtcctcccaccccaggctcctcagtagctgagactacaggtttgtgccaccaagcctggctaatttttgtacattttgtagagactgggtctcactatgttgctcaggctggtttcaaacccttgggctcaagctatctgcctgccttggtctcccaaagtcctaggattacaggtatgagccactgcacctggcctgagacctacttttcaaacatgaagtactaagtgatcctcaattggaccaagacttaggagccctgccccaatcacgttgcttctcccagtttactcggggtgacctagacagctacatcaacacacagtctggtgaaatgcacatgcgtaacttgaggatgtcaaccttttggcacagtctcatttcctctgcagaagagcggctagagacattatactctgttcccgaagtatatagactaataaaatagtggagttgatttagattgataacaaattataaaattgataaaaaatattttctatttttataccatttagaacagctattaatatttttaaaatttttttctcaattggatgaaaaataaatgtatgattattccttccctttcaattgcagttacattacattttcattgtttctcttgcactgagatttattttttatttttagtttattttgttcattgctatggaagggtgataattgtatcaagtaagtctcttttacttacctgagagttcccatgttctttggggaaataaatgtcatcatataagtcagtcttaggttaacaggttgttttaaaattgctaaccactatccaaatgcagagtgatagtattttctgggtaggtatttcatactctcttttcgaatattggtcaccgaaggatttcacaaaccactgacatttcagcattatgacagtgcaatgtgctcctgtcaccctctgaccccatattttttttaaaccattcatttcaatcggaaaaagtataattttttgaaaaaacagagatacttaccctttgcgctgcttttaaagattactgggagacttcatatctcagataattgatggtaaattctgcttggttgtttataagctcaaactttggagatctacaaaaagagtttcatctgagaaataaaaactattttaatgattgtatgatccaccagactgtgaggtcttttcttcagtccctcctctttcatgaagcgtttgaggattattccattcatctctttccttaccgactttatttcctgtgtcaaaaagtatgatactaacggtaagtttgtgtatggtacatttactggtgtatggtaccgtatgtggttgacgttaggtcatattaaattttacattttgagattgcttatacatagtagtgttttatacacagtaattctcttttccctatggggattataagatccctctggctgacaacactgctataaatttgttttttgtgtctagtaagatgctacaaatgtggttgactctcagcatttcttgtcaaatggaaacatgtatagattggaagttaagctttttgttttttgtttttttttactttactgaacagttatttaaccttaactcttaatctgctctccatcaccagtagaaaatattttgtttagaaaatgttttgtgtaggctaggtgtggtgactcacgcctgtagtcccagcactttgggaggacgaggcaggtggatcacaagatcatgagtttgagaccagcctggccaacatggtgaaaccccgtctctactaaagatacaaaaaattagccgggtgtggtggtgtgtgcttataataccagctactcgggaagctgaggcgggagaatcgcttgaacccgggaggcggaggttgtagtgagctgaggttgcaccactgcactccagcctggatgacagggtgagacgccacctcaaaaaaaaaaaaaaatgttttgtgtaaaaccatatgacagaatagatctgaggaaactgcatttgtagccataggagaaatcatagattttggtggctctttacctatcactgtgttttttaaaagagttatgtctgaaccacctatgtgtcccgattcattttgccatttcatctactgctcttcctcctgtttttatttaagactatgaagttactttagtgtaactgctgctgtcacctttgcccttagctaatcaaatagtttaccttgagggaagcatttatctcccactttcattattattatttttgtagctgtaaagatatatattttatgtctgcagaaggctgtaacagtgaaacgaggtattgatctgctgtatttagcaatttctttccaccttgccatcaatagcatgtcagcatctgtctgtaccgtggttgacctcacaaatagctctttatgctcccattggattcaaatgatatagtatgctgaaaactaaatcaatgaatgattataaagtttttagtattatttcatgacctggaggcaactggtactccttgcactgacagttcagtgtacaatgaatatggtaaaatgagtgtgtctggcctttgttctactgaaaggaggaaaacgggtcacctggttgggtcagctcatacttctaatgatctcaaagcacttaggcacttcagttaaacatctcactttacagaatcaggcagagagaagagcaagactcctatttaactttattccccatgcctcatcacaagtatgtagcaaatgtttctaaaattatttgagctataatcatataggcttttgccttcatttataaaagaaagacaaaaacccaaaactagatgctttgtcactgtcaccaaggacctaacgaaaaggcacatggtggaaggagggagagtggtaacctaggtttaggtctaaggggactcttgcttgctgtcagcacctggtacaaataccaagatagggtttttggggccacattttccatttgagggagttcctactcacctccactgatctgtggaacactgaaatagcaggagtcactaatttgcctgcttttggatgttgctgaattcagcatcgtcttgaaaagttcttgccgaatcatacattcagatgaaagatgttttagatattaaacttgacatttgggatatatggaaagatagaaccaggtgatggtgggtgaacagggaaagtagaacccagcagttgtcatcctgatcttttgaggatatgaatcaaatctatttatttctaagaaatgccatcctgatgtactcctttgtccatcagcccagtaggaagtttgacaaggagtattggggagttcacatactaattcattccccagacatttgttggatgaataatgtctgaaaaatagggtatcttggctgtattccttacagatgacgggttatctcctttccccagggtcacttaaggaagagtggatgatagtgatcagagcttaaaggtgttggtctacaccagtgctgccacgaagtcaggagtttgagaccagtctatagtgctggtgtagaccaacacctgtatataatgtttattttcaagttcatttgtaccactaaatactgtctctgatgggggccactagggctctatttgtgattagaaatcctattgttgagaattattactgtgtcctgggttagagagaatagatatgagggctagctcctcctcttgaatgttcatgggaaactgtcatgcttggctttagcaaatccagaatgtgtctacctgccttttttggccaattgccattattccccccagtaagatatttgaataggggaaataatgggtggattttatgaccatttcatgtctggtcagtttcttttcctacatgaaaggatgaagtggggactcttcatgtaaagccacagagtcggaagccccgaggaagaaattcagcttggtcctctgaatctgggattgagaacaacaaactgaggcaccataccctctatttcctgtagtataggaaattgctgataattaataattttagcattgaacttattcaagtccagtaaaattttcttaggatctgctcagggatctgcctctcctaaattcttgggttacttttgttattcattatggatatgtgactgattaatcagctaagctgtttttgaagtcattttaacttttgttctgtattatcctttaggaatatgagtaccattagtactttgtgatgtctacaggagtacttccttttcatttgtcctgtggtgtctgaaggagaactttcttttatctttcctgtattagttcacgttatactgtgaggtttgcaactcaggtctaaatacaggatttgggaaagatgttcctgtctctcaattcagtctttgtgattttatgtacatatatgcctgaatattagataaggaattttcccactcagattatgctgctggaaagagaagtcacttcatattcaaatctttctcaagtcttttgtattgtagaatgatcttcattgtgaacggcattatttggtcagctatccaaatagtatgtgagtgtgtacttatggcttggaatatttttctggatcaaaactatatgtagtaatctggatttatgcaccataatttctattttttgcctaagagtggaaggttgctacatgctcatatagtacttaaaataatttatgttttgctgtctgcagatatatattagaaactagctatattcttgttggtagagaatagggcaattagttgacctttgttcatataagctttgatagtgggatgtcttggctttgttccttgtagatgatgggttatttcctctccccaggctcacttaaggatgggtgggtggtagtgatcaggaattaaagagtgactagtgttgcctctggtgtagacccacacttttatataaaatcattttcaagttcaaacctctaaaggctgtgtctgatgagggccacttaaggctctgtttcttagaaatcctattgttgatgaaaaggctgtaagaagacctgtccaacttaattcttgatcctagctagtcacttaatgacaatcatgtggcctgtaaatgagataagacatttctttttactcaattaagataaagaagaaacctctttacaggttatatgttaatgcacacacatcttaatacaatcatgtatttctactacatagaaaagcaataagagcccgaacttagaattgtataaggaggtatttgtgtcatatactggactctgaatcatttgtggactacgattttataaacactctaaaaaaatataaaacgtgtcgatgaactactgtgtacctaaagttacattatttttcattaaataaaattctatatacacacactaatattcacagttctcataatagtatggttatattatgttgaaactcgtccttcttaaagattattttgttttgtagacatgtaggaactttcctagaaaatctgtatccagtttttttctgtgccattttgaattagaaactccctaaagaagaataaattaactttgcattttctttcatttttttaggatctgagaatgtgtatgtgtctgaggctacctctgtgtctaaaagcagagcatgcttaaaaccatggctgaggagttatgcttaacggtatactttgcatgcatttgtgatttgaaataggaaaaaaagtcaaatttgagacagcttgaatggcatgctgtcagtttggagcttcatgaattggcaatggtctcatttaggaccttcagatgtgtctctgcctggacagaatgagaacattttgcatgttcagaaggagacagccactccttgctgcttcacaataggcagtggtgcatgacagttgcccttcattgctggcttcttggagcttaacctctgaccctccacttagtcactgtgcagcagttggagcaggttggagatgttggtgaatgacaggcattggcctgcaacatgcttgtcattatttgactgtcaaaaggagcctgccattggtttccatcaaggtttgaaacctctgtgcagcagtccatattacttaacttccaaggctgtcaacaggatgatcaaatgtgcataaaaaaatcagagtgctgaatatatcttcaatcaggagaaagaagtttcccctcttcttttctttctttctttctctctttctctttttatttttcttttggctaaatatattcagatgactttcacagggccaagaggttgaatctgttgctccagtgagaaaagtgaactgttgtctcaagtggtctaagtttcaaatagcacaatttaaatctgagcagctctgctggctaaattctctgacttgtctggcatattctatcagctttcagctgttagtttaagggactagatgctagtccagtggtgcctggtgttagctcacaggataaaacgtttactttggtctctatgtagtgttgcaaagggatgcagacgtctgtgtatgtgactgcgaatgaaagggatgattttggatgtatgattactatctcatttaagactcttttttccacatggtagggttcaaactggaattttaagtgatctgatcaagtcttagaaacttaacaggtcagtcttatgcaatttattttttagacatagaaaaatatgacagcaaaagccattttttttcttgtaaatttgaaactttggtttgaaaagcatcttgaagtggaagaggatgaacctaacagtattctggaagtgtatggaaagtgttggtttgcttctaacattgtgcagtggatggtgtgggagtcacgagacctgagttttagttttgcttctgccattttccagcagtgtcactgtgtgtaagtcactgaaccccttagtctcagttcttcatatggaaaaatagagatactaatatggtgaggatggaaggaggtactgtttgtaaagtacttgcttttgttaagtactgtagtcactcagtaggcattccctgatctcctttttatccttttcttttacatccagtgttagcaggaaagacatcaaacagtagtaaggggccaggtacagtggttcatgcctgtaattccagtgctttggggggctgaggtgggaggatttgaggctggaagttctacaccagcctgggtaacatagtgagaccctgtctctacatgaaattaaaaaattagtcaggtgtggtggtgtgcacctgtagtcctagctacttgggaggctgaggcagggggatcccttgagcccaggagtttgaggttacagtgagctatgatcacgccattgcactccagcctgggcaacagtgctagaccctgtctcttaaaaaaaaaagtcagaagacaatacttgagctgaataaacattccagagcctgacacagtcaatcgttgtgttccaactcttttcttctcccatagttctgattcttgcttatgacatcacgttttagtcaagcactcaaactaccaatctgagtaggctgcctgccttccttttttctccttcccttccttccattcattcattcactcaacagatatttatagagctcctactatgtgccaggccctggtctaagttctaggatacagccatgaactagataggtatcatttggctatcattaggtatctggagagagagacaaaaaataaacaaacaaataatgactttttgatagttctaaatactattaaaaaattagtgtaagaggataaagagttattttggttggtcacagaagagctttcactgtagagttctttccagcagagaactgtttgaaggaaggagagggccctgggaagatggggacagtcttccagacaaaaggggaccatacttcttttttttttttttttgtcagggagtctcgctctgtcacccagactgaagtgcagtggtgtgatcttggcttatagcaacatctgcctcctgggttcaagtgattctcctgcctcagcctccaagtagctgggactacagatgcccaccatcatgactggtttttttttttgtatttttagtagagacagggtttcaccatgttggccaggctggtctcgaactcccgacctcaagtgatccgcccaccttggcctcccaaagtgctaggattacaggtgtgagccactgtgcctggccaggaggctgcacttctgtctcctgctcctcatccagttagtcacctttgtcctaatgtctttccttctttcatctcttcatcttcaggccactgctgtgttcagcccctttagatttccgtaggctcttggcctgtttccattccacccacttctaccttgccatcttaaaaaatgtaaaatgggccaggagccgtggctcatgcctgtaatcctagcactttgggaggccgaggtgggcagatcacaaggtcaggagatggagaccatcctggccaacatggtgaaaccctgtctgtattaaaatacaaaaaattagctgggcttggtggtgcgtgcctgtattctagctactcgggaggcagaggcaggcttgaacctgggaggtggagatctcgccactgcactccagcctgcgtgacagactgagactccgtatcggggggaaaaaaaaagtaaaatgaccgtgtcactccactgttcacaatttcgtggagatttgccactggctgcatgttaaaattcagactcctgggcttgctgtataggttcctgttttttcagccttatttattgtcagctggtaaccacgcccccaacccccagctttcacccccataatttataccttatactcctactgttggaaagtggtgacccctgaacatatgcctctgtccttttctctttctagactcttctcctcccttctcattggcacctagagaatgatgtatctttcaacaatgtccacaaatgccacctcttctgagacttctgtgattctgccatcctcaatgttgtgtacacttccttagctttcccctcactatagctgtttgtccattactttctcagtccctgagctctttgaaggcaagaactgcgcttttattcctctcttgtaattgcaatatctggctgagtgtctggcatacaacaagcactttataaactgtcacctgtgatagcctaatctttagaaatatttagggatagatttatcatggacttcaaatgtagatataatcagattggacagtatacattttgaagagctcttcagtcaaaatattccatgattgatagagagacttctttccttaggcctaatttaaataaatatcatattgaaaggagagtgatgcatgaaaacattagaaactaatagaaatattatatatactaacttcccaagaacaccaggatatagtgtcactgagcaagttagcttcagataaacttttatgttgctttttttttctataatccaacatgtgatgtatcttttttcaaagaagatagtattaaattttgtatttcaattcagtaagtaaatttcatattttttctatccatccatttatctctacatttttccaattatactgtatagcattgtcatgattttttttgtagttttcattattttagaaggcttttttttttgagacagggtctcactctccttgcctaggctgaagtgcagtggcacgatcatggctcactgcagcctcaacttcccaggctcaggtgatcctcccaacacagcctcgtgagtagctgggactacaggtgtgcaccaccatgcccggctaattttttgtatttttagtagagacttggtttcgctattattgcccaggttggtcttgaactcctgggctcaagcgatctgcctgccttggcctcccaaagtgcttggattacaggcatgagccaccgagcccagcctattagaagcaatttaatgccaaaccacagtagatttgtcatatgaatagaataatttatttaaatagtttcctctattgttgaccaattagcttgtttcatttattttatcagcataaataatgctgtgttgagtcagtgggtttaaacatttgtatgtgcatttttaaatgaataaattcctagaaacagaacaacggagttaaagatagggattttttaaggctcttgatgcatattgccaagttgccttatggaaaaggtgtccagatgtttgtagagataggttgtaaaaaggatcctgcattagaatgtgtttcttagattacttgtatgtgaatttgggatctaactgggaattttatatttgagaggacattggagagttcagtaatgggcataaagagaagaaagagatagaaggaaaggaagaacaaaatctagttttgaacttctcaaatggtgtgtaggctgtggtttagtgattttcagactgtgtcctggctacctatagggatctgcttctccaggtgggggcctgagaacagcttagcttctgttgatgtatttgtttatacttttggataaaagttccttcatattaatacttccaaatttgaaaagtttgaaagccacttggtaggtctctatgtttactactatcattttcagacacatgattcaaaagggaattatcttgttcatgcctctgttgtttgagatgtcagcctcctagttcattgttaccttctttttttaaaatttaatttaatttaatttaaattttttgacatggagtctcactctgtagcccaggctggagtgcggtggcatatcggctcactgcaacctccgcctgccgggttcaagtgattctcatgcctcagcctcccgagtagctgggactacaggactacaggcctgcgccaccacgcccaactaatgtttgtactttttttttttttttttgagacggagtctccctcttttgcccaggctggactgcagtggcactatctcggctcactgcaagctcctcctcctgggttcacgccattctcctgcctcagcctcccgagtagctgggactacaggctgtttgtactttttgtagagacagggtttcaccatgttggcccggctggtctcaaactcctaaccttagataaaccgcccacctcggcctcccaaagtgctgggattacaggcgtgagccaccgcgccccagccctcattgtggccttatttttttttttttttttttttttttgagacggagtctcgctctgtcgcccaggctggagtgcagtggtgcgatcccggctcactgcaagctctgcctccgggcttcatgccattctcctgcctcagcctcctgagtagctgggactacaggcgcccgccaccacgcccggctaatttctttttgtatttttagtagagacagggtttcaccatgttagccagcatggtctcgatctcctgacctcgtgatccacctgtgttggcctcccaaagtgctgggattacaagcatgagccaccatgcctggcccattgtggtcttcttaaaggaaccatgttgctaacccgaatgagagaggagtaacctcctgaattaggagttgttactgcactttacaaatatcctgttacctccttcacctctgtatggttaaggaaatgtggtatcaagtcactttccagttcctacttcagtgtgggaactgtgaagtatcttttaggcaaagtagaggttaaggcaccttaagggcaggaacttcttatcttgcttttattagcagtcgtgtcaacatgcactaaaatgtgatgacccactttcccttctgataaaaggagaatgacctgcttggcatggatggagagaggtgcctgaggcagattacattgttaccgctcataataacagtaggcataaaggaggggggtggtggaaaggccagcagatttctgtttacccatggaaatgtttgacgtttttggcttctgatgaaatgtgctaagaagagggggaaaaaggagcattgtagcaggggaaggaatgaatgagtaaggaaaagaaggaatctggcatcagggaaggaatgaatgagtaaggaaaaaagggaatctggtgtcatgtgagacatgtgaagccacgaagggccttaaatcccagccctgtagccatctattggcagagccttaagacctcaaaccatagagggagccccccttttctgtctttttaaatttaacctatatttgtttagagccaagatctctgacatggcttggctgacttttctaaagatgaactgaggccaggcacagtggctcacgcctgttatcccagcactttgggaggccgaggcgggaggatcacctgaggtcaggagttcgagactagcctgccaaacatggcgaaacccctgtctctactaaagatacgaaaaattagccaggtgtggtggtgggtgcctgtaatctcagctactcgggaggttgaggcatgagaatcacttgaacctgagaggcggaggttgcagtgagccgagatcgcacaactgcattccagcctgggtaacaagagcaaaactccgtctccaaaaaaagaaaaaataaaaaagaagaagaagatgagctgaatacagggcgacctgtacagttgataggctctgaggagatatcaacacggaaaattagggacgtaattacccactcctcaatgaaggaggattcttctcagttaagtttatttacttacttggctttgagaccagagtctgataactctgggaaaaagttgtagttattttgagatggtcgatataatttaaggcttttttaagagagtaattgtgtggtttaacctgtcatcttgaaatatgaattatacagagataacattaaaaaaggttatatgtgacatttctaggtgtctcagaaaaagatttgagtttgtctcatgtctaccatggcaacactcttgagttattataaagaacattatataaggatttcctctagaatttttaaatcttaaaatgtaacttactttagccagaataaaaagaggtttaaattaatggaaaactgactggaaggaagatataaaacaagaaacaataacacaacaaaacttcactaaagtacacaattctacaaattatgcacacaagcacacacattttacaaattgagggtatttgtagaaattcaactctcatttgaatcaactcatgacaaaacgtatttacaaagtaagtagaatggaaaagtaccaaaaaagcatttcttgggttaatggtattacccaggtcaaatccattaaggaaattctctgccagaccttttcttttttcttaagacatgaagttttgcacttgttagtataatttgggagtggtcaagaagctaggtgatagaacaacttcagattctggatttctggtctattatttggttttttttatgaataagagattcactcttttctttaaaggaagtaatttagattcctagcactgtcatttctgttctgaatgttataaactctctgtacaaaatttgaaaggaacagacatgctctgatgatgtacagaatcttaatgtttcaaaaacgatagttctcttcccctagaatagaaaagtatagcgttcacctgattgcagatcccaaatgtctacatctgtggttgggtggccaatatcacatgaaagagttttgtgcctttttgctcaatatataagtttgaaaaatgttggctgcaagtaacagaatttccatgtaacagtggattaaacagtaatgacatgacttttcccacatcataagctgtctggaaggaggaagttctcatggaacagtggcttaatgatacagtcaaatgcaggtactttccagttttctgctctgccattcttcagcacgttggctttttcgtcttttgacttgtaacctagtgatcactgggttataacagtgccaggtatcatgtcctcatgtaactgtgttcagggtaggaagaagaggatgggaagataaaagagagtttttatattaggagggaaatccttcctgtaagtcccctagcacactccttattatgtcctattggccagatctggatttgttggtcattcctagttgcaagggagactgggaaaagaagtgtctggcaaaagggaatgcgattcctacgcttggcttagagagctcatgatccattccttggaactgggctcatggctgcccctgttagcagggaagcagaatgaatagctgttgagtaggcagccaatggcttctgccatactcaattaatgtgtgactggaaatgagatttttatcttttgttccacactggccaagggatatggcctctgttaccatgtaatataaccctttgagacaaatacatttaagaccagaattggaactttgaattatccatccaatacatttaattagcactgacagtgttctaggttattgctagacacaggagatactgcagtgaataagatggacagtctctgaactcatagggttgatagtctagtaggactgagagattaggaagtagtttcagtagatatggggaaggcacagtttgctgtgcggtgaatgcaaatcagctaacatggactcggagagtcagggagggcctcttggaggaggctacatcctcgctgactccagagacacaggattcagctaatctcagaaaatgatgagttgatcaccctccttttttaggtattcttggaaatccaagcaaaaacaaatctgctcttaatgtggaaactgtggcaacttgagaattttatgtgcttcacggagtgagtaattccagcagcagctcaggaagcagcatagcagagtgtaaatggcattgtctttgaagcctagttggataagctttctgcctcaatctatctgtgtaaggaacagggtttctctgaaggtatctttgaaatactctaccatcagttcatatttctactttcacctaagtcaatattgaatcctctttggaaatcttggggtcatccttcctttctgtcaccttctatcttcagtcaccaagtctttctgtctgttagcagctctaaaatctgacccttccttctccttcttactgcctctgctttagtttcttactctataaaatggagataatatatcactgtgtagatgccataatacaaatagcaagctcttatggcactaataattttttaatacatgttaaccatatgaataggtcttattattattatgtccattttatggatggagaggttaagtaatgtgttcaaactgctccagctagcagctggtagagttgagggtttgaatataggctgaacatctggctcctgaatctgtcctctgcattgtactgagaaccctgtatcgtaccgaggtacgtcatctgtgttcttctgtactctcctattttgggctaaaccaggtcaaactcctatcttagtgtctttgaaatgctcaaacctgcacgttgtgcacatgtaccctaggacttaaagtataattaaaaaaaaaaaaaaagctccaccatcaatctgtagtttctgccctcacccaagtcaatatcgagttctctctggaaatctcggggtcatccttcctttctgtcacctatcttctgtcactcaccaagtctttcaatctgtcagcagatctgaaatctgacccctccttctcatttccactgcctctgcttaagtttagggtgtctcaaaatacctccttccagcacagttgcaatagtctcagaactaatgttcttgcctctatttttcccttctccccaacatcctctctttttgccaatttctgtttcacattgctgacaagtggtttttcttattatttaactctggtttgactttgattcaatgtaggtcttaaatgtatcccttttggctgtaggataaaaggccaagtgccacaggtttccagagcactatctgacgtaaccagcgtctcctcccagttctgacactttccatctccccgctaccagctccatctatttgctgtgtagtttgtcagggatgctgtcttccatactcattcccctcccccagatttatgtgggggaactcctttttaagatttagctctaaagtttctgcctctgcaaatccttcccttccattgtgcccatttatcacttcagcttctggtcactttgtacttggccattgcgttggtatacttggtgtctctttgatggtgagtccttggaaggcaggaaccctgtgtgcgcctgtttctgcagagcacagtgcagtttctgctaacagagggcctatcataatacttatggaagggttgattgatgtcctgagagtatgtttttaattttgcatggtggacacattttatatatttatctgtgggaaggagattcatgaataagtgtgtatatatctctatatacatacacacatatacaatcatgcattgcttaatgacaaggatacattctgagaaatgcattgttaggcagtttcatcatgtgaacgtcatagagtgcacttacacaaacctagatatggtatagcctattctctactgcatcagtacagttgctgtttcgtacagtaacttgctatacaagtaacttgctatacattactgtactgaatactgtaggcaattgtagcacaatggtaagtatttgtgtatctaaacatataaaaggtgcagtcaaaatacattattgtaatcttatggaagtactgttgtatatgcggtccgttgttgtctgaaataccattctgcaatgcaagactgtgcatatgtggatgtaagaaggatgctccttgtcacccagcagtaatatgagccatcacttattttgcctgtatagtgccctcttgggaaacatgtttattggctcccttagattaactttatgacgagagagtatgtacccttcactctactcctccccccagcctacccaattaaagatgactagtcttttaaaaatagcgttattgagatataacttacatcatataaatggaatcataccgtgtgtggtctttgtgactggcttcttccacttagcatgatgttttcaaggttcatctatgttgtagaatgtataagttctttctttcttttttttcttttttgagacaaggtttcgctctgtcacccaggttagaatgcagttgcacaatcgtagctttttttttttttttttgagatggagttttgctcttgttgcccaggctggagtgcaatggcgtgatctcagctcacagcaacctccgcctcctgggttcaagcgattctgcctcagccttccgggtagctgggattacaagcatgcgccaccacgcccagctaattttgtatttttagtagagacggggtttctccatgttggtcaggctggtctcgaactccccacctcaggtgatctgcccacctcagcttcccaaagtgttgggattacagacatgaatttcttttaactttttatagagatgaggtctggctatgttgcctaggctgttcttgaactcctggtgtcaggcagtcctccctcctcggcctcccaaagtgcacggattacaggcaatactttatttatttttatggctgaataatattccattatatggacacatcccacgttatctcattcattagttgatggacattgggttgtttccactttttggctattatgaaaaacgcttctataaacatttgtaaggaggtttttgtgtggccatatgttttcatttctcttgagcatatacctggaagtggaattgctgggtcatatggtaagtctatgtttggcagtttttgaggaactgccaaactgttttccagagtgacattcccactagaaatgtattagagttccattttctctacacccttgccaacacttgttattgtctatataacaccatgtcacattcccactggcagtgtattagagttccagtttctctacatctttgccaatacttgttattgcctatttaaaaaaaattttttttttgagatagggtctcactctgtcacccaggctggagtgcagtggcaagatcatgattcactggagcctcaacctccggggctcaagcagtctttccacctcagcctcctgagtagctgtaaccacaggtgtgcttttaaaaaattttttgtagagatagggtctccccatatgttgcccaaactggtctcaaactcctgggctcaagtgatcctccagcctcggctgcccaaactgctgggattacaagtgtgagccatcgcaatctggcccttgtctgtctttttaatctttctcatttgattcttataattctattagccaaagaaaaatattcttactattactatttatttatttatttatttgagacggagtctcgctctgtcgcccaggctggagtgcaatggcacgatgtcggctcactgcaagctctgcctcctgggttcacaccattctcctgcttcagcctccccagtagctgggactataggcgcccgccaccacacctggctgttttttttttttttttctatttttagtagagatggggttttaccgtgttagccaggatggtcttgatctcctgaccttgtgatccgcccgccttggcctcccaaagtgctgggattacaggtgtgagccactgtgcctggcctactattactttttagatgaaaaccccaaggcaacagacagattaaatgagatgcctcatatatgtgtgaatggaaagaaagaagtggtgtggataattcaaaaccacagattatccaaaagtaatttaaaagtttttgaatcaaacactaaagtatgtttgatgttggagatcatatttcccactcccacgttaaaagacaattagtatgattgtatcttttttgtctgtgtttttttttaatcattgaggtataattctcctaatataaaatgaaccattttaaagtgtttgaaatgattactctgaggatgcctattttttagtgattgtaatagttatattgtcttcaaaaatatttgcatgtacttaaaaacacttaaaaaatagaagcagtataaagtttgatctcccaaggagccatcatagatctatagagggaacaagaatagaagtaccacgaggcaaactggaagtcacttgttttaaagtaattaagataaccatgttgacttttatccatactttatgtatagccttttcaaaattagaaggctgtgtcttccttgttattctgacatgaatatttagcagtgccatctgtaaccctaggatcatatggtaaatgttaacaagaagcaccagaacttgtgttttccctgtcctattgtttttctacaagaatgctgacagctagagtggctttgtgacattgtgcccacaaagctgaatattacatgtgtagttacctgggtaggtgtagagtgtattttttttaaagagcaggacatagtgactggatgtcatcagttacatctgttttatcgtactaaaaattttacgtatattttgaaaacagttgcaaattagaattttctaacttgtatcttcatgttacgttcctgctaagtgaagaaaatattttctgaaaatatgaaacttgtaatgtgcatacaggattgaaaatgtgctgatagaatattttctggtttttcttgcctttctgctcagtgtgtcataatcttattttttgagggaaaacatgcacattttacagtaggttctccccatctgtttcaattcttcatcttgtaatgcttcctttcaaatagctacatgattaccttccagtttaggggcactgaaaatgttatctctggctcagttgacagtttttattgatgatctggtgggaaccaggtctgtggctttttcagcacatttcaatgtcccaataccacacaagaagcttttctctctcccctgcacaccccagatgaatacaactttactgtatattctaataataaaatacataaccataaattaagacaaggctgaaaggtttaaagaagaaagtaaaagtcaaccttaattttactttccaaacaacataatcactccggacattttggcctgtaacaggggtcagcaaactattgtctgtgggccacatctggcctgccacttgttttttaatcgaccttgagctgagaatggtatttacatttttgaatagttgaaaaacattaaagtaacagtaacattttgtcacatgagaaaattgatatgaaatttaaaattgtttccccaaataaagttttattgaaacatagccatgctcattcatttacatattatctagactgctttcatgctaaaatggcaggtttagtagttagttataggccttcaaagcctgacgtgttcattattactatctggacctttatagaaaaaaaatctgctgacccttggtctatacccttcaagactttttctgtgcatttgcgtgtgtgtgtttacattttgaaacaatgaggttattctatgtgcttttgtaatttaccctttttgctgaatagtgtttacaagtaacttctattgcattgtttgtttattccattggattataatctgtgaaccactctgttgctcttttatttgtattgtacaaacccattagatgttacctaggaacagtaataataatagtagtagtagtagtacttactatatgaattaaaattgattttaattgtttaatgaaataaaactttatttttttcacataatctgaatcatgacctaggtagtggtcaagctgcccaagaaggtcattgaggaaccaggatctttccagtgtcctcttctgccattctcagcatgcaatttcatagagagagggtgactaaactctgttattgttgtgtatcaagttaccacaagtcttagcaatctgaaacgacaaatattaattaccttacaatttctatgggtcatgagtccagatacagcttagctagttgtctctggctcagggtctcacaaagctgttggctgggaaatcgcttatttcaagacttgactggggtggaggggatctgattccaagctcactcatgtaggttttgggaagtgacagacccatactggctgttggctggagaatcaattccttgccacgtttctgtctccatagggcagctcacaacatgtttgttagtttctcccagagtatctggggagagtggggggtaggttacagactttttgtaacctactctgggaagtaatattccataacttctgcggtattctgtttgttagaagtgaatttctaggtccagcctatactgaaggggaggaattccaggagggtgggaatatcaggaggcagggattattgagggtcttcttggaggctgctttactatgtggtttcatttaaatgtggtgggtagaccttcaggcattggcctggcaggaagggtcaataccagcccttccagtttttcaattagaactatgccatatggccacccctagctgcaagaaagtctgggaaggcaagttttttttggtgacacattgttgcccaggtcaaaatcaggattttgttgataagaaaaatttcgataatagacactgggtggacaacagaaggtatctactatccctgccttctaaggtggttataaaggttcagtgaggcaatccagcactggtctggcttataatattcactcagttaaacaggagctatgattattgctgttacttaaaatcacataatatagctttgtaaattagcttgtgacaaaacaggatccctatgtgttgatactaaaagaagtagcataaaaggaagaaaaaaatacattgattgggtgcatagtatgtaccaggcattttatttacatgcagtatctgagttaatcttcatcataaacctaactgggtattgtttgccacactttatagataaagaaaagaaagcccaataagattaactaggttgttgaaggagcgctttccactagtgtgccttgagtgggttatagtttgtggagatattggttcctttagttcttggaatgggcagatggggacaggggtaactggagcccctggtctcttcatctctaactctgggcagcctcttctgattactccagtgtgccttaaaaaatataattttctgcacactccatgatgtggaaaaggttagagtgtataactctatccatgagtaagtgaatccaggtatgtataattccagctgcctgtctcctttccactgtcaggctctcaacaatctatagaagccttgaattttcgttagcctaaaatttgaaatgccccttcatttgctacaaaaatattatatttctacattttcttggattataaagtgatttaagttaacatgatttgaagcttcactgtggtcggaatgaaagcttgcttggccactaggtggctccttttggttctttctcccagtcgatggttgtggctttgtcctgtgccacctcttagaaggaacctaaattggacataaggaagcctagacaacaaggagatctgaaatgaatgggacatgcactctgatgattgcagttaccttttcatcctttactttccactcctgttcctcctgtgctcatacgctgatgtttaggtaacagatctagtccctggagcctcagatgagtctttgatatctctttctcacttataaaagtgggaaagtggggtaaagaacttttgtcctcatctagtatgttaggtaataaaataattgtaacatgtttgcagataattttaggcacaatttttaatacagcttattatcgtgggaatacttgtgttactacgcagataatgattgcactattaatattaatttccctattctttaatttaataatacaagctttaacttacatgtattatctcctataatcctcataggaaccctgcctagttaccatttttttccccctgattttagagatgaggcaattgaagcttagagagataggttaatttgctccaagtttaatagagtttggttgctttcagattttttcctctccgtttggaagttgttaattcattatagttgtgggcagagttttgacttaagtcaatatatttaaaattcctatgaaataattcagtagaaagtacttctggaaccatagtttggttgcaagtacagacatcattttctccagtcgtcttgtagaagtgagcagtagctggaagtgggctcccttcaggaaggctacaggctctttgcagaattacaaattgtatacactcagggatcacttcctttctcttgcctacaaatgcagcacccattatcatagaaactgcagggcatttgacagcttaggttcagactcggagctcatagaatggaacattcttcttcttcaattagagacacactaaaaagatgggaaggcacctaggcctagggttttctttgagactgctgactgatgtgttctcttttacccaaatttagattctgcattaatttccaaatttctctggttgccttgaaaaaataaatcggctcatgctaggttttctttagtcacgaataatttaactgtgcttagtatctctagttgactccccagttgtggtggtgatttctgcagaccataggaaaatgtataacaaatgtgagatgagagagccttgtcaggcagggggcacttactctgggaagtcagagctggcagtgggagcagtccccagcactaacaggtacacccacaagatctgcctcctacactgtcacttctacctctttgttccccttcctgactcacttcctgccagtgatttgtgacatatttcgtagctgatcaaatgagcccctgacacctgattgccgagtgcttcttgtttacagttgctttccaaggacacctagacaagatggaaagcttaacgtgaagtaattaaatttgcatctgctctgtgacaggactctaaggacttttcttccccccccccatatatgaatctcattgtagagctcctaccgtctttgaccatacaacatctaaaaaagggaggatgtggacaggtaaacaaacattggttcagtctactgcctgtcattatcatgataaatattaaataagatcactgatatccctttcttatttggctttctactctttacctacttgttttgccagattggtaactgattttcaacataagaactgtagcttggaggtgatttaaaaagatatttttaaaggaaagcaaatattgccaaacaatctggtttggtttaacaccctttggattgtacatttctcacaaatgcttatgaataattcagcaaagccaaatgcaatctgctggtggtatctagtgttattcacacttgctaatgaataattccctttggcttttatagggcggctctaaggaatgacttctgagactcagatgagttattattgggctatttgtcagtgtccttggggcattgcgagccaaagcccaacttggctacccactccacataccttctgcaattcttctgggaaacatgcagctctctctgtcccagctttttagccccagaacgttgctatgaaagagactctaacagaagaggaaataaaaatgacagaattcagctccactgtgattgcattggttcagttccttcattgtttcattcatataaagaaatgtttattgagcaccttaaaagcattgtatgtccacaaagataagatagatttttatgtgcaatgtcctcaaataaactagaaagtgtagggtgtataggagaggcataggatcccagaggaggatggtcagggtcttttgtcaaagtgatcagttaccattttctcatcatgttctcaggtatgcacttaaatgcatatttgccatttgtggtgttgggtgagggttccgttgctttggataaacctaagatttgactaatcttgaaactgcttaaaggataagccctataatgtgatcccagatatgactaagtggccgttgttcatttctgttgctctgaagtcaggaatgtggtatgacctggctttaccagcctgggcaatctaaggatggtgaacgtggatttatttatgcttgggtggttatatacttataccttagcaatcatactgcataatgtataaccctgaggtcagtgagtgcattcagccttggtgaggttgtttctggcagcctgtatccatttcagttttctctatgcaactcctaagttttcctctagaggagtgtaatcttcctctgagcacactggaagattacagttcccagcttccttgcagttaggtaggatcatgtgattagttctagccaatgacgtggaagtgatgggtattatttcctggtcaagacattaggagctagtgtgccacttgcattctttccctttccctgccacagtgactttgggggccttgtgtttcagatggtggggtctccattgggctgatccaggaaggactgagtggagtagagtccattcccttcccccatcaacatattagacaggtaacttgagcaagacaaagacctttgttgcattaagtccctgagatttgggggtttatttattaccacagtgtagcctggaccattgtcactaatatagagggattagtacaggaatagctgtgtgcttgttattcaacatgatttagccagctttagagaatgtagtttcttttttttaaatcattttttattgtaaattgccaaatcatagttgtaaatattatgggatgcaaagtgatgttataatttatgaaaacaatgtggaataattaacatatatatcaggtcaaatacttaccattcctttgtggttagaacattttaaatgaactcttggtgattttgaaatatataatatgttattatttactatattcatcacactgcagtatatctaaagtagaaaaaacctcccaaacttactcctcctgtctaattgaggctttgtaccttttggccatcatctccccaatcttctaacactcctagccttgggtacccaccattctattctttgcttctttgagttcagttgtttttgattccacatgtaagtgagaatatgcagtatttgtccttctgtacctggcttatttcacttagcataatgttctctcattccatccaatgttgctgcaaatgacaaaatttctttctttttaaaggctgagtggtatttacgggctgtgtatatatgtcacattttctttgtccattcatctgttgatgaacactttggttgattccataagttgaatagtgcatagtgctgcagtgaacatgggagtgcagacatctctttgacataccaatttcaagtatcctgggtaaatatccagaagtgaaattgctggatcatatggtaattctattgttagtttttttgagaactccataattgctgtactgattcacattcccaccaacagattgcaggggttcccttttctcaacatcctcactaaaacttatttttatctctttgacagtagtccttctggctggtgtgaggggatatctcattgtggttttaatttgcatttctttaatgattagtaatgttgagcatttttttcatgtatctggtggccatttgtcttcttttgagaaatgtctattcaggtaccttccccattttttaactgggttattaaatttttaatgtagaggtatttgagtttagatattaatcagatgtatagcttataaatgttttctcccaatctgtaggttgtctcttcacttttttaattgtttcctttcttgtgcagaagctttttattttgatgtaatcccatttgtctattttgcttttgttgcctttgtttttaggggtcagatataaaaataattgctcagacgaatgtcctgtagtttatctactatgttgtcttctagtagttttgtagtttcaggtcttatgtttaagtctgtagtccatttgagttgattttagtatatggtgtgagataagggttcaattttattcttttgcatatggatatccagttttctcaacaccgtttattgaagtgactgtcctttccccaaagtatatacttggcacgtttgtcaaacccacatacatgcatgggttcatttctgggctctattctgttcattggttgatgagcccatttttcactagtaccatgctgttttaattactattgctttgtaatatggttggaaataaggtagtgtgatgcctccagctttgttctttttgtgcatgattatcttggatattcagggttttttcttgtgtgtgtggttccatatgaattttaggattatattttctatttgtatgaaaaatgacattggaatgttgatagggattgaattgaatgtgtagattgctttgggtagtatggacattttaacaatattaattcttctagtctatgacatgggatatcatttacttagttgtatcatcttcagtatctttcattaatgttttattgttttcagtgtataggtcttttacctccttggtattaaatttattcctaagtattattttttcacaactcactcttcatagaactattttttatagctattttatttatttatttatttagagacagagtctttctctgtcacccaggcaggagtgcagtgatgtgatcttggctcactgcagcttccacctcctaggttcaagcaattctcgtgcctcagcctcctgagtagctgggcctacaggtgtgcaccaccatgcctggctaattttttgtatatttagtacagacagggtatcgccatgttggccaggctggtcttgaactcctgacgtcaggtgatccacccaccttggctgggattacaggtgtgagccactgtgcctggcctgtagctattttattttattattttattttatttttttgaaacggattcttgctctgttgcccaggctggagtgcagtggtgcgatttcagcttactgcaacctccgtctcctgagttccagcaattctccagcctcagcctccccagtagctgggactacaggtacatgccaccgtgcccggccaacttttttgtatttttagtagagacgaggtttcaccatgtgggccaggctggtctcaaactcctgacctcaggtgatccacccgcctcggcttcccaaagtgctgggattacaggcatgagccaccgtgcccagccttgtagctattttaaatgggattgttttcttgatttcttttttatatagttcactgttagcatatagaaagactactgatttttgtgtgttgattttgtatcctgcagcttaattgtattcatttattagttctaacagtattttggtggaatttgtagggtttttaatatgtagtgtaagagcatatcatcagcaaacagcaatagttttacttcttcctttcctatttggatgctttttttctctttttcttgcctgattgctctggcaatactctaatactatattccacttctgtactgaatagaagtggcaagagtgggtatctttgtcttattctgaatcttggaggaaaagattttaattctttttttcttttttttttttttgagacgaagtcttcgctctgtggcccacgcgggagtgcagtggcgcaatctcgggtcactgcaagctccgcctcccgggttcatgccattctcctgcctcagcctcccgagtagctgggactacaggcgcccgccatcacgcccggccaatttttttgtatttttagtagagacggggtttcaccgtgttagccaggatggtctcgatctcctgacctcgtgatccgcccgcctcggcctcccaaagtgctgggatcacaagcgtgagccactgcgcccggccaagattttaattctttaccattgagtataatggtagctgtgggcttatgtatggcctttattgtgttgaggcacattccttttatacctaaggtattgagtgtttttatcatgagaggatattgaattctctcaaatgctttttctgcatctaatgagatgaccatctggtttttgtccttcatgtagaatgtaatttcaattgggaatcaaatggcagatctaatttaggggcagaaagagagtttgtttcatcagttatcaaagaatctgtgcaagaaataacattggtgaaaacagagtcatggaagtaaaagaataagtagtaagaagagacagagttgaattgaggctatcataactgatattaatgaattttaaattgcatttggcatgtttaattggtaagattatgaacctgtaatttttctctttgcttataacttatatcaaagtctggcccttgagctaagaatggcttttttctttttctttttcttttcttttcttttttttttgaggcagagtctcactctgtttcccaggctggagtgcagtggtgcgatcttggctcactgcaacctctgcctcccaggttcaagcaattctcctgcctcagcctcctgagtaactgggattacaggtgcacgccaccacacctggcgaattttttgtatttttagtagagatggggttttgccatgttggtcaggctgttctcaaactcctgacctcaggtcatctgccctccttggcctcccaaagtgctgggattacaggcatgagccactgtgctcggccaataatggcttttaaatttttaaaagattataaagaaaaacaaagaagaagaagaatatttaataggggccatatgtggcctgcaaagcctgaaatgttactagttagtcctttacagaagaagtttgctgaccttggtaagtttgcttaccatctctacaaactattatcaaaaaggatcacacttaaccaaaatgtgagttcctggagaattgggaactcattgcttttattaatctctgtgtctttcagtctagcatggtacatggcaacacagtagaagatcacagcaattttacttgattgaattgcacacagaacatgggcaatatggaagacagtttagaggatgaaaaccaaaaacaaattacgaaggttgtaggtctaaagaaatagaactgttcttcctctgtgcttgtgggtggtgacattcctggtttgtttaaacctaagtatggacgtttatttaattttcatattcatcttcaaataaaaggaaggttttaaaacagatgtgtccaatcttttggcttccctgggccacaatggaagaattgtcctgggccacacataaaatacactaacactggtcaggagtggtggctcacacctgtaatcccagcactttgggaggccaaggcgagagatcacttgagctcaggagttcgagaccagcccaggcaacatagtgagaccctctctctattaaaaaaaaatttaccatcctggctaacacggtgaaaccccgtctctactaaaaatacaaaaaattagccgggcgtggtggccggtgcctgtagtcccagctatttgggaggctgaggcaggagaatggcatgaacccgggaggcgaagcttgcagtgagctgagatcatgccactgcactccagcctgggctacagagcgagactccatctcaaaaaaaaaaatttaaaaagaatgaagtattggcacatgctacaccatggactaatgttgaaaacattattctaagtgaaagccagatatggaagactaatattatatggttccatttatataaaatgtctataacaggcaaatctatgaagatgggaagtaggtgagtgattgcccaggggtggggtgagaatcaggagtgagggctgatcggtgcaggggtttctttttggagtgataacaaagttctaaacttagaatatggtgattgttgaacaactctgtggatatactaaaaaccattgaatcatatactataagttggtgaattttatgttacgtgaattacatctcaaagatactaacaaaaataatgatgcagtggattgcctatttcctagtgatgttgctggttatttttctctctgattcaagctgcagtcaggatttgaatcgcttacattttaccttcttgaagtaagatcttctaaaaacaaaattgacttatagtcaaatcctctttgacccagctatgttctacttacatgaatttgctccattttttgtactggcacatgggcacaaagacatatgtataagaatattcattgtggcattatttgtagtggcagaacacgagcaatctaagtatccatcagtagggaacagtttaaatacattaagggagatgaagctagtgaagatgaaactgtcttcaagacaattaaaagaacaaggtgtagaatactgttactatttgtgtaaaatgcttgcatatagacagaatatgttgtaaagattcaacagtggctacctctttgggaggcaaagattgggctgatctagtaataggagagggacagcctattgcagggttgcactttaaaaaaaaattatactttcttttcatggaagcattattcataattaaaaagtggaaccaatgcaaatgtccaccagctgatgaatggataaaccaaatatggtatagccatccagtcacgtaagtagggtcaaaggggatttgaatataaatcaatttcattttgaggaaatcttaattcaaaagggtagtgttcaaatattatctttaaaattaaaaaagttgactcctagactatatctcagcaatcaatcttgcatatctttttgcatacttcttttcaatccatatggaataatttgtcttaagactcatcccttcaattcaccctccaaccactaatgatgcagcaattatgtggttccactgtaattttaacactgtcttctaacccagctgtgtggcagcagtgtatctgcagggcaagaatgtggcttgcaagggtcaatatcacactgcccacaattattttaatgtctcctctgaaatgataaatgaactttatagttataataaaaagtaaacccattccccctaaggtataaagggtgtacaatttacatagtcagatatgactgcctttttttttttttttaaagaatccttcgttgagggctttaaaaaaaaacagggttagggataggaataggtggctcatgcctgtagttccagcactttgggaggctgaggcaagtggatcacttgagcccaggagtttgagaccagcctgggcaacatggtgaaaccttgtctctacaaaatatttgctgtgcatgatggcgtgcacatgtagtcccagctactcaggaggctgaggtgggaggatcacctgagcctagggagttgaggttgcagtgagccgtgatcgcatcactgcattccagcatgggcaacagagagagaccctgtctcaaaaaaaaaaaaaaaacaaaacaaaacaaaatgcaaaaccagaaaaaccagggatgggttttcagtgtgggcatttatttgatccagcccaataaacatgattaaaatatgaaaatgttataggatttatagctgctcctctaggaacttacactttttttttttttgctgttgttggcataattggaagaaattcttccaagttttgcatctgcattgcttgtcttataacactaacttcatgtaacttacaaaatatttgctggaagttttcctggccctaggaggacccataatttataactcctgctttttattatttggtgccacttgtggctcgtgtccttcctaattattgcaaatcctctagcctgcccccacattcactcagtaagactgccaccttgagacatgagctgttggtgtttgcagtatttaacatagcatctactaccatcatttagctatctctgacaaagagctcattgggccctcttgcaccatttcctcagctgggaagtgtgggattgtagaagctgcttcccttctccccacatctgaagctttgtcctatcacatgaagctaggatttccacgctttctttctagctgcaggagaactggctgctcaggggtgctgcgttttctaccttctgacccacagccagaggcagctcccactgcactttttcatttgcattagatggcactttgctttatacaattgacgtctccatttaatttttatatcttgcctgtatcgttagagaacggggtttggaggtgttcatgacttatagaagccccacagttagcccttttatgatccctcttttagctaggccctatttacaaattttgtaaatttagatggcttcttattaaatgatgtaaacccatccatttgtactgttaaagctgtcatgaatggtatggcatttttgagtcaggccgtcctatagcacagctgaagcacactgaggcccagagagtttattggcttcttcaagattacaaagctacttaattacagagctgaatttggaatttagaattccaggtccagaactttttccataaactgaactgaagtaaaagctccaggctgggcgcggtggctcacgcctgtaatcccagcactttgggaggctaaggtgggtggattacttgagcttaggagttcaagatcagtctggccaacctggcgaaaccccatctctactaaaaatgcaaaaattggccgggcacggtggcggatgcctataatcccagctattcgggaggctgagtcaggagaatcacttgaacccggaaggtggcagttgcagtgagctgagatcgcaccactgcactccagcctggatgacagagcgagacttcgtctcaaaaaaaaaagctccatgataccttgaatttaagggaaaattaatggtgagttaggaaaggcatgatacacaatgcaccaaacaacactccatgaaaatacctcaacaacgaagtactttggaaagagatgacgctgaggtatttaaaattttatttactttcatgattatccaagaagtaacaaatctttttttagattatttctgatagtctttacatgttcttccaggtacttctgtagcaacttaacagatcgtatgacaatatgctgatagtgattcttccttttgataacggtattagagaagacagacagtgctaggacaactgtacaaacaccatttctcatcgctataggcaagccagaagccacatgtttcctagggaaaagggctgacctgttaccattgctagttgtgtgtaaaacatgtgttagaagaagtaattatgtttagctgactgactatgaccaagattaatagctcttgaaagggctgtaatgaaaggctgccccaactggcttccacattattctttatttatcccgctctcatccctgtcacctttgggcaccagccaaatgtcatttatgtgagatttgccccttggatgtgaaaggcctctctttcttaatgatgggaggcgattgggctgcagggctggagagcttggacggttgacatgacccagaggagatgctccaggtctgtgggagtcagaggcctaggactctccctcctgagggagaaagaacatgaggatattcagctgtctgatcccgtccattgaggtgtacttgagggattacagggagtacttcaaacactctgttgtcaagtccatatatttcggtggctcttcagtttggagcacttggaagtttcttattttgaagaccatttgtttgaatgaaatcatcaatcatttctagtttcgtaaaacttggaagtctccttgtggtagagactgcacagatcccttcttgcttctttgagtcatggacttttcaggctggactgctgcccaaaatgcagattgcatttccccagcctcccctgcaacggggtgtggccatgtgactgagagaaggtgtactatgggagtctctgaggtgtttctttaagagaaagctggtgtatgccctttgccctttgcttcttaggcccttgcttctgtcccgctgcctggaatgtacatgctggacttggatcttgaaggtgaagcccaagccttatgggctaaaaggggccgggcctctgagaacttcaggagaaccactgtcccagcctggttaagccactgttattttggattttttgtcacttgtaggcaaatctaaacttagataatacactgtttctacacttgcagaagatgaaaacgccaaacccttggattgccttttcccttcctaagtattaatatcaaaacttaaacaggttcctttccccttctttcaactcctctaaattaaaacaacctacaaaaagatcatgcagtaatttatttaaaaactaaagacatgagagagatctcagtaagagagatatatgagagggagattaacaagaaggctagaaaggaaaataacacatttaggaaaatgataacgaggactggtcttcatggccttctgtaataggtcagggagctctcactcccttccagtgttggtggcagcaacagcttcttttcttagattattagaggccctagggattcgatttcacctgctttgttaaggccataggaagctttttaaaatttcagatttcaaatgtcaagtctctattcagtgcttttgggccccttgcatcagagtgtttatattttgcctgactctttggtttccggccataaagtttgcatgttgtcatcttttctctaacattatgtgtattagataacatgtactacaatagctatagtgggttacaaaagattcttaacacaacccttttaaaagagttgcagagatgcgtaattatttttcatgattttcaaaacttttgaaagagaaaagcagctgtttggttcactgttctcattagcatttatatagtaaactaagagagaggttttctgtgcagtgtttttccttgctgtttcttgccttttaatttgaagaatagcaggatcttgtcttttgttcacatgagtagaagtccattcagctggaaaaagaacagtgcactctttgtgtactcagagcatttgaatgcttttggtcacacactagttgctgtttaactacaataaaattgtgaccaaaggagataaacatttaaaggataaatgacaggcctgttaatctgaaagcaagttttgtagcgttgttgtttttagctaataggtgtatagccaggagtcacggtgatgacttttaaatctgaaactgagtgaagtctgtgttttcaaccagtttaaaaaatgttgccactggacctttttaaaaaaatatttttaaaaatacgacaaaaattttatgtatttatggtatatactatgatattttgacatgtatacattgtagaatggctagatcaacctaattaacatatgcattatctcacatacttttttgtggtgagaacacttaaaatctactttcttagcaattttcaagtatataatacattgttattaactgtagtcaccatgttgtacaagagatctcttgaacatcactgaacatatttatggctgatcattttgtgttttaacaatcatttgaacatgtctaaactgtctttagaaactggtagggatttccttgctgtgtttgctaagcttggccatgtcatccacataaatatctgaatatattcatatatgaatacatactgtatataatatgtgtgtatatatgaatacataatacctatatttatatataatatgtgtgtatatatgaatacataatacctatatttatatatataatatgtgcatatataaaatgcccaagtatattatctaagaaaagagccactggggcttttataagtctatgatttcagaactatgtccatctttacacctctaaagcgttatgatttacctgatttggtggaggaaaggtatttttggtaattttctgtccctatgggaattcaaaggataaatttcaatctctttttctttctttctctctctgtccatcttatgcagctgaaaactggcatatgactctttgagaagagctcaaacagttgtggtaagggtgcttagatgttgagtgctatctgttttctggggtgtgaaacatacagggttttaccagtctgttgttgcagagtgctgggtgtattttgctttagctgactgttccgttggagtattcagcctttctttaggataacaaaaaataaaattaatcaaaggcataatcaaggacgttttccttttgtacagtcacatctcattatacaacattagtcttaagctttgcccacctgccagataggtgtaagatgattaatgaaagctgaaactctcagtctagaggagacagcagggactggtggtgctagtggtgaagtaagaagtacatatgctgcctaaagggactctggttcagtgtgtgaatgtcagcccagtgttgcaaatattctgacttttcaaaagaagcaggacatctagatttttatttgaaatctctttattttaataagccatcgactaattgaaatttaaaacctgtgtagtccaaatagaccatatctacaggctggaaggaatagagggcctgccttttgtgacctctgttgtttggggaggttatgtaaccattgtaaccagggaaggatacatgaggattcctcttcagggaagctgaccagcccaataaaaaatatataggttgacatttggagatatcttaaaagacggccaggtttccatcatatcgctctgtagtgaggcccaccagttgacaaactaagcttctgcacattcagcttctgatctgtttcatattccctcactggaaattatgaactgatgggcaaagatcattgaacatccaggaatgcctcaaataggaatgacaaaatacagagcacagaaacagaagaaaaggaacccagaggaacaggaaaatgtggagagcagaaaacaatttcaaaacaaattataattaatattcccagagagatgagagaaaatacacgaaacaggaacaagatgctaataaaaaggaaccttcacactgttaattttgttagttgtgataatgtattgttatacatttttaaaaatcttatacatttaaaaaaaagttgtccttagttattagagatttatgctaaataattacaatttgaatattgtgatgtctgggatgtgatttgaaataattcagaaaaaaggatagagtcgtgtgggagatagataaaatgagattggcaaaatgttggtaattgttgaagcatgctgcgtaatgggcgcataggggttcattatattattatttgtacttttgtgtgtttgaaattttccattatacaaccttaaagaaaggatcatttagaaagcaagaaagagcttgcaaattgaaaatatgatagcagaaattaaattttcaacagaagtattagaaaatacagttgaagacatttgtccagaaattagcccaaaacaaagcaatggaaaataagaaaggaaaaatatgaaattagaggatcagtccaggtggtccagtatttaactctgggagttacagaatgagaaccaaaatatcagaaggaaagagattatcaaagaaataatacaggctgggcacagtggctcatgcctgtaatcccagcactttgggaggcccaggcaggaggatcagctgaggtcaagagttcgagaccagcctggccaacatggcaaaaccccatctctattaaaagtacaaaaattagctgggcatggtggtgggcacctgtaatcccagctgcttgggaggctgaggcaggagaatcacttgaacccaggaggtggaggctgcagtgagccgagatcgtgccactgcactccagcctgggtgaccgaaaaagactccttctcaaaaaaaaaaaaaaaaaaaaaaagaaaaaagaaataatacagggtcatttccttgacctaaaagacatgagtttccagatcaaaagagcccagtgaccgcccagcacaacagatgaaaaatgatcccactatggcattttatcatgaaatttcctaaccccagaggaaaagagaagattctaagagctctcatttgcatcctgagctggtctaggatccagggtttccttgggccaatgcttcagatagttaaactcatcttttgcttggtcagggatgtggtggttgcctggctgttgggattgagagaaagaatctagggtctaacctctgctcttgacttccaactagtcttcctgttttcagcttcatggttgaaatgcaccttccttcagaagttcctggttattgtattcctgagcctttctgtagatggtggcatgggagctcacttcttattggtcttccccttttctccctcaatcctgtctaccagttagtcttcagctttggtgtgtgtgtgtgtgtgtgtgtgtgtgtgtgtgtgtgtgtgtgtgtgtgtgtgtgttttttggagacagggtctcactttgtcacccaggctggtgcagtggtgcgatcttgggtcactgcagccttgacctctgaggttcaaaatcctcctgcctcagcctcccaaatagctgggactacaggtatgtaccaccatgcccagctgatttttgtattttttgtagggatggggttttgccatgttgcccaggttggtctcaaactcctggactcaagccgtctgcccgcactggcctcccaaagtactgggattacaggcgtgagccaccacacctggctttaggattcaggttttgctgttacattacttgccattcctttttcatcttttaacatctctcatctgcttgctttcttttttttttttttttttttcctgagactgagtctggctctgttgcccagactggagtgtagtggcatgatctcagctcactgcaacctccgcctcccaggttcaagcgattctcctgcctcagcctcccaaatagctaggattacaggtatgcaccgctatgcccagctagtttttgtatttttagtagagacagggtttcaccatgttggccaggctggtctgaaactcctgacctcaagtgatccacctgccttggcctcccaaagtgctgggattacaggcgtgagccactgcgcctcatctgctcttatctttcacattgactttgacgatttatttttattgttgttattgttgtctccttttcttttttcttttcttttctttcctttctttccctttccctttccttctcccttcctccctccctcccttcctttcttccttcctcggttccttttcttccttttctttcttttctttttttctggagacagggtcttgctctgttgcccagtctggtgtgcagtggcacaatcatagctcactgcagcataaaactcctgggctgaagggatcctcctgcctcagcttcccaagtaactgggacatcaggcgcacaccaccacacccagctcattttttttttttcagttttgtagagatggcaccttattatgtttcccaggcttgtttccaactcctgggctcaagagattctcccaccttggcctcccaaagtgctgggattgcaggtgtgaaccactgcacccagtatattgttttaatttctttacaggcgttccagtgaggttttgggaaggagccaagtgcatgttttgaatccaccatgttagaatggaagttaatttgttgtgttaatcattaatttgtatgtcagagtttcttttcctgaggtttatttgaaaatcaacgtaagaaaacaaaatttaatatggagaaaataatttcctccttcttaaagtctcctttgactatcctcacggaaattggtttgtttctactttctctgaaatactgtggccctgggagactcctgctcagtttagcaaagaattctctactgttttgggtcttaatctaagcactggatgtgtgcttttcacccaactagattatggagtctctgtgaacctagggagatatcttagtctgctcattgattaccttacggctccttatggatatgaattgaataaatactttgctgatcaaagtatactactcaaatttgtattactttatttttatatgtgttatatgtgattcttttaatgccttctcagcctgttgctcagagattagtgggaaggaataaatgtaacaagtagactttgggggtaatactgataagttaaaaatgtcattggtttatagcttcaagggtattttactgaaattgcaaatgttctattatatttagaaagagaaggaatggaaacctgactagtcattatactgaggttgggaaatctggaacttgagttctgaatcagttttctgtagatagcctgtttcacagtggatttgcttaatgttttaccggtaaacaggcactcctgtttattttcagctcttgcctttcagcacaggatagctacaattgttcagagtatgcctctcttgtataaataacaatactgtcattttctctaaagtcatcctttttattaaagaaaccctttaatagtcccacatattctgtagttatgcatttctgtgagtgcttactgaccccagcacagtgtttaataaattattgaactttgaagaacctttgagaagcaagggctttatgtgactgagcagcagacatgaaaaaacgttatcctccagagtatctaacagacagaaatagaggcttgatcagacaatataagcaccgagtgaatgatggtaataccatgaaatatttacacccatagagcatgcgagggtggggaggagagtgtgggtttttatccttttgggttgaacctgatgccatacaactcaccactctatgatcttaaaagcaaaacagaaagagaatgagagaaagaaaggaagaaaggaaaaggaaaataaagaaatgatgaatattgatttggtgatattttgttgtttgcattatcttatcacaaaagcaaggctccttttgtagacaggaaccttactaagagtcaagttttaatcagtccttaacagaaactgaagatatctgaagtgatttcttgccactacaagtttaaagttttaatttaatcaatatctcatgatttaccatgcctcaaaagctgtcattttattatctgtaataaatagagatttgaagagtaaagaactgaatatagcctgatacgatcttacttttaaacagaagatgcaatttatttattttttcatgggatgctattttaaagtgacttgtgatttctttaataatgatccacagagaaaattaacataaaggaagaagtgtctaattatttaggaaaggtttggaagatgtttatcccggctaatatagatagagagtgtctaatatcttacagcatagaaaggggctaaaacaaatgtgccaaccaatttgttttgcccctgtgcccagtattttatatatccatttttttaaataaggatgaaccttttaagatttcatggtgtcatctaacattattaaaagtaattattgttgatgataaataaaggttgacaatgatgtgctttattgaatttaattttactcgtggtttattttaaaaacccgcagattgtgtttgggagatattttaatgtagtatgtctgttttttgctttctagttgtggaagaaagaatcaaattatgtattaataaggaggctcagattgaccatagacattggcctttcaaggggatcatctggttttagaggctttagtctcctttgagtaccctggatgtttgctatgtattatgctaaactaacgcatgattacattgaccctatgattatagtgacctaaattggcaagtttctgtcacttataaagtcaaggtagtaatgttggaagggaaactgtagtgagactctcctttgcaactgtaatgttttgtctgtagattgcaaatgagggaattttataaaggctttattatttgtaatgtaggaacccattgcatacaaagaaatttttagtctaaggacccagtattagtgaaatgtgacatagatctatttgtgaaagggtgtacccagttgaaacagcaggggcaagattttatttgtatgtttattatttttgttaccaaagcgatgccctggaaagaatcgggatttttgagtgagtgatgtgatgtggatttaaatcctgtctttgccacttagttctttcacttccagcaagtcctgaacctaagactcaattttttctctcaaaatggggctcatgatgatttacttcgcagatttgttaaagcttgtaagcattcagcacggcacccagagtgtgggaggcactcaatgaatattagctcctttctccttccttttcagctaaaccaaaaaggctttatctaggaggtgagacttgtagaaactcttgattgatggaaggaatgagtcagtgaactagaagaagggtattcgaggcctgtggataaccatgtgagaaggtgagaagtgagtgtgtagtgatgggagagtgtggctggacagatggacagataaagaaaagagggtgtggctgggcgcggtggctcatgcctgtaatcccagcactttgggaggccgaggcgggcggatcactaggtcaggagatcaaaaccatcctggctaacatggtgaaaccccatctctactaaaaatacaaaaaaaaaaaaaaaagaaaagaggggctgaattaactgacttgtagaggcaaatgtgatattggtgttgggacacatcatctgaacttccactgtcattatctgcttctcaaaattggagttgagagcatgtgcgaacttgagaatttattcttcttgtctacttgaacatctctcttttaaaaaatgcaaaatgttagaaatgtttgatccaatatagggcaaataaaaattggtctgttctttttttttaaatttttttttgagacacagtttcactgtagcccaggctggagtacagtggcatgatcttggttcactgcaacctctgcctccagggttcaagcaattcttgtgcctcagcctcccgaatagctgggattacaggcgcatgtcaccatgcctggctaatttttgtatttttagtagagacagggtttcaccatgttggccaggctggtctcgatttcctgacctcaaatgatctgcccgcttcggcctcccaaagtgctgggattacaggcatgagccaccatgcccaacctgtctgttgttaaattctacctctgatcgtaatacttcgatggagaatacattgctattacttttagcatgatgggtaccaatatgagatttccagttgcttcccgcatgttcattttgcagattttaactgaggcttatatatgctcagggctgtactgtactctggggattcagtagtaacagacgagagtccctcttctcatggagattaatattctattagaggaagaatgctagtaaataagtaaacagtggctgggcatggtggctcatgcctgtaatcctagcactttggaaggccaaggcaggtggatcacctgaggtcaggagttcgagaccagcctgggcaatatggtgaaacccggtctactaaaaatacaaaaattagctgggggtggtggcaggtgcctgtaatcccagctactcgggaggctgaagcaggagaatcgcttgatcctgggaggcagaggttgcagtgagccgagagatcacgccattgcactccagcctgggcaacaagagcgaaactccgtctcaaaaaaaaaaaaaaagaaagtaaacatatttaaggtcgtaaataaggccatgtctaatagtgataaacagtatgttgtgttaatgactgaggggaggggactgctttagatacagtggtctgaggtcacctttgatgtgaactccaaaggatgacaagggcatacatttcagcctcagagacaaagctctgaggtgctaaagagcttagcatgtagaaggaacagaggtggtcagtggccagaacttaaagagaaggaaacgaaagggcaaaggaatgaggccagatcatgagggtagggactttagactgcggtagatttcgattttattccaagtcccattggaaatcactggagtgttttaaggtagggagcgtgtgtgtggagtgacttactctgatttgatttctataaagatcactgtggctctgcgtgaggaatattggaaggccagagtagaattagggagaaatattgggaaaggaatgttctgatggcttggcccagttggtgactgtgcagatagactgaaggggaaggatttaagatacattttgtaggcaaagctgccaggatttacttttagacagcataagaagtttgaaagaaaagaacaatcaaggaaaatttccaggcttttagcttgagtaactagattggttttgtttgcttgttgtttctttttggagatggggtctcactctgttgcccaggccggagtgcagtggcgcgatcgtggctcactgcagccttgacctcccaggcttcagcgatcctctcaccttagtctcctgagtagctgtgactacaggcgtacatcactactcctggctaattttttcgttatccgtgaagatgcctcactgcattgcccaggctggtctccaactcctgggctcaagtgatttacccatttcagtgctccaaagtgctgggattacaggtgtgagcctctgccctggcctgagcaactagattgtgaccatttactgagataagaaaactgaggacgaagcaggtctggggtgaatcaggtgctatccctttggacagtcacatgactggtgtctgttcagcacccaagggaccatcaaagaggctgttgtggagagggaatccgaaggtcagggccagagatagaaatctggggagtcatccactatataggtgatgggttaaagccttagaactcttcttttcatgaatcattgttgttctttaggttgtaatgaagttttaggcctcagcttccctgaactggagtgtttttccttcaccttttccggtctctgggttgcatcgccagactgtctctaagcccaacaaacgcgttccttccaggcaaaagcaggagatgacacacaccatgagccagattttccatggcagacttgtaaggaacaagataatctcattgttcctcctgctacttaaaataaaggtaatattgattttatagtagcagttcaggtcctaaggcatgatattgattaagtgtctgatgagaatttgtagggtagtctcccagacctgcagctacagggcatctccccactgggccaggcctctgtgctgacctccactgttataagtggtgtttttcttaggaatccttagccctgtttagtctacgcactgtccagaagcatttatttaacctgatggatggctcaatccaacccatcaccttaatctgaccttaaagatgggaacctaatgtttttgttcttagtaaatgtgaagactaattttgacactgtttagaattattttcttattagtagcagtagatttcatgaattttctgctgtgaaatttcctattaaaatactataatctaatgttaaatgacgagttaatgggtgcagcacaccagcatggcacatgtatacatatgtaactaacctgcacgttgtgcacatgtaccctaaaacttaaagtataataaaaaaaataaaaaataaataaaatactataatctgacttttttatttttacttttttactttggagcctggctttatgaattttttttttaaacaggggaaggtacctcttttcaaggtgtcattattaagcccatgggactcttcaattttaatgttatatcaaagagagtaaatttcttgtgattattgtgatatgatgcattcaacttgcaggtcaggttttatatcatttatagatcagattctgaagatatcttcagtcaaatttaataacaatcaaggaatatattattcaccggcctgaagtatagaaagagttcccagaaatcatctaaaaataactgtttcatataaaacattttgactttctattgtaataagattaatatatttttctcccatgtctaattctggctggattgttcatggggttgatgtgaggattcagtgagttaatataggctaaggtgcataatataatgcctgacacatagtagatgctcaatttatgttaactactgttagctgctttagcctgttgttaactgcaaactccttttacattacctagcacaggcctgggcacaagtatgatatttaagtagatgcttagtgactgattgatgtctccaaacatttgggatttccttccacatttgccatagcacagcttgttttatgtcttttctaaaatggtctaggtacctgacatcctttgatccttcatatggttacactcaaaaggagccatatgaattttgaccatttgcacatctgcctgtctttttggttagctgccagatagagctcaggttttaaatcctttgcagttaaaagagataataaatgttaacattcctagtacagtgcctggcacagaatgtgtaaatatcatttgattcggaaacatgactgctggtcaattcggcctccagggagacaaaactaaggggtggggttgtggctttttttgaggtaggggatggaatagatatttcttacccgagtagaagatgatgccgggggatctaatgcttcttttaaatttcccttttgatgcacaaaggggcaactccgtgtagcaggaccttggtgggatggataggcagctttgtaagtggagaaatggcctctgtttagcttatgagcacagagtcattttgggggtggtttatgagtcatctgaaatatgcatttaatctagatttgtggcctgcttggtgaggctgctgcttttttatgatctcaagtgtcttgtccatgtcaaaacttgccttgtttttttgtttactttgaatcagaaaaatgttcacaaccacccttggaattcctcctcaagtgtgcgtttggtcacatcacccctggctaccaccagtacatgactgtttattttggatgtccttttctgatgttcagctaatttaacccacaatgaagttaatccttgcttctttggaaaagtacagatttacttattagctgccttccagagacatttgcattttcatgaaagcgagtatataattacattgacttttggactcatctacccacatatgtggtgggcgccttttgaaagtcaggattcagagtaaatcagaactgtcttgagttagctgaagttctctttaaggttaacaataaatgtatctatgacaaacatggggatgtggtattgcatattcgattatgtccatttatctttccttcttctgggtgagaggggagatgaaaatggagctaccttggagttcatgttttcaccttgattctccgcatttatagcatactgattgaaagcatggctgccagaaccatattacttgggcttgagtactagctctgtcacttactcattgtttaactttgggcggggtacttaatttctctgtacctcagtttcataatctgtcaagtggggataattatggtaaccaccactgagcattgttatgaagatcaaataagttaattcatgtaaaatatttagagcagaacttagtatatagcaactgcgatacaagtgttagatatcatttttattagggtttagtaattgcataaataaaagagatgaaagtctaaattattaatcagggccatttatctatgagacactacaggcattgtgtctagccctgtgggtttacattagttagggtaggttattgctgcaacgtaccctaacttgatatgatttttgctgcaaaaatcatatcaaaatagtctataatggcttaaacataataaaatgcatttcttgtttatgtaacagtaatgagtaggtaaacagggtggtaggacattttcctctctgtattcatttagggatctaagctgaaggaggctctgccatcttccacacaaggtttctaaggtcaccttaggttatctctattccagccagcaagaaggggaaaagagctgcagaaatgtgtttaggggttttttatgggccagacctggaagtggcactcatcacttctgttcacattccattggccagaactcagcaggaagaggaggaaaacagctgccactcatctcagccacagagtttttcaggggtctctaaaaatgtatgagacttgaaaaaaatgtattgactccaaactccagacataaaattgcagaattgaaatgaataaatgtttaactaaatgcttataaaatggagccttatatcagcttccaaagttgttacagtttgtatggaaaaaaatgtaatttcttcctaacgaacctccttgcttctttccctgccttctctactatatttgaaaagattttgtaagttggaatttggaatttccaagaattcccaagtactatccagtgattgctgagaaattataattagtcataaatgagtttctcaaggccaaataaattcaaacgaaaaatcttctcaaattattttgcattgcagagaaaccttttaatgtgaaatatgaatacaatttaatatgtttattttgatgttgagtgaggccttcaaaagtagcaggatcatggcctacagaggtcttaacattcctattgtatgcagacacatttcaattgctttgaaaaggtgtatgttgaaggtaactaaacacattttgcatttcaagctcagaaaatttcccctttagattcccttttcttttctccttttattttctaataaaatatttactgctgtgatatccaagaacatgaatgatactgcattgaataacccaggtgcttggtctggtggatgccagtgccagagaagaaaagtgccctattttttcagttatcatgtttgaaggcgaggctttggtctgccttctgagtcattcttggcttcttggatgatagatttcttaaattcttctattctcctaactcaaggcacttctgaatgggtgtttgcgagacgttgtttgaaaaaccacttatcgtgatggatttttgttcttctattttttgctctcttacacactttgctgttgtcctgccaattggaatttgatttgttaattacaaaagcaaactatccaggatggctctaaagggacttcgctataggttggggctatgatagagactttcgcgaaagggattggcaattaagaaatatagcaactgcttctgatgattaaacatttcaagcaactctgaaggtagaatgtggggaatctccagagaaggaaggaaatagagagggaactaatatttatagttactcctatagtcatctccatctcagtacaggacatcttcatccttccagttgttcagaccaaaaaccctggaaacatccttgacttcgtctttcccattccacatttcacccatcagcaaattctgttgcatctgtcttcagaatatattcagaatccaaccacttcttacaacgtctccttctgccatccttctccaagccactagcatcactctcctggatcatcgcaatttcttcctatctagtctccttgcttctttccttgcctttccctacatagcaatcaaagtttagtcttcaaaacacaacaaaacaaatctcttttctgttcaaactcttttatgtttcctcaaaatgttatacgtagagttaccatataacccggcaattccactcctagttacccaagagaaatgacaatgtatgtccacacaaaacctgtacatgaatgttcacagcagcgttattcatgatagccaaaagtggaaaaaacccaaacgcccatcaatgatgaatgtacaattaaaatgtggcataaccatacaatggaatattatttgtcaataaaaagaatgaagtactggtaccatgctataaaatggttgaactttgaaaccatatgctccgtaaaagaagccagtgacaaaaggccacatattacatgattccatgtacagaatagacaaatccatagagactggaaatagattagtgattgccaggagctggggagagaggaatggggagtgactgctaatggatgcagggtttctttttcttttgtggtagtgaaaatgttctgaaattaagtagtggtgacgattgcataactctatgaatatactttctggcttgtatacttttttgaaggggaaaattgtgtggtatgttaacgatatctcaataaagctgctattacaacaaaaacaacttctttggctttctttctgatctttttccctgaatcgtttctgacctcttcccctactcttcttctctttctttttaacccactcagactggcccctattttgttcctctaacagggcaagtgcttcctgccatgggcctttgtattttctcttctctctttttgtagaactttcttcccccaggtatctgcgtggctggttcacttgcttcctttagctctctatttaaacatcctattctcaggagactttctctgattacccgaaaatagtactccctacttcatggcctgctggcgttctctgtttctttcatcctgttttatttttctctgtatcatcaacatgtgatacactgttttcttgtttgttttttatctgtcttccaacattaaaatgtaaactccatgaggcagtaactaggctttgtttgtgactgtatctgcagtaatacataccacacctcttttcactagaccattagcttgaggaagacatggatttccttggcactggtgttgaattgggactaactgtatttgcaggaggaatattcagtgtgtctattagatgctacattagaaatcatcagcttggaagcagtctccatgggaaaagtaattttgattcaaagggtagaatggaactactcaggttacatggtcttttattgtcatataaatctttgtacagagttcctactttttaaaccattagcattatgctaatatacaaagtttgctacttttcatatttgtcttacagattcaaagcctttagttcttttcagtcttaatttaccacctgtctgctctctccttttctcccttggaatgttcttaagatttaattttgaaggaactttctgtcagatgattattggtaaagtaaaatgtatttctgggaagcagctgattacttgggcctttgatttatttatttatttttttttttgaggagttcatattgcgatatacctatttggtggttatttagaaaggccaaggtagggagaaaaaggaaagaataaaatatatgtatgctttaaaaaaaagcaagcatttagtttggggagccctccaaatgtgatttcttctactcctgttttcctgcttccaagcataggtggaagatattgtcagtttctctgaactcctaagttgaaatgtgcaagtcactaggtggcactgaagtatcattctccacacagccacgccatagaacacttttgttatcttgctccagctgactggatttctaggtgtcagggaaattgttttattggtacagggcatagtgtaatatattcctctccaccctaggcagctacttaacgccctgaaacatgcacctcttgtggtcatggcctgttaactatgcttatttggtgtaataattagcagaatttctcactaacaggggtacttaccaacacctcacatcttcactgtgtttttgtacgtgatggattgtacattctgtggagaaagttgggaaggtcaaagcttaacctctgcctaacaggactagttttcgcacatttgttcagaataggtttatattaactggcttttgagcttcttcagaccagaattgtgtgtaacgtaaacatatttgagcttttatgtaaggacctagtgaaggtttgtaaacacaacactgttaattttccaactcatagaatgacagaaaaataaatgaatagctgctggaataattggacgacacttgttactcagaactgtgagtgttggaagcgtgtcataggaacagtgggcctgccacaagcaccacattttaggttaaaatcggagaagaaaattacacatggaattttaattttttccatggtcgtaagttcggccccatttaattctttgtggtttttacaagccctcttaggctcctaatatttctatagcaacaatttcaacgtttattttagaatgtggtcagaattaaccgacagaagaccaaacaggataaaataggtttaaagcaggaaatactttagctggaccactaacttaccctctatgaccttaggcaaactgtttgccgtctctgtgctttgattctctcatttcttaaaatggagattataatacgcacccttgtgtgtctcctccaccaggtaaaagtgaaacaataacttctcaatatacctttgcttatattcaaagctccaggtaaatataagatgttgctataattacctaagaaagctaggaagatttttctttgttgattccaaggtgagttgtagaaattccagaagatggattaatgtagtctgagggctcagacttctgcatctgtgtagatagtacctattttcatatactgtggcctggctctgtttctggcctggctctgtttccaaggtttaagttccattcttttaactgtgtatcaactattttcacttggttgttctacttttacttaaaccctttatatatgtctggatttagttgtaggaaacagaaactatgtgagatagggaaataggttgatataaagtcatcaggaggaccagagaaatgggctgaaggtggagcctccagagatgggcttctgaaacaatattacagattggcttgccagggtagccgctcatctgtcacactcgggaagggctaagaatcaggagtcattcctagaactgttgatttgtaagaacacacaaccatagttgtagttgggatcaggaaggtaccaccattacaactggcatttgagaactacaaagtgaatggccagattctggaatgttattgcctcatgactatgttgcctgcagaaaaagttgaaacagcaaggtgatggcctccattttatttttgacttctgattctcacatgccgccattaaattggtgaagcttatttctcatccagaactcctagctgcaaaagggtctgagaaataatagtgtttaccttttcatcctctgcaccataggaaggcacaataagaggagattggaagggtgctgagtgccaccatatctacctcttcccccagcatgtttaaaataaaatatctttacctccaactcatattgcattttctgtccagcacagcaactagcttagtgggccctcagtagatgtgttaatgacattgacttccttatttcttatatggccccacctttcctagtcacgtgtcttggtactatgtgagatttcagatccacctgcctacctgtaactcttgattccttttcatttccattgctgtctccttgttcaggtccagctcctgtctgcctgggcttttgcagtagtctccttatctggcttttggtttctttcaccgtaaccatattataagtagattggtgtttaaaaatcagaacaacaaataacaaacatccttccactgtgctcctgtccttctcaaaagctttctgaggctcctcattacatgcaggatagaatccagactccttagcttgactttcaggaccttccataatcagggtgcaatctatcattccaggcttatctttcattttccccctgctggaactgaattttagccaaaaggtctaatcactgatgtcagagtgtcttgtcctttactaacttttcagctctgctatccttttgcctgcttttaatagtctgttttctttctcatttgtttattcctttgatcacttaggcacagagtttttttctcctttcttcatacttatagcatggtttactaaggcattttaattttattacctatatcgttagttttctttttatgactatatactctccgctcctttttatgtcgacaatgtaaatatttgttgtggattgatttgttgatttttcatggtttagacatctacttgcttgggaaaaaggggatggtggagggtcaatctgggggctgaagcggtactctagctgtgtgattttgtctttttgattactactgaaattaactatttgctttgagcaaactaatgctgagttttgtggatttagtgtttgaaaagggccctgagagggaaaaccctggagttgagctccttatccccgtttgccaggctggatgagctccatgtccataccactgcattgcagtttgctgaagtgtgtgttgtgaaatagcaatggaatttgtctgtggtttcttgccagcgaggaggaggaagaaggattctgagtaaatcagacatgtaaattagtaaggcccatgggccttaagcgaattacacaataaagcccaaagaaattcactttggcttctttctgctttttgtgtgtgtgagaaggcagctattatgtgtttgctttaggccagaggttcacaaattttttggcttcagaacccttttatactcctaaaaattgttgaggactcaaaaagcttttgtttatatgggttaaacctatcaatatttactgtactgggaactaaaacaggaacttttaaaagcctttattgatttaaaaatagcaaaaccccttcattacaagttaatgtaacattttttatgaaaaataactcttttccaatgtaaaaaattagcaagaagtgtgccattgttttacttttctgcacatctctttactgtctagcttgatgcttgattcttatacttttttgtttagttgttgaaatatgttgttttggttgaagtatatgaacaaaatctggcctcagacattaatggaaaaagggagtattttaattgcttcttcagctattaaatgtagatattcttctttgatattattccaaaacttgtcaagtgatagcttctattttaaaacatttttgtttttaattgacaataattatctatatttatggggcatgctgtgatgttccatgtacacattgtggcatgattaaatcaagctaattaacatatctgtcaccacacatacttattatttctttgtggtgagaatacttaaaatctactattttagcaaatttgaaatatacattactgtttactagtcagcatgctgtgcaacagatcactagaacttaggtctcctgtcaaactgaattttttaccctttgactaacatctcccctttctctgctctatcccaccaaactctggcaattactgttctgctctctacttctatgagtttgacttttttagattccatattttagggagatctgtacctggcttatttcacttagcataatgccctctagattcaagattcatccatgttgtcacagatgacagaatttccttttgtaaggctgaatattattccattttctttagacaagtgataatatcttaaagcttacttgcagtgtggaatccgaagctatctcaattaacttttcttactttgttatattaaaatctgttgatctcttttgcactttgaatgcatcttttacattcaaatgattttgtaacattacgttttgatcatttggaaaattatcatgtcactgagttatacagatcttccaaatgttgatgcatttcattatacagtgtaaaaaaaggtcacactcatcagtatcaccactgatcttatacaagtttttaagtattgaaaagccccaagctcaaggtagcaaatacaaattttctaaatttctgatttttcttgacaacctgaagtttatcattggcagcaaatatggtcagttgtttttcttgaagtggcaagctcacttgattaattgttgagaaaaagtctgccaaatactcaagtccgattaaccagaaaaatgtcagtcagctattttttcaagtaaaaatggtgttccatggggcaaattcagcccagaactcaaatcacacatgtacttttgtttgagacaaccattttactttagtatttatcagaagtactttatgtatgtttactattttgtcacacagtatagtaaaaagatagctacttaaagctcaagatttaatagaattaataatttttcctgcttcaccaaggacatgcttaagtgaaactaacttcctttttctttctcttttaaatggaatgcatggtaaagaacatagcaactagtaagtttttgaggtctattaaaacagcctgctcactatagttaataataatgtatatttcaaaattgctaaaatggtagattttaaatgctttcaccacaaagtatgtgaggtgatggataagttaattagcttgatttaatcattccacaatgtatacaaatgtcaaaacatcacattgtactccataaatatgtattacttgtcaattaaaaatagatgttaaaaaaactgaatactagtttagtttggtaccgctggcttgattagtgacaaggcacctgcagttttacccagcattctttaaaccgtcagtggaaatgtccacacggtgaaaaaagcaagtaatagtattattctgaaaatagtattgatcttgtggaacctttgccaatctactgcactatgccaattaggaagatttgagtagctaaaaattccaagagtggaataatagttttattagttatatcttgaaggccaatttccttttttaccctggaacttaggctaagtgaggcaacctggaggagaaaatttctctcctgtcctgagattgctgttagcccagggtcggaattcctggggcctgattttttgagtttaagaagcacagggaggatttttttttaacctgcctttggtgataataaatgtttaacctaaatcaatgtgattgtggattttttttttttttttgaattgttgtttctgttagaaaaataatgaatgacaagtgccgcagagatcagttgtttgtgagatgactgagaaggtaataggacctcctatttgggacattaaggaaagccttctctaaaaaaagaacccattttgagcaacatgcgaaaattctttgagtcagttggcctcatttgtaagcctttgattgctttatttgtttgtttgcttgcttgtttatttatttatatttggaaggcaatctttctgcttcctgactggctgtcagatctcccaaataacatcatccctttgctggtgtgaatatagcctagacttgaggcagcaattaactgatcatgtaatagaagaatcccaatcttccagtttctttttttaacttcttgggtggttggggcacatcattgcaacaattattacatttactcaagagtttgtcttttctattaaaaaaaaaattccatctaagtgccttacggtgaagaggaggagattgtgtaactggagtctccccttaactggtctttattgttaaagaagagtgatccctttgtgtttcagcttggcacacagaaactgttttaatttaacagtccagctcctttaatagatcaattctctattgtggtttgaatttggtgcactcccaatttactctaaacttctacgggcttccttggagaaactggggcagagatgccgaagactcatttcgggtacaatttagagtttgtttatttatataaatgtaaggggtaccagtgcagttttgttacatggatatattgtgtagtggtaaagtctgggtcagcttttagtgtaactcatctgaataatgcacattatatccattaatttatagttttatctcaaacctcttattaattaatgctagccatggaagctagctagcgcttgtaaatgcctgctgtgtgttagatgctctagtaggtgttttagacaccctcatctaatcttcatggtgattttctgatatatcctgaacctgtacaattttctccacttctgtcactactactacaggccaagccaccatcatttcttgcacagacttctgcaccctcaatgtggcctccctacttcaagttttaacagtcttctccctctcataatccactttccagacataagttggatttattttaaaaatatatatcaagtgatgtcacctcactgcctataagactcttcagtgacttaatgacaaacagaatgagatccttctcctgctctggctgacaagaccagaacaacctgggttctatagctctgagagctcaccagccactctgtccttgctcgttcactgtgctccagactcactggcttgctttctgtccctggaagccaccagactggttcttccttagggcctttgtaccagctgttcttcctgcttgggacactctctccccagatctttagtctgggcctggcttcttgtgatttgtgtcttgcctaaaatgacacccactcaatgtgccttccctgaccagctgagctacagcggtttccctctaccgcatcactagattttactttctttctttttgtttgagatggagttttgctcttgttgcccaggctggagtgcagtggcatgatctgggctcactgtaaccacctcctgggttcaagcgattttcccacctgtagagacggggttttgccatattggtcaggctggtcttgaactcctgacctcaggtgattcacccacctcggcctcccaaagtgctaggattacaggcaggagccactgagccaccacattcagcctagattttattttcattaaatcgcttgatgcagtgcagagtgagtttctgctattagactgtctggatttcaatcatggcctcgtcatttactggctgtgtgattttggagaagttacttaacttttcaggactttcatcttcttctttataaaatggaaatattattatatccctccattgtaagaattgaataaggtagtacttagcatcttttatggtttctgacacattgtacataatcaaaaaatgttaaatattgctattttaatgtaatgttattaaaatcattgcatattttatagcttatttatttggctatttttctgtctcttctaccaggaatataagctttatgagggaaagaatcttatgtgtcacattcccaactgtgcccctagagcttagaacagtgcttagcacatagtaggcattcactaaatctttgctgattattaaaatctgagatataattatccctatttttccaattgagtaatcagggttcagagaggtaaagtaacttacccaaggctacgcagctactaaatgctagtagttcctggtatttgtactgaatgctgattacaaagaccatgttctttctgttatgccacaatacataagtggatctttatttcagattctgtcatttatagcagatgattttcaggttgcctttttatgtaaatgtaacatgactcatgaaatgtaaacagccatttgtgtgaacatgaaaggtcagagccaagagttaggccacaggcaagttaggaaagtgagatatagcacacccaccacattcagtggtggaagaaaagttacctgattcctgccttggagatgtgtagggtagtgaccttggggttgggctgcctgaggaggttcctatgctttgatttctgaatggacaggatccctaaagtcatcgaccctagtttgggctcttgtacttcttctatcatcttattctagttggtggaggcagaggttgaaaaatcaaaatgttggctccttcagcctctaaaaagtaataggcttgaatttgcttttgtcactaacatgattatggtgcttggtctgtgggggcttcactgatgcattctttttaacagccctgtttgtttgtttgtttgtttgtttataagtgagcatagcacagaggaaaaaatataggttttggagactggcacatcagggttcagatttctgctgtgctacttcttggctgtgttttggcacgtgaacttctctacacctcagtttctttgtttatgtaatggggattcatatgacaattaaagagagagcttgtctaaagtgtcttatgtagtagtatccccagtttgacccttttgagaatctgatgacagttatggaaccctctccccagacaagtgcccgtatacccagaactttgtatttaatttcatggggttcatgaagcctctgaaactcagcttaagagtccataccaaccaaggtccttataggaagagcttgtgtttttgttttgttttggctttctgcagtctcttaataatgtttattgaatgagagaatttaactaatttccggtttccataatcactttaaactcggtatttgatttccttttccctgggacctgtgacagtgccagcttcatagcctagtctaggcatgccagttgcccactgtggcaatcaatatctgagcctgtggtttttgccttaggtaaactgtagagatggactcatggaatgcttggaaaatttttcagtttatgataatgtgtaaatgtcgagagccaattattgaggaatggcacctcaaagtatttgggtactctagatcagacatgaccatcttggtgtgtgaaattttgctaatgcatctttcctaatagaatatacaatctcagggctagaaagtcttagagatcatttaatttaattcctccagattgattaagtggtttgtccaaggtcattcaactggtatagtggcagagctcaggctgtacaaatcaggtgagtattcttcagctcctcagaagccagtaacttccactcacttgtgtgtgtctgaaattcattaaaccttcgacacaaagtgcagccattttaatgctgaatgatattcatcactgtctgaaatgggcttatttatgtacgaatgtttattcctatctcttcctccattctcccaaaatgtaaaccccataagaacaggaatcttgtctgtcttagtcacactcagtatccttagagccttgtgtgtagtaggtgtgtagtgaattttggttgaatgagtggcagttctaataatgtcagaagaattggaatttctttacagaaatctttatcagtaatttaacaaacatcgattgaacctattatgtatcaggcactataccaggcacaggtacgaatgagatatggtgctcagcttcaaggagttacagtctaaataccaaaataacagaatcaagagcagcagactaaattgggcccactgtattttttaaaaatttaatttgactgctgggtgcggtggctcactcctgtaatcccagcacttcgggagcctgaggtgggtgaatcatgaggtcaggagtccgagaccaacccggccaagttggtgaaacactgtctctactaaaaaaaaatacaggccaggtgtggtggctcacgcctataatcccagcgctttgggaggccgaggcgggcgggtcacgaggagatcgaggccatcctggctaacacggtgaaaccccgtctctactaaaaatacaaaaaattagccagggcgtggtggcgggcgcctgtagtcccagctactcgagaggctgaggcaagagaatggcgtgaacccgggaggcggagcttgcagtgaaacgaggttgcgccacggcactccagcctgggtgacagagcaagactccataaaaaaaaaaaaaaaaaaaaaaagtaaaagaaaattagccgggcgtggtggcacgtgcctataatcccagctactcgggaggctgaggcaggagaatcacttgaacccgaaaggtggaggttgcagtgagctgagatcgcgccactgcactccggcctgggtgacagagtgagactttgtctcggaaaaaaaaaaaattaatttgaatgcatgctccattatatcctatgtcttttaccttcctgctttgctcatttaactgcctgatttctgatgacatttaagttcaggtcttaggttctgtagatcagtggtttctaaacctggttgatcatcacctcacctcactggccttagaaacaatacagaccctacttctggagattctaaaccagggctgagatgggcccttggaaactgtattgaaaaacagtaactctatagtcacttacaatgagcagccaaatctagctagatgcccctgctttatgggtgagtgttgagcatgagggtttcgtcttaaaacctggacttgatattctatattcatagcatctttcatatccttaaagattctatgtacttttcagcacattgttctgtttcaaggggctctgcaaagtatacttgctgtctgtacatttccactgtgaaaactccttgaaatcatgtagacaaatgaaagctaaacatcaaataaataacctaaactggtaatactcccatttggctctccttgtgtcttttcatgtgggttagctcttcaaccagattcagcatataaattgagtatgtatggttatatggtgactttcaaaagtaaatactttttctgtggaacaaaagagatggatttgtggttttccaggattccttttccctgacttggtagaaagatagccaggcatagctcagcagacctgaaaataggtgagctgtcaaggtgttggcagggagaggctcctctgggtgggacttggggcatcctaccagcgaaaaagagactaagtttaagtgatttcacatttgggctttacttactataattgctgaagtgctaaattgagtgtgacaaatctaacaggtaattgccaagtaggtttcattaccagtcattgcatagataaatgatgttccttatgttaaaaaataaaaccaaactaaagaaaaaaaattggactatatttggaggtagaattcagatattgcagatatgttcatatacatcaaagctgtttcaatgtgtcaacgaactcagttcatttacctctgccaaggtggtatagtgtatgtgggagtgcagagtgggggaaagtgaggaggggttgtgatttatgagaaactgtaaaagaggttagaattgggaaacaagtttttttcttagaggagtggcaaatagtaagtagcatttggacctcactcagctctaatagttaaagctaagctttttgacattatcattatatattaataatatatatgtgtgaccagcctcaatagattttattcattagtaacttggttgatttaatgaaaatagttttaaaaggcatactgaagcacagtaaaacctaaggctcacatcactgtctggggagtcagtgaggaacagggcagagtgccagtgcatatgaagagggatttttttgccttcttggttcactgcatattcccagtaattggaacaatgcctgacatgaagtagacataaaataattactgaatgaaagtggaaaggaaagtatacttagtctctgctttcatggagcttatatgctagtgggagagagacaaaaattaagtacaaataaataaacagaatatatgatagcaactagggtgagagtgctgtttttgataggatggcagggattgggccatttggggaatgaattgatgagaaagagaaagttgtgcaaagctgggagaggaaacatcatttgaaggacagaaagaaggcctacatgatttgagaatggtggagagagagatttgagggacagacttgctatgattaagaaagatagctgggcgcggtggctcatgcctgtaatcccagcactttgggaggatgaggcgggtggatcatgaggtcaagagatcaagaccatcctgaccaacatggtgaaacccggtctctactaaaaatacaaaaattagctgggcgtggtgacatgcgcctgtagtcccagctactcgggaggctgaggcaggagaattgcttgaacccgggaggcggaggttgcagttagccgagattccgccgctgcactccagcctggtgacagagcgagactccatctcaaaaagaaaaaaaaaaaaaaaagaaagtcatgataaagagtgtggattttattttacgcaaagtgggagctcattaagaaggtaaaagtttttaagcaagggaatgacatgatttgacctactttttaaaggaggttgctctgacggctgtagaggatagaccataggcaggggacaatagagagaccaggaggaggctgttggagtgtgttaggcgagatatggtgagtggtttcagaggcttgtgtgagaaagttgatacactgcccctaccccatgcaaacacacactttcttttcttatgatgacctttctttaaaagcatttgttggaatatgagattataggccataagtgagaaaacaactctttttgagctgtgaggaatactaggagaggagaaagtgagctgtgtgtgctgcccatggtggtacgctgctatggttctacagttccagtcatttttgacagcatggattcaatgcaaaatggcaacacacactctgtatcttttggcagatcagaacataatgaaaataaaataaaaaaattcaaaactggctcttgaatgaaataggattcagaagagatgatctcaaatctactttatgagataatgtcctttttaaaaataaacactaacatcagttatgcatttagaatgtctgaattattattctaggttccttgcgactgctgtgaattttgtgatgcacttggatagtctctgttactctaaagttttaataggtaacagtcagaaatggagtgggagagcataaaagcaaactgaaatgcaaatagctggtaccctgaagccattaactttaagctggttattcctgacctactgtttggacataagatggtagagaggctgagtgtgacttgaacatttgttccttagaaacaccatccttgggctgggcgcagtggctcacgcctgtgtttccaggactttgggaggctgaggcgggcagatcatgaggtcaatagatcgaaactatcctggctaacacggtgaaatcccatctctactaaaaatacaaaaaattagccaggtgtggtggcgggtgcctgtagtcccagctactcgggaggctgaggcaggagaattgcttgaacccaggaggcagaggttgcagtgagccaaggtcgcaccactgcactctagcctgggcaacagagtgagactccttctcaaaaaaaaaaaaaaaaaaaaaaaaaaaaaaaagaaaaagaaacaccatccttgtaaagagagcgcatacaccttcaatttctagggcagcagcgtttgctttacaacttctatgtcttggtgggagtagcactatctatcaccttatgggccaaagggaaaaagtccagtgaaaatggctctgatgttgttggaagtgggaaagcaggttaataggttcttcttaatggaaaatgcagccaatattggccaacttactttgatttcggtagtcataacaccaccctggaaggcaccctagatagaggtcacttgctaccactcattttacagatcaggatactaaggattttcctgattttaagcattaagtatggatatccctgttggttgaagttaaattggtcaactagaatttaaaagcaaaaattaaaaaaaaattattttgtattaggtttcaaaggaattgttgtcagtaggagaagcctgattgttccttttacgctgactcatacagtttcagcagattacatttgaggcctaatgttgaaatctcatctgtaagtctggtatatctaactaatcatataaacatctttcatcttagactgtgtagcatgtccctagtagaccaggtgggccaaatgacattatagttaaatcaagccaataaatatatgagaaagaaggcaaatgagcgtagactccatagtgaatgatggaggttccgacgagtcaaagacactgaactattcattgctattggtttatggaagagcaaacccagatatgtgttatgctgattctgtgtgattggctacttccaggattgaccctgttctcctgtcctgctcaagtctccttccttcacttaaccatatattgtgggtactcagaaatgccatgcttttgtttagagtagcaggattggtgttgaagatcaacaagaaaaagcaaaatgggcttgtctgtcccatcaagtgatgtgctgtcaacatatgtagaatatgtgccctgaattaggagaaaaaagtagagattcctgagtttaggaaattataatctgatgcatcttcttcagactcaagccttacctaaagtttgtaaattctttctctttcgtctttattctttctctactcttaacatttttttcccccacctctttggctatatgctgttctgcttttgatacagaattgaccttatttggccagatggggtggctcatgcctgtaatcccagcactttgggacgctgaggtgggcggctcacttgaggccaggagtacgagaccagcctggccaacatggtgaaactccgtctctactaaaaatacaaaaattagccggacatggtggtgggcgcctgtaatcccatctactaaggaggctgaggcaggagaattgcttgaacccgggaggtggaaattgcagtgagctgagatcaggccactgcactccagcctgggcgacagagctagactctgtctcaaaaaaaaaaaaaaaaaaaaaattgacctttttcatgcccaacctctatctccattatctcctagctttttggaaaatatttagtactggcatttcttcttcactgatttttcattctacctgtctttagtatcataggggtagttacctcagcgggggtagggagaccttgggtgtctcttacttgtacatactctgtcctctataagtaagtgtgtaaatacactgtattttcccattcagacatattgtgtaagtaataggaaccaggtgtttgaataaattaaccaagtgccaaatttcattttggaaatgaaatattttagtttaagactctaggacatttataaagctgaaatacattgcaaagtgatgaaagctttcttaaattctgttatagtcatgcaccttaaaattattcattgttacttatagttattatctgtctgtatatgctcatctacatatgtaaaacatgaagatattctctcaagtgaggacttcatgtgccagatttttcagcctggattgaattttatggatgagagagataccctggaaatggaaccattggcataaccttgtgtctaatataataacagagctctaatgaactgcaacatgagctcagatctgcaaaatattcagaggatataggcaaagagcagttttttcctccttatgagctaggttgttctccaaaagcaacaagtactacttgtcttttcagagcgctgtcatggagctgtaagtctctttgtggtttagacttaatgtgagtaagattcctctgcattctcagcctagaaaaacttgaccgttctcttggaatttggtgaaagtttcctaactttgaagctagagaatactctcatttcagattaggcaattattaacatttttttctgttctaatttcatgatgccaaaaaatcatgtatggttgatctatttggagaacaatatgtagcctcagacacttaagatcatatgtagtttagaaataatgtcaattgcatatgaatgttttgatgtttttcccccagcctttctgaattttttgatttcttcaaattgtacctggttttttatttttgtttctgtttttgtttttgactttcacataaactgtttatagtgtctggaacatacatatatatatatatacacacacacacacatatatgtatgtatgtatacatgtgtacatgtatataaacatgtatatgtatgtatattccagacaaattatataaatgtatgtatatatatacaaattatatatacatatacgtatatatatacaaattatatatatacatatacgtatatacacaaaaattataacacaaattatatatacatatattttgtacatatacaaatatataatatgtttgtgtatgtatagttatatatacacataaatattttgtattttgtatatatgtatacatatacattttgtaatatatacgtatatattactatatgtatttttaattgtaaaatacacataggataaaatttataattttagtccttagccattttttttaaccatttaacaagtggtattaagttcatcctcattattgtggaacccatcaccactatccatcttcaaaacttttccagcagcccatactgaaactgtaccaattaaacaataactccttgtttctagcttcccccagcccctggcaaccaccattctattttctgtctctacaaattcaactatttcaggtaacacatataagtagaatcatacagtatttgtccttttgtggctggctagtgacgacattaagattaaaatcaggagaaacagggtgggcatgttggctcacacctgtaatcccagcactttgggagcctgaggcaggaggattgcttgagcctaggagtttgagaccagcctgggcaacagagtaagacccccatctctataaagaaaacaaaaccaaaataaagcaaaaaaaaaaaaaaaaaaaaaggagaaacagatttaagacagtcaggaaagaaaaatattgactttgattttggtcttattgaatcttaggtgctggcaggtgaggactttcatgttgtaatatcctgaagacagtttcaaatataggtttggaatggagatgaggacttcagagttatcggtaatgaactcattttaagaagatgagattgcctaaaggaagaatgttttgtagagttagaagagtgggatttacctgatgatcttaggaattctggacatttatcttaaattgctctttaggaagtttagtagaaaaagaaaggatgcagatagtgtctgctattaaaggcagaggaagaaagacctgaaacagagacagagaagaagggagcttaggttataggaataaaagggagaggatgtcatagaaacgaagggaaatgaggattttgagaaagagatgcaagtgactgtgcccagtgtttccctaatgaccaagaggatagttctgggttttagcaagtatgagttggccattggccttgggaagaatagtttcagcagaatggtagtggttgaagccagatcctcataggggttagggccaaaagaaacagtaggaattctaggcatttatctgaaattgctctttaggaagtttggtggggaaagaaaggatgcagatagggaatctcaggcacatagaggttaagtaacttgctcaaggtcacacagtaaccttaagtaggcaggataagctctggttctggagctggtgctcttcatcattattttaggctgtactctcccacctttttttctttgtggttgtaggtggttgtaggctacttaaagagatacctatacacctgcagttaaaatccaagtaactcagtggagagcctggtccttcgttattatgtctcagattgaagttttatattttacagcatgatgaaattacatatatgatggttaggttaggttgcaagtcttggaatatatgcagaggaataactttattacaatgactatttactttttataagacaatccagcaatggtaatttttcattagtgatataattgcaagaggaaacttgagaacagaaaatggacatattgaaataagattaaatacatgctgatgaagttacagagttttatgcaacgtttcaatcaagaaagcatgataataaagcgtgtataggccgggcgcggtggctcacgcttgtaatcccagcactttgggaggccgaggcgggcggatcacgaggtcaggagatcgagaccatcctggctaacacggtgaaaaccccgtctctactaaaaatacaaaaaaaattatccgggcgtgatggcgggcgcctgtagtcccagctactcgggaggctgaggcaggagaatggcgtgaaccctggaggcggagcttgcagtgagccgagattgcgccactgcactcccgcctgggccacagagcgagacttcgtctcaaaaaaaaaaaaaaaaaataaaaataaaaaaaataaagcgtgtatattgactttccagaatcttgagaatggataaatggaaacaaagagaaatacctattttgtattataaacctctaaaatagttactaaataagttattcttttaggtatttttctttcacttttcatcgctattaggcaaaactgatagtcgatgtagctgtgtcagtagctaagggatttttgttgttgttgttaaactaacatgtcatatcttgtataattcagctgtgactatacaggggaaagtatttaatgtctgatgattatacagcctgtgctttggaaacagccgaaagccagacagcgacagtagagggcaaaggattattaaatggatagtcactgaggtcacttatagtgactttactgcaacaccgtgtgcatctcctttcccatggcaggttgtttgatcatggcttaatggctaaagctttgtaaaattataaaaaaagccagaaatcctgctgatctcaagtgttatttacagttggatgcttggcaggaaagtgctaagtctgatcatactaatgctaagtcaggcagaacacgtggtgaaatctcatggagctctatcctctgaaccttgagaagactaccaaagtataagatttcagggtggaaagtatgctgcaatatgattgagagaatttggctttttcatctgaacaggtgtggccaagtggaggagtttctcctcttggaaatgtcaaggggtgtatcattaggtccttggagctagaatgtaggtagaatggcaaggaaggaattttaattagttctgttatctttcttttatggtttggaatggtattttctttggtcatctattcacttacaaaattatggacagtatttgattgtgaggaagaatcttgggtaagtgttatctttgttttcagtagaattacttggagctggctcaaggaaattatattagtagtttgcaagtgagttacagctaatggagtcaaaagaagtttgaaaagggtcaaaagaagttagaattgttccatctgagtctttggcccttagtaaaggatccagcattttgttttgtttttgcttatgtctttgatattaatatatttttcagaatattataaaccacccttccccaaagttttatttccgcaatcactccctaatctttatttcttttttgcttcgcatcatatacatttttctcttcaggacaccttcttttcccttttgaaacttggactatgttcttaaaattgacgattataggtaagaagaccaagtttgtgagacaaatagaatttgatattcaaattatctgaagaactgaagtacattattttgtacttgtttttatttattaaaaaaaatttcccttggaaaagaaattggtgagattaaggaatgctatagctaactttgtaggatatttggaaaactatgagttatagtgaaaggtgctgtcttagggagtacattttaaaagtgctagaaaatataatattacagcttgaatcaagagaagtgaactctgctagggactaagtactttgttagaaaggtgctcataatagaatggcgtgaacgcgggagacggagctttcagtgagccgagagcgagactccgtctcaaaacaaacaaacaaacaaacaaacaaaaataaaatagaaaggtgctcataataaaatgagaaataaaaaaaattctaactgatcaaatgggacaaaacccagattcacggtctttatatgcaaataaagtatagattcttagattcagaacagtaaaagaaaaatacctagaaaacaataaacaaaaggcatgaacaggcatttcacaaaagagctactgcaaagtcacaaacatattaaaagttactcatcctaactaacaatcaaataaatgtaaattagagcaagcaaacttgtttttccatttatgaacttgccaaagatttaaaagtttgataataatgaatgtttgagtatatgaagaactgggtattatttgttgatggacatgtaccatagcatttttctggagcgtaatttcacaatgtgaatcagaagtcttaatagtgcatacgttttgacctagtgaatctcctgctaagactttttatcctaaagaagtcatctgtgccttcttgtcaagatggtactgtaagctcacagtttgtacataccttctgctctaaattcataggaatggcagatataatgcattaaaagaattaaagaaaaaagtcgtagctgggcttacagacaagatagtgttgtagacccgaaagctaactaaacataaagggctagtaagctggattgaagcgatggtgctgcagaggctctggatggagaaacagaaagctagatttagctcccatagagtgctaggactgaaagtttaccacttgaaatgggaccataactaagctcactgcttaaagccaggggcagggatgaagttgtcaatcctataaaaggaaactaaataaaggctccacatggaggctccagtttatatggagctgtgggtcttgaggggcaggaggagatagattcaatttcaagaatagcaactgaatcaggctgactgtgaggagacaataatgagaaaatgtggtgttccatgttacaattatgaggtttggtcctggacagtagcacagggatcctggtggaggcagctgcagaaacactatggagggaaaggtgagcacaggtggagagaaaggggagtaagagaagcaaagaagaaaagcctttcacttagaattagccttcaaaatgcaataccaaaatactggaagaaaataaataccaagaaagatagctaacaaaatcaacaatgagaacaaaaatttatcccagatgagatgaatttttacagaaaagtcagtcaaaaattaaaagaatcatgttcagaatactcaaggggataaataaaggcattacattgatgaaaaatgatgtttaaaaatactcccaagatatgcagaaatggaagaggaacaacgacatgaaaaagaaccagttacaaattttggaaatgaaaaatatggtcatagaaataataaacttaatagaggggatggactttagacctcacacaattaaaaagagaattgatgaattagaagagaatactaaggaattcattcagaatgtatcataaagagacaaaagattttttaaaaggcatttaggagatttgaaggatagatggagttccaacatatgtctaataagagaacacagccttgaacttttggcctcaagtgatcttcctgcctcagcctcctgagtagctgggactacaggcacatgacaccagaccctgctaatacatttgtgtgtgtgtgtgtgtgcgtgcgtgtgtgtgtgtgtagagaccagattctcgcgatgttgcccaggctggtctcaaactcctaggctcaagccatccacctgaggtctcagcctcccacaagtgttgggattacaggcatgagcctctatacctggccaagaagcaaaatgtaaagagccaagaattgagaattttcctatttaaagaatgatgagtttagatatattgagtagtatcatcatgttgacgttgtagaatttaagggatatagaggaaaaaacatttttgagatacaaaacaaaaaaatgccaattacctacgaaagaaagattagcaacaatagatgctagaagacaggagaataatatactaatatattcaaaatgctaaggggaagttatagttaattttgatttttaaacccagttagtctttgattcaaaagtgaaggaaaaatacagatactttcagatataaagaaagaccaagagagttaccatccatggaatctcaccagggaaactgttaaatgctgctctttagcaagaagaaaagtgaaaccagaagtaaggttttgttttttttctttctttctttcttttttttttttttttggagacggagtctcactctgttgtgtaggctggagtgcaatggcgcaatgctgactgcaacctccgcctcccaggttcaagtgattctcctgcctcagcctcccgagtagctgggattacagacatgtgccaccatgcccagctaattttgaatttttagtagagatggggttttgcaatgtcggccaggctaatctggaactcctgacctcaggtgatcggcccgcattggcctcccaaagtgccgggactgtaggagcgagccactgctcctggcctagtttttaattaaaacaagtgaacaaacaaaggtgggcatagagattgataaagtgtattggaaaattcactaagttattggtttaaatactactttttgttctaaaatgaatataaagctaaaactctggagaatgatgagaatgtaagaagggagaagtaaattatgtgtgatccaatattagggacacaaaaagggacatactacatgaattactaatatctaagaaaatatgatacatttgagaacttagatgaagttgatacatacctagaaagataggcattacttaaattgcttcaagaagtagaaaatctgaataaaacaatgaacgaaattgaatgataatgaaaagtccatctgtcaaatgacagcaggcccagttttataggcacgttaaaccaaatttaagtaatccttacttactcttcttccctttttaaagagttttattggggtataattgatatagaataaactgcacatatttaaagttttgacatacgtatatactggttaaaccaccaaaatcaagattaggagacatgttcattatcactcctaatttgtgtccctcagaaatccttttctccttctctcccctagtggttctgggcagctactaatctgctttctgtcactattgactagttggcattttctcgaattttgcataaatggaatcaatcaaacagtatgtgcttttgcactcgctctctctttctctctcccttttaaaaaatagattctggttttttagagtaggtttaggttctggcaaaattgtgagacaggcacagagatttcccatatactccctacctccacacatgctctgttacacacactccactattatcaatatctgccattagagtggtacatctgctacacatcattatcacctaatgtccataagtttaataaaccattagggtttacttttggtggtatatattgttgcttgggacaaatgtatagtgacatgtacttaccactgtgttatagtatcacacaaagcagtttcactgccctaaagattctctgcactgtgtgctcttttttggaggtttagggggaggcctgtcttccgtcactcagcattgtgattttgagatccatcatgttgttgtatgcttcactaattcattcctttttattgctgattggtgagttattatatggatataccataatttctttttctttttttcaatatactgcgatttctttatctgtgcacttgttgatggacatttgggttgtttccagttttgggtaattacaaatgaagctgctgtgaacattcatgtgcagatttttatgtagacatgtgcaatcatgttgtaggtgtttaatatatatatttttatgaaagttccagattgtcttccaaagtagttgaccattttgttttcatgagagcagtgtataagagttctagttttgagagcagattttcttaaatttcatgaagtttatcctttttttcttttatggattttacttctgggttcatttctctgaaatctctgccttgtgtaacttaaatactaaaagagtttcgtatgttttctaatactagttttatagttttaaggttttatattaggttttatattgatgtatttattaattttgagatatttttgtgtatgcacaaggtgtggattggagttctttaaaagatatagatatctaattcttcaagtactatttgttaggactcttctttctccatttgaatctttgtcaaaaatcaatgaaacataaatatctgggtctattgtggacctctattttgttccatttatctgtttgtttagtattatatcaatacagcactgtcttgatttctgtagttttatactaagtcttgaagttaggtagtgaagtccttcaactttattttactttttcaaagatgttttgtcactttaagtctttgcgtttctaagtgaattttagaaatagaatgtcaatttttacaaaaaaaacctgcagggatcttagtttgagattgcatcaatttggggacagtgaaatattttatcgagtcttccagtccactaacatggcatatctctttgtttaatttcggtagtgttttttaaattttctttgtataagtgtggaaaaccttttgtccagtttatctctgagtactttataatttttgttaaggtacatggtatttaaaaaaacttcaatttcagattgttggttgctagcatataaaaataatttttgtatattgatattgcagtgtagctaaacttatttattagctctaatagctgttttgcaaattctgtagaattttctacatagatgcttatgtcgtatttaaataatgacatttttaccttttaaaaatttattctcaatccggatacttttcacttctttttcttgccttgttgcacgggctagaaccttcagtacaatctggcatagagggggtgatgggaaacatccttggcttttttcctcattttagggtaaaatcattcactcttttaccactaggtagggtttcattgattcctttattaagatgaagaaattccgtagtttaccgagtgtgtttatcagggtcattgttgggtattgtctaatgctcttacatctattcaggtgaccctctagtttttctttcttagcctgataatatgatggatttatgtagatttttgaatgttaaaccaacctggcgttctgggggtaacacttggttattatatattgtcctttttatgtgttgttggattcagtctgctaacattttgttaatactttttacatttatatgcatgagggatattggtctgtagttttcttgtaatatttctgcttgcctttgggattgaaagccattaattttctggattaatttatgtagaattattattatttctttcttaaatgctttgtagactttatcagtgaaggctttggatttggagttttgtttgtgggaagtttttgaaatacaaattcaatttcattaatagatataggactatctatgtctactaaaaaggggctatccttttctttttcttttttttctttgagagcaaggcctatgtcttgatcaccattttgttccaagcatatccctggcatatagtgggtcaggagtaaatgtttggtgaatggatgaatgaatgaggcaaactcagggagaggaagtggggactgtgtctgttcttggcccagtgtggggttgtttgtggatgacatctcattctcatcctgtagtagagggataacacaaaagtatggagtctcagggctccagagtcctcatcctctgagctacatctcctacttagccgaggtcttttcactctctgggcaagtctcctcactttgctgaaatggcagcgttcctggtacatgcccggtttagcctaggctaacctcttcttgagtgaacctaggtaatttgtgtctttcaaggaatttgtctattttatctaagttctagaatttattagcataaagtttataacatccccttattatccttttaattggtatgttgaaacttctgtgtgtatttttaaatcattctggctagggattttaaattttcttttctcaaagaactagcttttggcttcatttttttttaacttttctgttttctatttcattgatttctgttgtggtcttttattattttctcctgtgtattgtatttgttcttctttttcgagtttctccaagtggaagctaaggtaattgatttgtgaccatttttcttttttattataggcattcagtgccataaatttccctcagtttactagtttaggtgcatcctacaaattttgaaatttgtattttcatttttgttcaacttaaaatactttctcatttctcgattgttttcttctttgactcatgtattatttaggaatcaattatttagttttcaaatatttggggattttctagatgtatatctgttattattttaagtttaactccattttatcacagaatatattttttatgatttcaatccttataaatgtattgagacccagagatggtctgtcttagcaaatattgtatgtgtatttgaaacaaatgtctattttgctgttgtttggtggagtgctatctacatgtcagttagttcaagctggttgatggtgttgttcaaatctcttatggtgcttttgtctacttgttctaccagttattaagacaaggatattgaaatcttagactattaattatggaattacctatttctttttgttctttcagtttttgctgcatgtttgaagacctgttattaggtgtatatatgtttaagatttttatgttcttgatgatttgactcctttatcattatgaaatgactttttctcttgtaatattttttgttctgaattccattttgtctgatatcaatatagccacttcaactttcttttaattagtattactgggtaaatttttttccaactttttacttctttacaaatctttttttattgcagtagaatgtacataacatataatttatcattttaaccattttaaagtatacacttatgtggcattaaatacaatttcacaatgtcttgtccatccttttactttaaatcaatttgtttctttacatttgaagaatattttttataggcaacctatggttgcatactgcttttaaaaaaatccaatttgacagtttctcccctttaattgggttatttagatcatttacagttattgtgattgtttctatggttggatttaattctaccacttttgtctattctttgatccctttttttcttgatttctgccttttttggatttttttataattccattttatctcttttgttggcttattacttgtaattttttggttttttttttatgttggttttagggtttctggtatccatctttatcgtatcggaatctttcttgaagtattactgtgcttcacatgtagcataaaaatttttaccacaatatacttttcatatctctttggccattgtgatgttgctatcatacattttatttctacatatgttatgaatcccagaatgtactactcttgtttttgctttagtcaattatcttttataaagacttagtgagaagtcttttatatttcccatatagttaccatttctgatactcttcattctcttaagtattcagatttttatctattgtccttttctttccacctgaagatcttccattatcagttcttatcttgaagatctgctggtgttgaattctttctgcttttgtgtgtctgaaaaaatatttatttctcctttattgttgaaatacattatagcatttccccactgtcttctgtcttccggcaaccattttttttttttttacaatgagctatttggtgttattcttttttttctttttttgaaacagagtctgactcagtcacccaggctggagtgcagtggtgtgaactcggctcactgcaacctccacctcccaggttcaagtgattattgtgcctcagcctccccagtagctgggattacaggtgtgcgccaccacacccagctaatttttgtatttttagtatagacgaggtttcgccatgttggccaggctggtcttgaactcctggcctcaagttatccacccgcccacctcggcctcccaaagtgctgggattacaggtgtgagccaccacacgcagtcttatttggttttatttttatagtttttttgggtacatagtaccttcatctcttgctatctgtgggggattggttccaggacccctgcaaatataaaaattcatggattctcaagtcacttatataaaatggcatgtcgcatttgcatataacctatgcacatcttcctatgtactttaaatcatctttagattacttatagtacctaatacaatataaatgctatataaatagttgttatatttcattgtttagggaataatgataagaaaaaagtctgcacatgtttggtatagctgcaaccatccattttttttttcagcaatattttttatctgacattgtttgaatccataaatgggaaacccatatatatggagggccaactgtattttcttttgtctgactgcttttaagactttatctttttcactggatttaagtaattcgattatgttgcgttttagtgttatttcctcttgatttttgtgattgaagtcctttgaacatcttaaatctgtggattgatggttttcatcaaatttggaaaatatttggccacttctttttctgtcttccaatctctctcctttcctttggtaactccaattacatgtattaatctgcttaaaatcatcccatagctcactgatgctctgttaacctttttctcctgtctttttcctctctgtatttcattttggataatttgccttgctgtgtcttcaggttcattattcttttcttctattataactaatttgtgttgaattattattatccagtgtatcttgcctctcagatattgtggatttactctagaagcttgatttaacgttatttctgtttctctacttaccatgctcaatcttttctcaactttttgaacttgtgaactatagctatacttactgtttcagtgtacttgtctactcatttcatcatctgttctgtttttgcaccagtttcaattagttgatttttctcttcattatcagtcatattgtcttgccttgtagtattctcttagaaacttccatgccttgttgcttttgattggatgacaaacattgtaaatttttaacatttaagtgctggattttgtgcttgctgttcctttaagtaactcatttatgttacttggaaacagttgaatcttttcaggtgttgcatttaattagaaaggaacagtgtgacattgagtctagggctatcgcaccactgctgaggtgaagtccttctgagtgttcttcctgatgttttctaaattatgacattttctatccaggctagatttttttgtatgttgtagtgttggctcccattattggaaacagaacaagacttgctaagtattaattaaaaagatctcttttgaaagccttgtggagctaccaaagcagccaggacttgagggtccaagagcagtggctgtaagtattggttttaaaaatttataagtaggattgattttaattaaaaacttttaaaaaaatgttgtgtatgttgtttttcagttaaaaattaaacaattcttaagagagatgatttctcttgcctcagggatggtgtggtgtagtgggtgtggccttgtacctgggaactaagaatgtgagttgtgattctttcataagcagcagtatagtctcttgccagtcacttcatagctctggatgggccttagtttctttatatgttctaaaattatgcaattttgtcatattaaaaagtaggtgatcaccacaacatagttaattgacacattttatatatgtaaacttttatgggaagtttttatacatttctcctgtagatcactgaggctaattaatatctggattcttattaatccagtggcattaatctgtggcctaaagtataatttgatgtggtacacatagattcctgtataagtaatttataactaggaaataaaactgtcctttccagacatgagtaaataacaacaacgaatggttgccaaaatgtattgaggggctgtttatgtgccagacactgttcttagagctttatgtattaatatcatttacatctcacagggagataagaaactagttgcaaatcatgcacctagactggtagaactggcattggaattcaagagtttggctccttaggctatacacacataacaaaggagtttgctttgttatacagacccctgcctcactgtttgaatgctatttgcctaatatctgcatagtttatagtttgcaaaaggcactaatatgtatgaataattttattttatcatcacaactctatgaaacagtgtccttacagatgaggaaattgagaatgagcgagtttgcttccgatgtggtaccgcatcgaggaagtgaaagagtctccattcaaaattctactttcgcctccaaatccagtttacttttactgtgccatattttcatggagagggaagtttttcgtaggacaaggaatgctaaatttgttgaaatggttgaaatactttttttcttcttatctaaagcaaatatggtatatgtgaaatatttacacttttttggtttagctacttcttattgatcttttttttttttttttttgagaaagaaccatgctgtgtcaccatgcagcggtgactcactgcaacctccatctgccaggttcaagcgattctcttgcctcagccaccctagaagctggaattacaggtgtgcgccaccatggccggctaatttttgtatttttggtagagacggggttccctttgatggccaggctggtcttgaactcctggcctcaagtgatccgtcttccttggcctcccatagtgctgggcttacaggtgtgagccaccgcgcctggctcttaatgatctttctagtgttagtttagatatgtcttccttgcccaccaagcaccctgcttaaggactaggtcattttcccacttaaaaccctcataagatcatgcagttattttcacaatgaacattcattagccattattcatcactgtattttgaaaagactcaggtaacaaaattaaatttttactgaacctgacacaataggatgcatagttgaagaagtattatgtggaaaatgataaatggataaagaataagtgtcattagcagcataatcttgacacggctgaagagtcaggagtgggatgaaaaatacacttcatttgtaggtgagatacacccttacatgatgagtcataatccacttaatctttttatgtaattactgtaagactctcaaaccatatctctatgtgacaagatatacaagctcagatacagcttaactttttcacagtaaagcagaggcttagggctggtgtagtttctgatatctaactttaaacccttatgagtttgagttgtggttttttttttttttttttttgagacagagagtcttattctgtcacacaggctggagtgcagtggcgtgatctcggctcactgcaacctctgcctcccaggctcaagtggatcctcctacctcagcctcctgagttgctgggactgcaagtgcacaccaccacgcctggctagtttttgtattttttcgtagagacgggtttttaccattttccccaagctggtctcgaactcctgagctcaggtgatcgtcctgcctccacctcccaaagtgctgggattacaggtgtgagccactgcaactggctgtggtgtgtttcacataggtcttttgtcctcttttactttgctagagctgtggaaatgggtggtagcctgtgtgcaggggtcttcatctgcccctcctgccaggtaggagagctgaggcttcacgctctctctggctctccgtgtggcatttgtgagcagcttgatgtatttgacacaagtgtgacagcaaagaagtgtgtgagcagagcagtgtgctgcagggcccagctgtgtggatttatctgtacatcaggctgaggagcagcagttagccagatctgacagtcaaacgtgagctccttctacctgtgctccagagcgcattttaatgttgtgtgtttttactgtggttggcatttgacacaaagaaaattgtcagagctgtttttttcctctcctctttagtgtgctagtctgcaatagttttccaaataaatacttcattgtacatggacaaaagaaggcactttctaaaacaatgccaaaaatcatgttgtcttcatctttatactgaatttcatgtgaggaattagtaggttagatgtttgaattggtaataggtaagacgtttacatagtgcaaaaatcaaaacaatataaaatggaatattttgagtagtcttggctctgccttgctcctttctagtcatttcccacctctattgacagataatcactttaatagtctgtcatttatcctttgtgtttctgtatgcaaatacaagcagagttttgtgccttgctttttacttcccaatatcttctggagagctttttagttcataaacagagagcgtccttgtttttgtttactgttgctttatacttcatcatgtggatgtcctgtagtttattccactgtcccctgtggctggagatttgcattgtttctaatcttattgttttattgagataataatttccatatcataaaattcaccattttaaagtgtacagttcagtggtttttagtgtgattccaagctttttttctacaagtaatgatgtaatgagtatcctcatgcatatattcttctgaacatggtacaagtgtattagaaggataaatcagaagtaggatcactggctcacatgggaaatgcatttgaattttgaaaggagttgactggttaccctctctaagtatggttttgttttgccctcctgacagcagagaatgaaagggcctgtttctcttagtcttgcccatagtgacctcgcttttcataaagcaatcttaatatttgtttttttataaagcagttaagaatttttaattttgatgtttatgagctaccaatttactattgatatctgattgatttcaccgatgtaagcatgaccaaaacttctctttatgtttgtaaatattgttatttaatacttgatcttgtcagttacttcgtaaaattgcaagtactgagtgttggtgttcagagcagatttttatctgtagggtcttaagctggatgattttctggtccccattctctgctgtcatgtagatacaacagtactcacaggattaaaatgaaaattcctagtggaagatcaattatatgctgcttgctctagagtaggaaaaatcttgtcaaattttatccttttgatacagccttataagttacaatgttttatacctgtctgatgctcagttccgaaatgaactgagaagtggtggttgttacaagaatttagctgaagcattaattataagcagaggttcagcctacattggcacttgtcgacctatgggacaggtctgttgctgtttcatctgatttaggtggagtatgtaattacttttgggaatccatgcttttgtgctcctctttatatgtagattagctttactgatggactctcatgaagagatcttaaggtggtgtttgcaaggtggagacatttcaaggtttgagaaatgtgtgtttgaattattcaaggcttaccttttttggcatttataaatattctggcactttgtgtctataaaaaagactaagaattgataaaatattcataggaaaatggaggcttttctgagcttgaagtaaaaattgaggtatagattttgattaaatttatgatggagtggagaaatgtacaagtatggcatggaaatatcattggttctttctatggcccaaataatagttaatactgaaaaatagataaatcaattaaccaatagtgaattatccaaactggtttgtcgattatctgtaatggtgtgtgttacattagtattataactataaaagtatcataatttaggccaggtatggtagctcacttctgtaatcccagcactttgggaggccaaggcgggcagatcatttgaggccaaggcgggcagatcatttgagcccaggggtttgagaccagcctggggaacatactgaggcctcatctctacaaaaaaagtaaaacaaaactagccaggcatggtggcattgcacctttagtcccagctacttgcgaggctgagttgggagaatcatctgagcccaggaagtcaaggctgcagtgagctgtgattgggccactacacttcagcctgtgggacagaatgaaaccctgtctccaaaaaaaaaaaaaatttctttgtttaactggtaagtcaaccttttcgttgtaaatgagaaaacacctatagtcaaaacaaaggctttgactaaataaatataatagaattatgcctaagagtagaatttggttttgtgtctctcagggtcaattggttgctatacttctattccctttctctttcctcacttttaggtaatgatacaaaaaaggtccagaaagaatttgtgttttacccaaaaggaagtttcctctgactactctgattgtgatgggtttgtgagagaaggctgctatttggggtgggagagggtagtatgcagggctgccacatctggttaagtaggttgtgcactttataaagacattgggcattggagcaggtggagcctgaaatccagtttgtgtttaccaagctatattcttattgagtgggactatatcggcccagagcaaagtgtaccgttatctaatttttataaatgtgacttactggctgacagtagctttggtgatgcatttaattgcatttttatttgaaacccagttgtttctgctgtttttgctttctttcttacagataatgtctgttgtatgtacctgtctatgtgtatatgtgtctgtgagtgtatatgcacatttatgccttttatatgccacgtacacacgaaaactccatatattcttgaatgtaaggtcagatattctttgaaaaatatccctcagaaggacggaggtgccctatatgtatctgatttcttataagatactttataatatgagatcgtctttcagttactttgtttgaatagcacagtactgtttggggaaaacatagtctcttgaaacagcctcagacaatgctggctttgagtgcttaaaaaggctgcttcatggaattggaaaagagaagaaacaaagatgtttaacacagatttattaattattgtagagatgatagatcactctaaaaaagcaataccgtaagtggatatgatctcaaataaatgtttacaagatgaataactcttccacatatgctgacattatgcaaatggatacttgtggcttggtttggtatttccagtgatagtaccataaaaggatttacaagctactatgtctcaagcagattatacagacaggcgtttgctctggaaaactgtgttggatgagttgtaagctgactctagtgatgaaaaagacccggttgtcaacaatacatgtgaagagtgaatcaaattgtctcatgaaatgtgagagtgaataaaattatttctaaatttatgcttcataccgtgtgtaatttagtatatatgtaattgactgggtgccatgactcatgcctgtaatcccagcactgtaggaggccaaggtgggaggattgcttgaggccagaagtttgagaccagcctgggcaacatagcgagaccttgtccctactaaaaataaagacaattatccaagcatggtggcaccgctgtagtcccagctacttgggaggatgagatgggaggatcacttgagcccaggagtttgatgttatagtgagttgtgatcacaccactgtattccagccaaggtgacagagcgagactctgtctctaaaagaaaagaaaaaaaaagatgtatgtaatttaattaatatattttataattgagatttgactaatttctatctctaaaagattataaattcaaagttggctaaaatttgtttgtattctcttattggaaaaataagagagtgtcttactttgggttattgcatattcacttatatgtaattattattttcaaacagaaactgaggcttcttgaagagcttgaagacacttggctcccttatctgacccccaaagatgatgaattctatcagcaggtaaggtattttaatatttttatcagtttcagtgatgtgttctgatcaaccttattttacctatgaggaagctgggctagagaggttaaatgacaggtgaaaaggtcaaattagatcacccatgacttctcatggcctacagagcatgtacatttcttcagaatcggctttttgctgtgaatttaatgctttagcatagtgactgtttttatttcctcggacattccacacttccttgcctctgctcatgctgtttcttctgcctagctcctcctccttccttttgctccttatcctgttgcagatggctaattcttcaagagttcagttaaacatcacctcctttgtgaacattttcccagcttaccctacctacaagtcaagttgattgcactcccggtaaataactctataccacctagcacatggtattgcaattacagaattccgtgtctctgtctctgaattagacaccactgtttcaattacaaatgacaaaaacccaaatcaaactcacagtggcaaaaaataaggggaatttattgacttgccttagaagtctaggagtacatggctaaatccaactttacaaaagatgtcacccgatcactgttttttcctatttttcttggcttagctttcctcagtgtgatctcatgctcaataggctctcatctgagagcatagcaggactctgacagcccaaggggtatgtggcctttggcatctgggatcttagaaaaagttagtgagttctttttccctggttccatcaaattatccaggaagtaatcctgttggcctggttggagtcatgtgcttattactgaactagtcatcatgttcaggagagtcaaatgctcctgtttgcccagcctagttcatgcacctactcttggagtggggttggagtgagagtactcccaccaaactgtatgcactatgtgagttagacatgggtggctctcccaaaggaaaatcagagtcctgtttccaaagaaggaagagtaggccctctgggcatgtaaaaataataaattttcacctcttttttcctactacaatgtgaagtcttgaagcagagggttgccgtgaaaatcagaataggaattaggtcacagcatctttgtatctctagcacctgcatgtacatagctgaccatcagtaaccaaggaaggaagagaggaaggaaggactttacccatctagaatccaggtcaatatgatttctgtgacttctagctcaatattatttctaggccactgtctcttatctccattcccatttgatctgcaccatctttcctcttcactgtcagtcctcttataggtctgtctagttttcctctttgccccccttcatccttgaagctatagtattttctaaccaagatgtaaatctgagcatggcaaccctctgcttcaaatcccacatcattgactggctcctacattttcagcctcatctcccctgctcttacaccttttatccacactggatttttgcagtactttaaatttgctatgagtttcatctttggggccttcttgctacgtcctctgctgacgtacctccttctctttatctgtctcttctttttttttattttttgacagaggatctcactctgtcacccagactggaatgcagtggtgtaatctggattcactgcaacctctgccccctgggcccatgcgattctcccacctcagcctcccaagtagctgagaccactggcatgtgccaccacgcctggctaattttttgtatttttgtagagacagggtttcaccatgctgcccagactggtcttgaactcctgagctcaagcgatccacacaccttgggctcacaaagtgctggggttacaggcatgacccaccatgcccagcctgtctcttgtttccttggtgaacttctgtgttacctgttagtaacagctcatatgtcatctcctgtaggaagcttccctgacacctctacaaccagagagttgtctctgcttcctctcatactttatctatacctttatcagcacttaatctcacttaatttttttttttttttgagatagagtctagctgtgttgtgtgcaggctggagtgcagtggcgcgatctgagctcactgcaccctctgcctcctgggttcaagcaagtgcatctggctaatttttatatttttagtagagacatggtttcaccatgttggccaggctggtctcgaactcctgacctcaagtgatttggcgtcccaaagtgctaggattacaggcatgagccatcacatctggcattaatctcacttaattgtaatgaatttttgtgtgtgctggcttcccttatcctctgtacttcgttcagtgccgggtacctatcaggtgctgaatgagtttgcttcaatgcatgcacccaatagttaatttggaaaaccagttatatataataataatgagtttagtatgatttgaattttgcttctacacacgtacacacttccccagggatttggcatctggaaagatttgacagatgtgtacagaaatgtcatactgcatagtgatagggtgggtgttctcttttgaactttcccagttttccagattatctgcagtgaaggtatattcttttgcaatcagggaaaaaataatttttaaaagtacccttaagacaggtaaacccacaaaaatgcaattagttctgaaatgcttactaaattttcatagctataagccttctggtgcatgattacatgcattgtcacaaagcaactgccaagccatttcagcttttgtcgtgtgaaaatggtacaggaagaatgagatacaaaaggttatcagcccactgtgctctgaaccagccatccactgagggataaaaggaaacccaaatgcaaacagaacaactatcaagacttctctgttatctttccaaggcccgcaacaaaccctgatactaatatctaatcactctaagtgcaccttgctgtttttcttttctttttttttttttgagacagcatctcactctgttgcccaggctggagtgcagtggtgcaatatcagctcactgcaacctctgcctcccagattcaagcgattctcctgcctcagcctcctgagtagctgggattacaggcacctgccaccatgcctgcctaatttttgtaagtttagtagagatggggtttcaccatgttggccaggctggtctcaaactcctgacctcacattatccacctgcctcggcctcccaaagtgctgggattagaggtgtgagccactgcgcctggccaaagtacaccttctaggaaggcttagtacttcaataaaaccttagtaaaagtaaacctcttctcttaaaagatgaagtgaaaatactttttaatgacatgagtaaatagaaagttcagacctgacactgggtcccttaaacaggccctcaccacaggaatgccaatccagctgccagtcataaacacaggagtctgttcagcttccattttgggtctgtcgattgatccttacagtgtgctaggctttgtgctacatgttttatgcatgctctcacatgcaatccccacaacagcctcattcattgtattcagcaactacttttcttcaggcttgaggtacttgaggtaggtatttctgttttagaaatcaagagaggaaccaggcacaactgtaagttccacctacttgggaggctgaggtgggaggatcatttgagcccaggaattggagttcagcctgcctctcataacaagattaaaaaaggaggaaatcaggagagactaagttagttatctgagtgggagagctggagttcagcccatatttgtctgactctgaaggcccatgctctttctgctgtattgtccacctcttggtctaccatgctccaattcaaaacaccttcagagaagttttgcagtttcttttaataggaccgtagagaaaagcaaaaccaaaccaccaagggtcaaagcagaaaagcagagagaacttctgttagctcatcatggaacacaaggaaacgaggaattacatagtcagaaaacaaactctgacttccagaaatatgaatgcagccccttttatccaaagaaaatgagaccatcctcagtaacccccttgctgtcactgattgtgtgctagctgtgtgccaggttgttctgctgctactttaagtgcattacacgtgtgagctcactgaaatcttgctatatgcttctgagacaggtgttactaaaaccctattttagagatgaggaaaccgagggacagagaggttcaaaaatttgtttaagacttatgtgcaggatatgttgggactaggatttaagtctgggctgttggcttttgggtctccactcttaagtcctatactgcttctctcttcccttgtgtctcttcatccttctgagataactctgctcttgtctcaaaggttccagacctctgtccccatcccagctctccctgtgacctccagctctccacttccaactgcctacggagtggctctacctgaaagtcttccagctacatctaactcaacatgattcatattcattaagttacttactccattaaacaaatggatttcactccccgactctgtgccaggtactgttttaggcattagaaatgaagttgtgaaaactgacaagagattcgtgtcttctttgagcttatttcttgtggggcaggtgatgtaggagcaagccatgtagatacttgttggaagaatgttctgggcctacagaacagcaaagcctcaggtatacttgacaggaaaagcacccgaggccaacatacctggagcagagggagacagctggtgagagcaggggagacggtcagagagagagagagagagagagagaggcccggttatacgagaacttatagtctgtaagttctgtaagaagagcattggcggttactctgagatgaggaggcatgagaaggcttggagcaaagcgtgacaggatgtcacttacattttaataaggattctttctacaaggctcttcccattcagcctcttctctaacggtatcccctagtcccattcttgagattagaaagctcaccaccctcaacttctatccattgctttcttccctcatttagtcactgggtccctggtggttttacctctttagaatctctcaaattgttttttctttttccatcccacagacactgcctcaactatgtaggccacattgatcactttctgcctccgcagttttagcatcctcctgattagcgttcctcatgccctccccagtgccatcagaactgacttgtacctccttgttttataaattttgttgagtcgcctttgcttccaagatcaagttcaaattcctcagcatatccaccctataaggccattgactttcttgttttttttttttttttttttttttttttttgagacagagtcccgctctgtcacccagactggaatgtagtggtgcggtcttggctcactgtaacctccgcttcccaggttcaagcgattctcctgcctcagcctcccgaatagctgggactacaggcgcgcgtcaccatgcctggccaatttttgtatttttagtagaaacagggtttcgccttgttggccaggctggtctcaaactcctgacctcaagtgatccgcctgcctcggcctcccaaagtgctgggattacaggtgtgagccactgcacccagctgccattgactttctgaccctaaactacctctctggtgtaatctcatcccatggcctaaaatggcgcccaatcataaactctcgtcatagggagttcttggttccaccctgactctgctgtgccctcttatccttccttgcctttgtgcccactagtactctcttcccttttctgtctggtgagcatctactcttaaagactttacttaaacactacatgttctgtgaaggcttcagaaaatcccttctgttctaaaatgtatgaaaaatctgactgcttctcaccacctctgcttcttacaccgtggccaaaactgccatcatctctgttgcaacagcctcctgactggttctgcctccttcccctggtctagtttaacacagcatccggaatgatctttgaaaacataaatcagctcattacactttcttgctcaaagcccttgaatagcttcccatcagcctaggacctgacatgcacccacaaagctctacatgcttgggttcctaactgcttccctcacctcatttcctgcccctgcccactccccaccccccctcacacttttcttcctattctggcactttactcttcctggaataaaccaagctcactcctgccccaaggcctttgcactgaatgttccctcaacctggaactctctcatccccccaggcatctgcagatattgtatccttgtttcttgctttcttctgctctgatgtcactgtatctagaggccttcccttaccaccctgtggaaagtaggcatacttaccccagcactccctatcctactttctcggctttatttttccccgtagacttatcatcatctaaaataccgtatattttacttatttatatgcttattgtctggctcaccttgctaggacatgagcttctagagagaaaatagacgtttcgctctcttccatattctcagcacccaagtgctttgcaaatagtatgtgctcaatacatatgtattcagtacctaagggttttccagcttttccttcccaattattccctgctcccacagcagtatactcacacttctattgtaggacattcttctcttttggtttccattttggtttatactgttaaattatgagatgctgtcaaataggacctatcttcttttaatccttgtatgtctggcactttatacagtgcctggtacataggaagtatttgagaaatgttaaataaacaaaatgaaatgaagtattgaatgaatgaatgaatgaatgaacgaggatctctgtgtcattttgtagcaaagcacatgttacctcaagtcttgtgatagctgtggcagagtctgaacagtgactccagaagtgtatcccttctggagctctagtttgcatcatgcaggcagagtctgggtcagacgagtgtttagcccgttagtcatcggatggctgccaagtcgcaagcattttacaacaaaaattatatagaaaatgagtgatagggtgcaaattgctgagtgcaaaatagaaagtgttaggagcaaaatctattaacagctagattagaaatacagtcctctaaaatcagaatattctagtacttctaagtgaagggtatttcccaagttacttgaatatttaaattttttttttctctctacccaaggttgagttccactgggcttcatttaagtgagcctctggtaaactggtatcttacttgtttaaaaaccatatctgacttccctgtgtgatgaaatctttcagaagcatctcttgatatgggaggaaaaggtagaatttttatataatggcttaaaatagacagaaaatgaagcctgatctccagagagcttagctttccacatctttcagccattgacaaaggcctggcatgctggcattttatatctaaaatacctttccaaatacttattaaactatataatcatcatttatgccacaggatcatttgtgaatctcaagaaatacagtatgtgaccagacaactgctaatataaatttcatgactgcatactcattggaaaaaactctaatgggattaaatgaaaaaaagcctaacatatttgaaaatctgccaacagctgttccaaattattgtgtgatatctgatgttctacatgtacctgtccaaaatggaaagtgaacttatttgtttgacagaatgaattaatattaaattacttaatgttcacttcttctccaaagttacttgttctttttttttttttttaaagaaaaattgaacaaatgcttcatagtacgtttatgtgtcaggcactaatttaattactctataaacaataaaagagggcatttaggttgagatttttttctcttacattttctttgagatagtgacaaaattagccagttattattatttgttttcactgtggtagactgaaaattcctcagtcttgaacaacagatttaaatagtaccagaagttctcttgaagatttttgaccatttagagccatcagaaagaatctcttggcaaatataagaaatgtcatgaaaattaagaatttttttagtgcagcatcttcactctgatttttctgattaaaaatattttacatttatattgggaaatttgaaaataatatagatgtctaaagaagaaaatcaaaatgatgctcaagtacattactcagggataaccaccataaacttttggctatctttttatccaatttttttttttttttctgtgagcttttacatatgtactgtttttcttttaatgaaactgagatctcttgtctatcttgttactaatttcttctatgagtatagtttcctactgacttccaaacagttaagtttgttactttaatattccatcacgtggttgtaccattttcccttctaaacccttcttgggcattttggtggttttcagtttttaattattatcaatagcagtatgatgaatattcttataatcttggtgtgtttaataacttccttatgacaaattcctaaaagtagaataactgcatgaaaagatatgggcatatttaggttctgatagatcttgtccaattggccttaagcaacattgtaataatttgcattcctaattgcacgctatcagaatattgaattttgccattatcaacaatatgtattactattataaaatgttttaatgcaaatttgatagacagtaactaatttaagtataatacaaattatatattttccaactttgatacagttaatatttatttatttatctatctttgaaatggggtctcactctgtggcccaggcttaggctcacttcagcttccacttcctgggctcaagccatccttccacctcagctgcccaagtagctgggaccacaggtgcatgccaccacacctggctaatttttttgtattgttagtagagaggggatttcaccttgttgcccaggctagtctcgagctcgtcagctcaagcaatacacccgcctgagtctcccaaagtgctgggattacaggtgtgagccaccacgcccaggcagttaatttttttatgtgctaagaggcttctctattaatttgcttgtgaatgggtgtgtgtgtgtgtatttaaatttttaatggttctgcattaatgtttctgcattcctgccatataggttgtactttttttttccagtttgtttgccttttaattttatgatttattttatacaaaaatttaaattttcagatattcacatctatcaatcttctttttcaaaaagtttattgattaactgtatatgtgtataatttacataccataaaatgcacgttttgaaattgtacaattcagtgatttttggtaaatttccagaggcatacaaccatcatcacagtagttttagaacatttttagcaccccaaaaagatctctcatgcctctttacatttagttttctttcctgccccagccaagatctccactcatctgcttcagtcttttaaagcttttattcttagaaaggagtcttgagcacttatgtggaaccaagtgatgtggctataacagatactaatgctattttcttcttcttctttttttttttttttgagatggagtcttgctctgtcacccaggctggagtgcagtggtgtgatctcggctcactgtaacctctacctcccgggttcaggtgattctcctgcttcagcctcctgagtagctgggattacagatgcccgccaccacgcccagctagtttttgtatttttagtagaaacagggttttaccttgttggccaggttggtctcgagctcctgacatcagatgatccagctgcctcggcctcccaaagtgctgggattacaggtgtaagccaccgctccaggccactagtactatcttcttttaggagcttgtgatcttacaggacagattattaaactaataatagtttaaataaatatagttacaaatagataagtgctacaaaagagaagtaaagcgtggggagtgataacagagggcacctatttgagggtggagattcaggaaaggtttcctttttttttttattatactttaagttttagggtacatgtgcacattgtgcaggttagttacatatgtatacatgtgccatgctggtgcgctgcacccactaactcatcatctagctttaggtatatctcctgatgctatccctccccctccccccaccccacaacagtccccagagtgtaatattccccttcctgtgtccatgtgatctcattgttcaattcccacctatgagtgagaatatgcggtgtttggttttttgttcttgcgatagtttactgagaatgatgatttccagtttcatccatgtccaggaaaggtttctataagaaaatgacccagggatgggaaggaccatccaggtgtggagttgggggaggagcctgggggaagtatttaagagctggacacttgaggactgcaggaatagaagcacatatggtcagagagaaaggggacatgatctgagtgggaaaaaaatggaatattttcccatgccattattttctttttatgctgttttttatgtcaaggtatttacagatgatatttatgtggttatatgtttttcctggtctatagggttataatttccccatattaaatatatcttatgcagtgttgagacccagtgtatgttgaataagggcagcagaattttaatggggggtgggcaggcgtttgtgcatatgagtgcattattttcagtattcctttcttagtcccagaggggagtgtgttcagaaacagagttcttgggaattaccatacttttctttattgttttatactaaggaccattcagagagtactggaggtgttaagacagtgtgaagaaattaccttcttcatcacttcttcatcattgctttgagtatactggggcctcagggacttgctaagaaagtaaccagtatagtgatagaattagagttgctgctcatggcttcagaatatttggtctctgcttacaggattgcattgctttcttcataagctatgtaaatagaaagtacgatatcactgtttctgttttccaatggggataactaaaatatggaaactcaatccttaatggatccctgacaatctcaatgacaatccatagtggtatgccacatgactcttctctttgtcactttcaattcatggtcaacacctcagataggcattttgagaagcagggcagtcctaccacacttacctagtaaagtcattttttcacattcagacttgactcattcatttttcttctgcatacttcctcccactttctgcatgtcttctataatatctcctgcactctgcctcattcagaacaggctagattatgctatagtaactgataactctcaaatctcagtggctccacacaataatatttcttgtccattttatgtatcatttgtgggttggcacagagtcactacccattaaagtagctcagagatccaagcagccaccagctggttgctgtggcagaggggtgcagagtatgctggagggtcttgcagtgacaatgacatgttccaggctggaagggatggccatcatttttcactggacagaagtaatcccatgtttcatccatcctgaggggaccaggaagtgtaattttacactgggcccaaaaagctgggtggcagaggaggaatccagaactatttggcaaacagctctaatgaccagcatacattcttagctagtgattcaccttaacttcattgagaaagtcagagcattctctaactaccacccctccaaaagaaaccctagaacgtactcatctgcctactattattacatttatcatcctatctgaattcataccttctttttccttctagcctattccaatataagaagtatcttctctcctatccacatatttttgatcacatactcttatcagtagataagcacatacagtgacatcctagaaagtgtttaacaagtggcctgtagggggaaagaaccagccttgatttttagtgttttttgatttccgcagtgtaaatactctcactgtggacagtttcaagccaccgtcacggtgttactgaatgtgcagttggaaagagatgcacacagtgggctctcatgagccagtgtggactgactccagcacaccaccagtagtgtgctggtggtagtactcatgtactcgtgtctgttttataataatattcatattaaacctatttgtgtgtatatgtgtgtgtgtatatatatatatgcatacatattttaataatgcttgagttctttcattttatattaaaaataaagcagttctacctctcccctgtgccccaccactcttccagatggccttacaaagccttgcatacctgacttgggggctactgctctagacactcaaggtctcgacttctttggttattcactctctctgcatcgtcagcctctttctcttgtatcattctcatgagtgtactgagaaactctggtgttctctagcgtcttccatcattagagattgtcccttagtctagccttcttctttatcaaaagctccatttttctactccccttcatagcagaaccattcagagacatctctacatgccatctcacttcctcctctttcattccatcttcgcctactccaatctgactttcacccccagcactctactgagattgctcgtgtcattgccatcagtgattttcatgctgccaaatctactggatcatctgtcttcatctcacttggcctctcagtgtcaggtgacatagttgagtaccccgcccttctagaaatgctctcctcttttagcttctgcaataatacactctgctggttctcctttgttgaggcttctgctgcgactcaggaaatagctttggtctccttttgatatttgtactgtttccctaggtgatctcattcatttctaggcctttaaaaccaagctgtgtgctgatcactcccacattgcgttcctctgccctgctttctcttctgagctccagatgtgtacatccaattcccctccccccgcccaccatattttcacctggaggtttcataggtatcttcaaggctgcagctctacagtgaactcttcatttcccccttttcttctttctactatttctcttttgcctcagttttccttatttcacagaatagtaaattgtttatttagttgttaaatccagaaatctggaatgtattcttaacttctatcctgagcaacagggagaaaccccgtctctactaaaaatacaaaattagccaggtgtggtggcgcatgcctgtaatctcagctactcgggcggctgaggcaggagaatcacttgaacccaggagtggaggttgcagtgagccaagatcatgccattgcactctagcctgggcaacaagagcgaaacgccatctcaaaaaaacccaaaaaaccccaaaagacttatatctttttttatcccttacatctaattcataagcacatcctttagttctacctacaacgtatgtatttcatctgtccacttatctttgtctctattttagtccagaccatcacttttcttccagatgattgtaatagcacattccacgctcacatgtgcctctttccaatctgtgcctgatattataactaagagcgattgtataagatgtaaatcaagttatttttctcccttctacatcctccagtgcatctagagttagcttcagattccttaccacgacctctagggctatgtgtgatctggcctccgccttcctctgcctcctcgtagcatgccactctgtctttggctcttgtgctctagtaaaacaagcctttttttgtccctagaataggttggtctttttcctgagtgcctttggcttctctggtctgtctttctgggaagcactttctctggcttgtcatatttctggtgccttcttttcctgaagatctcagcttaaatcccgtctccttagagaattcttcctgttctaataagatttcctgctggtttgtttctgtcttagtacttaacacaatttggggttgcttttctttatttatttacttgatttggtagaaagctttgtgagaacagggaccttgtttccatctggtggtaggtgctcaataaacagatgctgcatgaaaaaaaaaacgtttggaagaatactggtcttgccctgcctatcatgtgaatggtaattactaaatgaagacagagaaggaaggtatcttaacaatggtgggcaacacaatacagggaggacaggttaatgtgttgatcatgtctgactctttctttaagacagcctaaaactagggaggaacaaatcagatcaaacgttacagaggtaaatgtaaaatcctgtgatttggttacaaataaatcagttgcattttacagaatcaggaaactccagtctgacaccgattcacatgccaagtcctaaggaaagtggtagccgaaaagctaatgcagccctaacctacattaatcattccatgtatttctgtattagggaagggaattgaccaatattactctcctccagtgacaccagtagaattattagaattttgtagaattacaatgtaataatacctcattcatccatgcacaaatccatttattcattcctttaccatttactgagtaaattctgggcactcatattatagtcatgagcaaaattgccatggcttttgtgttcatggaacttaatgtctaactcctgaagagaagtgagttctctttttgtgaaagtgttaagcagaaaccagtttgtcatttattgagacaatgcattctcatggttaagaactcgtgccctggaagccaggggttggtgtccaggggctttaaattccagctccagtatttgccagctgtgtgactttgggcaaattaatgtctttggtcagattaatgtctctgtgtttcagtggtctcatctataaactggagataataatactatgcctagagttaaaatgagctaatgcacacaagtaacttacaacagtacctggtacgtagtaagcacttaataaatattttagataataagcagttaataaaatggtgttgagatttagggtgagaaaaagtggtcacagaataatcctggtgtatcaggacacacattattattttttgttttttattaaagattgttagtaatttgagcttgaacttgaaaatcttgactttagagtttgatgacatttgttttatttggttttctgttttgggctaggaagatgtgactcctatttagaaatagccaccaggtagtccccccacaactccccaaatgcttacaaagaaacacacctttggaaataatacaattgtagctatatatcaacgtctgtttttgctttggttttgttttagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggtacagtctgctcttggaaaaagcagccctgtatgtaataatatgacccgagttgtttaggctctggagatacacacgcatatacatgaacatgtttgcatgtgtgcttgcgtgtgtacatgcacatgcgtgtgtgtgtatcatgtgtcctttttagtcttgtcacacctgtatgtctgcagaatatgcctctttctcatctggccatgctagctggctcattgttatactgtactcagaatattttcgcacgtaagcactgctgtcatttgtctctcttgtgcccaggagagcagcctcttggtttcatacagccgactgtcttctctacagctcagaggagattgtacagttgctataattaacttgctgataaagagctgggaaaacaaaaatctgtcaaatctttccaggttcccacaggtgcacatttccagacctgccaaaatattttattatggttgacatcactatcttgatgggtgtgatttgtcaaatatggacttgttcttggcttcctatagtttgtaactactgtccttccttgccagaagcagttgaggtaggttttgtaagcagacagtcctctattttcaggaaactccctagctctttacccaattctgcagttttagaccttgttgggtggctgtggtagacttgttcttgcattttctgatgtataatccccttgaaacagatcgtaggctacctcttagtagcccacccacatttctcttcttctattattgtttctgtgtgtttatggccctcatttttccttagaatagaattacaaaaatggtagttgaacagatggaggagagcatgacctctgttgactttcttttgtgtctgattatttggcaaagggatacaagacatagtattagctctcctgtctgatttactgaaagatgtttggaaaaccagaattctggatatcccatcagggaatgactggaactttccagggtcattattttctgacaactctagttatttgattggatttttgtttgttgttgttatttgtttactaaaattactgttttggaaaagagatttaagaaaaaaaagatctttaaagtactctttaaatttcttacaatttcccagtctcaaaaatttcctcagaactactaatattttttctaactttatcttatgtcttcagtctgaaacaaggaactagtttagcatttggaaatttcaccactttctctggcatctcaaataatgatgctgacctaagaaaatcgcttgaagggatttaacgctgtcctaatggaaagaacggagatcctctgatctttaataaggacttgccagggatttaagaactatcacatccaagaactctgatgtgaacgaacaatggagttagtttctttcttaaggagacaactctccaaacctgaagcagtggtatgtgatagtacaaagctctacaaagatgtctttgtgctcccaattactctgagccctccagtttaatagtcctattgtactcccttcccgtgggtgatcaagtagtttttgaaacctagaatatctttcagaaaggaatttaaatgtctaatgaatagtttctatgctcaggagtaattaagactgacaaagtatacaaatataaattacatataaatatagaaatgttggtacttaaagagggaactgtagaatttgaatctgtaagagcggtgtgcaaactcctttgttctcttttttttctttttttcttttgagacggggtctcgctctgtcgcccaggctggagtgcagtggtgcgatctccactcactgcaagctccgcctcccaggttcacgccattcttctgcctcagcctcccaagtagctggggctacaggcgcccgccaccacgcccggctaattttttgtatttttagtagagacggggtttcaccgtggtctcaatcttctgatctcatgatccgcccacctcggcctcccaaagtgctgggattacaggcttgagccaccatgcccggcctcctttgttctcttaactgcagaaattctcagaactccatctaataataatagcaatactgggaatgctcatttattgagcacctactacgtgctacatgctgttataagcattttacatgcattaactcattttgtcttcccaacaattcaaagaacaaaatagtaatgaagtactattgctatcctcattttacagatgaggaaactgagtcacagaaggttgattaacttgttcatggtgatgcagcaagtaattagcagagttaggatttgaggacaaatatccaggcttcagaatcttaacacctaaggctatgtgcattatgagcaggtatttcttatcccagcagtgtagccgtctcagggattttattttattattttacttttttaattttttgagacagagtgttgctctatctcccaggccggagtgcagtggcacgatctcggctcactgcaacctccgcctcctgggttcaagtgattctcctgcctcagcttcccgagtagctgggattacaggcatgcaccactactcccagctaattttttataattttagtagagacggggtttcaccatgctagccaggctggtctcaaactcctgacctcgtgatctgcatgccttggtctcccaaagtgctgagattacaggtgtgagccactgcgcctggccagggacttggatttttaaaatgtccaccttctggaaaggttaaggggacattccacttgctttttctttcaggtcctggtgtcttcctttctccagctttacttctcacccacatctgctgtagctttccagcacatactctcagatgattggaatgcatcagattatcttattcgatgaaacagaacctttctgtaggtgtctggctgtgtgtcagacggcatacaaagcatgtggctctgggtcagatggtgtacaaagcatgtgccttgaaactctatggtgggcgcatgtcttctaagtgacaagtgatatctgtttagttttctggtcttataatccttggcagaatgccagaactatggcaaaggtggacttgaagagaatcatttggtttaaaattttggttgaggttgagaagggcttaaggaggtcatagagagtggacacttcagagaattgtatttttttctgtgtccttgaacttgtttgtcaatgagctgttctagacagtatgggaactccaaagataaatcaatggctttctcactttgaggtaatagggaggtaataggtgggctctcgtgattataattatgaaatgatgaaacattgggtttgaaagagacttttgaaatcacttgattctagcctttcattttacaaatgaaaacaccgagaagggaagtggcttggccaaggtcacattgctacttagtgataagagcagggatttaagttggaaagtgttccttgccactggagaggttcacgtaaaatgcactgggaattcagatacagaagtgattgcttcctgctgaaattaaattcagttgaagcttaagatctttcaagactctgctctcaataccttttcccagggaaatcttcttgtagatttataatgagccagtcatccctctttggtttattttcatgagtagaggtcattgagaagtaatttgtataggatacgtgtaattatatactaaattcattggctttcacatgccgttctagttaatagatatctccagtaggaagattgaaatggtacaatttttaatcaggaatggcttcggggaaccatatgtaaataggcagaatatttgattttcctattccagctttgctggcaattgcttgttactcctagctataaaaaacgaactttagcggggaaggcattaaaaacccaatgtttaatatggtccagcaccttgttctttgactggaacaccttcagaaacatcacttagatcaacagtaactattggctaccatttttgtttctttgtctggaaggaaacattttctgtgaaattgtctttctagaaagaaaagcaattcttaagattttaaactagtgccaagtattgcatattcttgacattattttccagacctcccacaaggagccaggaaggcagctgggcgcggaggctcacaactgtaatcccagcactttgggagaccaaggcaggtggatcacaaggtcaggagttcaagaccagcctggccaacatggtgaaaccttgtctcttagaaatagaaaaataagctgggcatggtggtgcgcacctgtagtcccagctactcgggaggctgaggcagtagaattgcttgaacctgggaggcagaggttgcagtgagctgagattgcgccactgtactccagcccgggcgacagagtgagattccgtctcaaaacaaacaaagaaacaaacaaaaatccaaaacccaggaaggctcacaaaaggaagaaaccgatccatgtttcctgttgagcatgtgataggctggaaagtagagactttgcaataatgttcttggaattctaggatttccattcatgtctttgatttgggaaaaattgcatccccttaaggatggaaatttgttcccgtaattcttgaatctctattttaacatgacttgctctatatttctcagctcatcactgagaccatgaaaagctagtttataattacagcttggagttttggagtattcataaaaacgctgtgatgtttaatgttatcttagcgtcccagcatccctgtctaaaatctcaaagcttatttgacctagcttttttttattgtatcatgctatgccttgtcagtgatttttgaaatcacttatactgctcagtaaaacttgtttggtcttataagtcacatttttgggggtgaccatccagttatttattcatctaacaataaggtctcccatgaagagccaagaaggctcacaagaagaccaaagggggggaaaaaacttatttgatctacaaagttacatttttttcatgcctatgcaattattttttcatttaacaataagcatctactatttgctagtcagttgtctagatgctgagcatgtatcagtgaacaaaacagacaaaaatccctgccctcatcaagctcacattctagcaagggaaaacagaaaataaaagtagattgtgtaacaagggtgagggataatcttacaattttaggtaggagagccaggcaaggccttgttaaaggggtaacatttaagcagattggacggagagaatgagccactgagaaatttgaagcgggagcacataggcgggaagatagaacatgattgggatgtttcagaagcaacaagtgtggatggaatagagtgagagaagaggaaatgaaatgaagacaaagggacaagtaaatgggtggcagaaggtagggctttgtcatgttagaatacaaagtagtaggtttggatttggagtgagatggggagccactgaggagtagaagaagggaagcaacaccagaaacaggagagctcacagaggtgaccaaagtaatccagactagggatatgatggtccagatcagaagaggcagagcaggggagaaatgtgtaaatacagtcctgtaactttttaccaacaaagagagtggcagtgtttcagcaccagtgagaaaggataaccagcagtggcatctcccatttgtcaagagaaggctaagcctgtaagaatggctacattttctcccctctgtgaatggctttattcgggaataactgacatacaataagctatacatattgaacatttatagttttataagtttcaacacacctgtgaaactatccccactatcaagataatgaacatacccattattccagaagtttccttgtgcccctttgcaattcctcttcctgacatatctgttttctttttttattgttttttatttgtttgtagagactgggtctcaatatgtttcccaggctgatcttgaaatcctggcctgaagagatcctccttgctcagcctcccaaagagctggaattacaggtgtgagccactgtgtcagcctggatttgttttctgtcactagatgagttggcattttctagaattttaaccagatggaattatatatgtgcacggtttttttgtctggattctttaacttagcatagttattttgagattcatccatgttgttatgtatatcagtagctcattcccttgtatccttttttatttcaataaaatatacataaaattaatcattataaccatattaactgtacagttgagtggcattaagcatcatcccacaccaaatctctgtacccatttaaacaattactccccatttctccttccctcatttcctggtaaccactgttctgctttctgtctgtattatatttgactattctaggtacctcatgtaagtggaatcatacaatatttgaccttttgtgtctagattattgatatggttcagctgtgtccctgggcaaatatcaacttgaattgtatctcccagaattcgcacatgttgtgggagggaccaaagaggaactggttgaatcatgaggccggtctttcccgtgctattctcatgatagtgaataagtctcacgagatctggtgggttcatcaggggtttccgcttttgcttcctcctcattttctcttgccactgccatgtaagaagtgccttttgcctcctgccatgattcagaggcctctcagctatgtggtactgtaagtccaattaatcctctttttgtttccggtttcggatatgtctttatgagcagcatgaaaacaaactaatacaactattttacttaacatagtgtcctcaagattcatccatgttatggcatgtatcagaatttaattcctttttaaagatgactaatattccattgtatgaatataccacattttgttgattgattcatccatcggctattcataatagccatcttttggctatggtggataaagttgctgtgaacaaatatctctgtatacaaatatctgtgggaatctccgctttcagtacttttgtgtgtatactttttttgtgtatatacttttgtgtatgtacttttgcgtaggattgctggatcaaatgataggtctatgttgacatttttgaggaactgctgtactgttttctacagcgactgaactgttttatattctcgctggcaatgcgcaagggctctaatttctccacatctacgccaacacttactgtttcctgttttttgataacagccatcataatgggtatgaagtggtatctccttgtggttttgatacacattttcctaataattaatgatgttgaacatcttttcatgttcttagccatttatatatcttctttggagacatgtctattcaagttgtttgcccatttttgaatttggctggtttttagttgttgagttttgtgagttccttatgtattctagatattaattccttatcagatatatgacttgcaatattttcttcaaggatagctgaactttttttttttattttttttgagacggagtctcggtctgtcacccaggctggagtgcagtggcgcgatctcagctccctgcaagctccacctcccaggttcacgccattctcctgtctcagccccctgagtagctgggactacaggcgcccaccaccacacccggcaaattttttgtatttttagtagaggtggagttttaccatgttagccaggatggtcttgatctcctgaccttgtgatccacctgtctcggcctcccaaagtgctgggattataggcgtgagccaccgcgcccggcctgaacttttgatgatatattaatgtgatgagcacgggatcagagaacagtggaatagactttactgtccatgacattgatgaggcacttaaattctatactactgaatgacatcattcatattggtattaattagctatgggaccttaagcaagttacttaaattctttgtgactcagttttctcatctgtaaaatagtgatcagagctgtatccacctcaagattgtgagaattaaacacttgtaaagtgccaagaacataacagcagtaattagcacatagtaagcattcaatactgtgttatttttagtttttatcaaaattattcattcatatcatttttacaagtcaaatatttttataaggtttgctaaggaaaaaaaagcaggagtttttacaccttttcttcccattttcatttccacaggcaatcatttctactcttttctttcaggtaatgcttttggtagttgataacatacttacattgttttgaacattatatattggcttcctgatatggaaggtgaagatttacctagctctcttctttctccctgcctgcctacacatgtacacgcttctgattcccattatagatttactgtaattttgattatatcactattcagcctttatagttatcatatatatacatgagaatgccttccaaaacctgtgatctgttatccttttcttttcaacttttttcttgcattaatggtagtcttgctttttgtgtatttgtatagttttctatgtagttatgactaattaaatcccttgctatctaccacatctcctcttaagagcttcagaaccatcagatattctgtccatttcattttcttggagcactgtcttccagagtcttcttgtctgctccaatctggtgttctatgcctgatgcatggggatccctttctgtgacctcttcattgtaatccagcggattcctttacttctctcttttgtgaactcctcacgttcctgcatcctggccttgctctttcctgactgttttcttattttggtggagcatgtcctacaatgttttcttcagaaagatgcttaggaggtaaatttttaagaccttaaatgtcttcaatcatctttattccaccttggtatatgtaggttcttccagtatgaaaaccttgttaggaaataatattttttttcagaatcgtagtgacattgcattactgtcttttatcttacagtgttcattttaagagttctgaatttttcttcagcttttatgtcgctttttttgttggatctttttttgaatgttttacaatttcacagtgatatttttcactcattttactgtcattgtgtagggctttcaatcatgcccttcagttgttggacattttcttgaattgctttgttagttatttcttcctctccagttttctcatctctttggaatccatatgatttagttaaccttctggactcttcctctagttttcttgtttattcccttattttcaatctttatgtttgttttttagtctaatatctgggagattttattaacttccaacctgtctattgattttttttttttttttgagatggagttttgctcttgtcacccaggctggtgtgcaatggcacaatctcagttcactgcaacctctgcctcccaggttcaagtgattcttctgccacagcctcctgagtagctgggattacaggcgcgggccaccatgcccagcaaatttttgtatttttagtagagacaaggtttcaccatattggccaggctggtctcgaattcctgacttcaggtgatctgcccgcctcagcttcccaaagtgctgagattacaggcatgagccactgcgcctggcctgtctgttgaattttcagtattgaaatatgacatatatcataaacatacagcttgaagaattgctgtaaacatatctgtgtacctagcaccctggtcaagaaatgaaacatatcagcgtcctagaagtgctcccttccagtgtctgcttccccacaacagtaaacactctcctgacttctaaggccataaatagttttatgtgtgtttgaattagacttgtaaacttgtaagctcctaaaagaagtaatttgtgtcttcatccttctttgtatccgtatatagtggcaaatgagtattttttgccccaaatctgttaagtatttgttgttcttgaggagcttgtactattcagttacattgtggccactgttcagtaactctttgatttctgcaactgcagtctctgtttagtaataggattcttttgatagcaaataataattccagacccaaagaggcttaatttaaaaaggtaaggaattctctcacttcatcctaagaactggcgtctcactggcttcaagtggaccttgttccaacagtaatgatgtgatcagtttcaaatttcttccccttcctcttttggccattctaaagctcatggcccccaaatgactgcccccagcttttgtggccactctctctttctttttcctgagctttggggaggagagaaactgggtattgggtgtgtactttgaactctggatcaagctttacctgaagctagatgaacaaataatgaccctcttttgattaacccagttcggttctggtttctgtgttatttacaacgtaagggtttcctgtgagtctccacaactctctttataccttcctgaggttacccaaggaattgaaacctctactgttagaagctctggtttggagaatattgtttgagaagtatctctgcttccttacctgatttcatattttacttcagataatatagtgattttgaagctttagctaatggcccgcatagcagtttttctctccttttcatactttcaatttttctcccaagtccgtgaaacatgatgtaatgaggttctcctctgtaatgtaaatatttttatcttaaattttttccccaaatgcttaatctgaaagctgacagagccagacatgatgttgaagggctttagatttttctgtaaagagttttcaatatttcacctgaaatcctagaaaacttataattaattttacaatttatctgtgtcaagggactatgtttgtcttgaattgcttgtttcgaggcatctgagagcggcttcttgttatagattctgagctgggaatgattagtttgtttttttttctcaccccttcagacttttctaaattctccattttttcagaccattcattgctccgtggctgagaaggagtatgtgctgtgtcagcagcaagcttttcttgcaacccgtcaaggaaagcatttctaaactctagaactctggcagggaggcttctccttggctaatctttctttcctagtgatgtagtccatcagctgtgtttcctaaatgctctctggcttatacagtacccatttgttgctacgctgggaacgtgtctagaaaaagtgtagtaattatgcacgaagaagctggtaccttctagagagatcattctgaaaacagatctgactggtgaaaaaggctttagtgtctgtcagtagtctcagtgtaagttctagattctttcctatggttcataaacccatgtcctggtctccacccacctctccaggctcttctcttgcaagtccatgccattcatgtgacactattgcagctgggaattgattgtgctcttatacacacaccatgccatttccctcctagaatgtgccttccctatgtcacactttccccttttgccttctgtctcctttcgttctacaaaatggatttcccatcccagacatgggaatgtcgaagatcagcactggacagatgaggcatcattagactccatggtaccagctggccatctacaacttgtgagtttctcctgcctcaagatctgtgacatggatagcaagggaccagccttttaaagctcctccaggtgtggagttaaggaaacagaggaagtaatcacaagggtgggaatcttcttttttgagatggagtcttgctctgtcacccaggctagagtgcagtggcactatcttggcttactgcaacctctgcctcccaggttcaagtgattctcctgcctcagccttctgagtagctgggattacaggcatgtgccaccacacccggctaatttttgtatttttagtagagacgggatttcaccatgttggccaggctggtcttgaactcctgacttcaagtggtctgcctgcctcagcctcccaaagtgctgggattacaagtgtgaaccaccacaccaagctgagaatcttttgtatcttagctcttggctaaggaaatagaaagtagagaataagaaatagggctgtttttaacaaaaaattagccacgtgtggtggcacatgcctgtaatccccaccactcaggaggctgagacaggagaatcacttggacctgggaggtggaggttgcagtgagccaagatcacgacactgcactccagcctgggcaacagagcgagactctagtctcaaaaagaaagaaagagggctatttaaatgtatggtgatgatgaatatgtactgaacctgtgagggaagttcttgacatacactattatgtatgttattaaatatggtacaaaattttttgtgatatattttatttgagtatcactgtaatctctactgtcatactctggcttctgtctttgtttcctgtagagccgtggttataattagaaatgtaaacaaagtattttgtgctttattaaatagaattttttctcaaaaactagctggcataaaacattgaatgggttaattttggggggaagttttggacaatttaaacttgacttttaaacttaacagtcttttgtatgttgtcacatcttctacttatttaacagtttggttagtgggagctgggagctgggagtgcaccaaacacactgaggtacttaaaatcttttcaattttattgaggcttaaaggcaagtaagaacctgttgcctctgcttgttgccaaaataacatggggcaagagtaatcagttacagttgctataggtaattacaagttgatttcactgagaagtaagaacactatatttaacaataaaaagtttatcagacgtgaaactttcctcctccctacacagcctaaggaggggaaaaactctcaccaaactatcattttactgagcagatttcaaaggtgttggatttttgggagacatcgagaaagactaattgcaattattgtctctaattgtctttattgatgccagcttgagaagagtaccaggatgaaagttagaagggaaagtagtcaagcagactgttaccctatgaagattcccacttattagactgtccacacgcagtggcattaaaacttcataaaaactgttccttacagtttgaaaattatttttttcaagtcattataattggttttctttttttttatttatttatttatttatttatttatttatttatttatttattttaaggtgcagtgtcactatgtcaccaggctggagtgcagtggcgcgatctcggctcactgcaacctctgcctcctggattcaagcgattctcctgcctcagcctcctgagtagctgggattacaggcacgcaccaccacacccagctaatttttgcatttttagtagagatggggtttcaccatgttggccaggatggtctcaatctcctgacctcgtgatccacccacctcagcctcccaatgtgctgggattacaggtgtgagccaccacacctgggcctttttatttctttttaattttgtgtggacttcaatggtagaagttatagttgatttgaccagaaagggacatgtgaaaaaccttcctaaaatatttcctttttttttcttgtgctgtttgctctatctgtaatcattagtgcccccctagaatgaagcagccaagtcttgggttatcacaaatataaacataatttttatatcatattcttttgctaaggtgatctggatatcaattaatttagcattaattattatactgtatgctgtcattagtcatgttacattattaggtattagtcacattacatcataattattttatgcagcctcaacttctttactaaaatgtgcagtagacatcagatcacaaatatcaagactttcgaacaggtgttggcaaattttttttgtaaagggccagaaacaagtacttttggctttgtgggttttatagtctgtgtcttatctactcaaccttgctgtctgtgtgaaagcagccatttatgtaaatgaatgggcatgactgtgttctagttaaactttattttgcaaaagcaggtcacgggactgatttgcctgtgatctctgcaacccagctcttgagtaagggtcacagactttgctgtggttaggcaggtacctcaaatgagtaaagtgaagtggctgtggggactgcgactagcaaaggtcacgtccttgtctaaaatgggcagctacttcttccctatagccactgtgactggctcagtgataccagatcttgtaattcaagggtagctgggaatttggatttttaggcaaagtccttttatcagttggcaactcatttagatttgttaaggaaatatggttgaggtcaagctacacaccttcgtgagttcttttctggtccatgaactccagtttagcaaattctggtattttcaagtgtaacagtatattatgtatgaataagaagtgcctgtagaatgtcatcagacatcgatagcaactatctaatgctggtgctgccactcactaacccttgtagtgcccatgacagacatcagtaattgatcataacactctttcctgctgagctaggagaaagtttcagatttcttctccactagggctctaaaaagccgcaaccagccaatcagtcatgtcccctgatataaaggtatttatcattctcattctagaaggtttataaaaaatgtttttttaattaacctaggaaatggctttggacttttattgttattctgttaaaaaaacctaattaaaagatgttcttaattaaaaagtactggagaaaacatgtattagaatggcaggtatgaaaaaaggtaagatactgttaatatggcagtgttagatttcagaccaaacttaggggaaagagtatccaaagtcagatgtatccttaaaagtcacttagcagcattccttccttgcagagaccatgaacttggctttctgatgtgttcattttcaccatgcctagtgcaaattaatgtgaatgaatagttacaaaggggagtttctttttttccttcctttcactgcctttgacccttctgcacatttggcggtagagtacgacattcagaatttagggattctgtgtgtgccatctgggatgcatgtattttttaaattgtttatgtgatatatacatgatacagcccagggaaaacatgctttattgtgcattttgaaagctttgcatctttttgtcttcctgcattacttctcattttaccctctgccagtctaaacactgttgtctttcacgtttgaccttctctaagagttctgctctagttctgtcgttgaacctctctcctctctaaacttctttagtactgaggactgtactagtttagcagcaatgccatgctttcttatgtcctttggttgtaaatttgaggcatttttgtttttttcttccaaattaacattttctttccctgccatctagcacaaggactgtgaatggagtgaactaaaagaacattttgtttaagcaagccatggtgttcattgaatgccttctctgtgccagtcactagggctataattgtggatgaaatagaaaaacagactctgccctggaagatcagagtctagtacagcagtttaaagtgtgatggaatttcaatttaaaatgtccccttcatggtaatcagtgatgcacatttacagctccactaaaaggagaagctccagtggggcatagctctttgtttcagtcactgacatatcccacatgcctggtgcaatgaccagtaaatagtaagtgctcaataaataattattaaattaacttttaaaagtttttatgtagagttattcctgcagggctgtgattataggcaaatcatagtgtgtataccttctaccttttttagtgtatctcccactcttgtaccccagaaaaactagtcttgagtatccttccagaaatgttgtattccagtcttgtgtatccttccagaagtattataaatattatattattatccttccagaaaaatcagtcttgagtatccttccagaaatactatatgtgcttgatatttatttatttatatttattttgaggcagggcctcactctgttgcccagaatggagtgcactggtgctatcacaactcactgcagcctccacctcccaggctccagcaatcctcccacctcagcctcctgagtagctggagccacaggcacgtgccaccatgccccactcatttcttttactttttgtagaggtagggtttcaccatgttgtcctggctggcctcgaacttctgagctcaagcaatcttcctcccttggcctcccaaagtgctgggattagaggtgtgagccactgcgcccagtctgtactttgttttctatatgagtatagcctatttatttttttctctgaaaatatattagatagttccatatctgtatatagtcatattatttttggtgactacatagtattttattgtctggagagatcataatttatttaaccagaaacctactgatgaacatttgagtaatttctgatcttttgctcttacaagcaatactacaataaatatacttgctcaacagtcattttacaacccctgaatgtaggacttttagtatacattcttaaaagtgtaatttctataagagtcaaagagcttatgcgtttgtaattttgatagtattgccaaattgtcctctacagagagtgtgagtgtgccattttactgtactcttactaacactgtgttgttttcaaactgatgttttctgttttgataggtgaaaaaatttctctcttttggctttaacatgcatttcttttatgtgaataaattggaacatatttttatatgtttatgagctagttttatttccttttatgtattgtgcctttataacatgctcagttttaaatttgtctattggcctttatcttactgatgtatagttgctctttatatatttagaaaaacattccttggctgttcttgcttgtttatatttccatgtgtattatagaaacagcttttctagttactaaccccattcatctaaaaaatgatccctttggtctttttatttatattatgtccaatttctagatgaatttagaaagtactgacatttctgtgatgttcagtcttatttcctaagaacataatttctctttacatctgttttttatttttaaaaagtaatttttttttttaatagagatgggggtcttgatttcttgcccaggctggtcttgaatgcccgactttaagtgatctaccaccttggtctcccaaagtgctgggattataggcgtgagcctctacacctggcctatttaaggtttcttgatgaaaaaattaatgacatgttaaaaataacctagaatatctttttaaaaatatgacataaagggaagatatatttcatttaatattcatattttattaaaatatcaattctttctaaaataacaattataaaattcagaagcttagattaaacatttcctttctgatcattttcttctcttttggcaggccctgaagaggaaagtgaggatgactctcatctcgaaggcagggatcctgatatttggcatgttggttttaagatctcatgggacatagagacacctggtttggcgataccccttcaccaaggagactgctatttcatgcttggtaatctttggaaaatcaaaattatattgaaactctagtgtctaaatttagattataggatttatattttgagtatgtcttatgaaataaacttttggagtattttatattaagagcgaaacttctttataagaacatgtaactaggtttttcttttttgagatattgctgattttttgagatggagcttcactcttgttgcccaggctggagtgcagtggcacaatctctgctcattgccgtttccacctcctggattcaagcaattctccttcctcagcctcccaagtagctgggattacaggcacacaccaacacacccagttaatattttgtatttttagtagagatgggtttcaccacgttggccaagctggtctcaaactcctgacctcaggtgatccacctgcctcggtcccccaaagtgctgagatttacaggaccatgcccggcccaattaaaagttgtttttctttttattctacatagatgcagagttcctcaaatatgctaaacaattttctggattctttatcagagatattaaatcatccaagtcaaattataactttaaaaaatactttcctgtccgtattagtttttagtagtgagagttttttttttttttcttctagttttgaatgttgtttcttctcaggaacagctgacctgacaatggggcctttctctcgacttgtcatttagttctttgggaagcagtttctcagttgtggttaggccaactgaagctgtggagtttgtgaggctttgtttttttcttctttgctgtaagtttttaattttatttttggactttctacttgttttctaatgcgcaatgtgtaaacagtatcattttttactcacaaagcttctcagggtttattctctacttggctcttgttcctgattatttggggtttatctcactcctatctacctggagaaatctactcatatgttgcttttggagccaggaagaaccagggctgaagcccagtatttatgataacagttgattcccagttaattgggtattttagagtctactatgttccaggtactgtgtaaggttccaggggagatattggaggtggatgaatcttggttcttgccttttgggaattcggagtacagaatagctctttaggccattctgccactaagcattttccaaattttagctcattgcctatgaacttcaaggttttggtcacaatcatgtacttctgcctaaataaagtaacttttaatctttcactgaattgaatttattttaaaaggagattttacatcactatcttaaatgggaatccagtatcactaggtataattagaagggctttagaaatataaatatagagaaaccaaaacagtactaagggcctgctacttttgtttgccggagatcctgagtctgagtcctattctgtgtttgttaaaagaggagattagtaacagagaggtgttaactgtatagtggtaccagtctgagactttctccttaatgtctgcaggaggattgggagatcattatgtagggtctctttcaaatagtgtgatttaatggcacttaatgtgatgtccctttacctcttaaattcttctcatggggagattcctgcatttcttgaacactgatctaagtatgcccttcatctcttgccttccatgtgaacattgctttgcagtttacacatcagtttcacacaagcagccccaatctcctgtcagctttgtgagggagatggcagagattgttctttttttaagtgatcttcctaaagtcacttagttatgaggtagaacagggaccagaatgggtggcaggcatcttatgcagtgcttttcctactctaaatggggctatttcaacctgatcccaatatactgaaatctctatgtgggaatgttttcagtgttaaggttctctcttccccactgtctctcctgcctgatctcaggaagtaagtttattttttaaagtccctaccccatcattgagtgtcatttgtaggtaaacattgtttcatttttttttgtaccacgcaaatacagatatttggcctgagtcttaatagatgttagtatcagccagtaaatcactttcctttggatactttgttcagaagtttctattagcaatgtatatctttcaaagaaataagagccagaatgttatcttttaaaatagcttttactttttaaaaatataaaagtggctgggtgctatggctcacacctctaatcccagcactttgggaggccgaggcaggtggatcacctgaggtcaggagttcaagaccagcctggccaacttgatgaaaccccccgtctccactaaaaataaaaaattagctgggtgtggtggcacgtgcctgtaatcccagctactggggaggctgaggcatgagaattgcttgaacccgggaggtggaagttgcagggagctgagattgcaccactgcactccggcttgagcaacagagcaagactcagtctcaaaaaaaaaaaaaaaaaaaaagtaaataagtactctaaaaattcagctatattccatatatttaataacatcttgtgtgttcttttctgattaaaaaagcaatatgtgcttatttgagagaaaagaaactctggaaaaaagagtctgaaatgaagaaagaatataaaaatcaggttaatgcctgatttaatatatttcttttcagtctttttctgtatatgtatgtctggaattatagtagtaatatgaataaaaccagatttactgggaattaatgacaaacattcttttaatcttctcagcaatcctgagaaacaaatattagctatactgcaaaagaggaaattgaggttaaatttatgtagttacttaaccgtggctgcacagctagtaagaagcatggattgtatcttgtcatcttatcccactcggggtctgacatcccatgtcaggccagccctccttctcccgtagggatgccctcctcaccctactcagcgctgaacgctgctcagggttcctgtgccttcttcttcccacctggcatgatgcctccgcctcacctaatggctttaagactaaattgttcaggaagggaagaaaagaagttaatgatattctgtttgtttcttttctgttcttcttaaggttatgggtttctcagggtttaagaactggattataggccaggcgcagtggctcacacctgtaatccctgcactttgggaggctgaggtgggcggatcacctgaggtcaagagtttgagaccagcctggccaacatggtgggaccctgtcactactaaaaatacaaaaattagccgggtgtggtggtggatgcctgtaatcccagctactctggaagctgaggcaggagaactacttgaacccgggaggcagaggttgcaatgagccgagatcacgccattgcactccagtctgggcaagaagagggaaattccatctcaaaaaaaaaaaaagcgctgtattttaatgaaaatattaaataatgacattattcattggattttggtgttataatgagtatacactgtaaaatatacattgggtcccttgagctattgtacatgataaacagaagaagttagcattattttataggagctgatatccaagacataatataaaatctactcttgatttcccatgtcttatttttagatgtaggtgatatagttggtatcctactgaactgtgccaaacacagcacaatatatcccaaagtctgcacttagaatatatatttttattaggatttattatttttattttatttgatttctgaaatgaatcttccttcatctcttttttttaaaaagtcaaaagtaaaagcaaccatggtctaatgctgccttttctctttacttttaaatccaaatagcacaaggagccccgtagagggagggacttcggccccgtgctgatatctgaaatctgaacttcatagcacttatgaaaaggaaacagtttagctcaatttataataatatattggtctgcagaggaagtgcaggctgaaccctgctgtctcaagtaaatactccaggggtgtctgatggggaacgtgtcgggtgcctgtaataaatccactgcccatggaagtgagtgaaggccttgttggcagtgcctgaggacatgcttaactaaggttgtcacggttttacttttaaattggaatctttgccctaatctcagagttagacatgaccagatttgcaaacagatttacaattttcactaattttccaaccaggacttcaaaacacactcagagaaaaaaaaatacactctggtctttctcagagtaggatgatttactttgccacagatgttttccatagactgaatgtaaccagggagttagggacttaaaagtggcttggagacaaaccatgggtttgttttttgtggaacagattatacagttcaagggacatcaacacaattatgtttattaaccaggagctgggtgtggaggtgggatgtttcaggacaaaggtgagtgctaggtaaacatttggggcaaaaaccctctcttcctcccttaatttgttattgttattctttacatgtcaccattcatgactctgttctctctgctctatttacatttgtttcttaagcacaactaaatctcactttcaagtatttgttgttactataccaatcagcagtttcaaaacttaagttgccaggtaaaaattccactgcaaaaaaagaaaactgcaatagaaatgtaaatgcatagcccttcttttttggtttttctttaccttgtcaacagtttagggtagagttgtgaaaggaccataggatttctatcaggtaaccaggtcccagactcaccgcattgtcaattgcctgtgtattgctagtgcctctcttagtctctgccttcactgtaaaatgggagcttaatgatacttccttctcagagtttttgggagtacaaataagaaaatgtatgggaataggctttgcaagctataatttgtaagtgcagacttgtgaagagtgggaactggaccatggcatattggagaaccagtgagacgactgggtgatagaagaatgctgaatgctgtgttcgtatcctgcttcatgcccagagttttgtcaccttcacaaaataccattccatacgtatatttgctacatataggaactacaagaaagggaagttttaccaatggattcttgagggtgaggagaattaatatctggtccattggttatcagagccctgtagtaatcagtcttactttggtggaggccagctttacttttagagcctggccagtagttttttatagattaagttcaccttccttgaaatacctatggcttagaggcagcaagacccagagcacagaaatatttgatgtggtctaaactgtaaattgccatgcttctgttttttgactcaacatggccactcccactggagtctgtagccctgtgagcaggaagaacagaggtctccaggagtttagactcttaagcgggggctcccttgggactgaacatggaaactgtggtatctttgtaaatcctccaggtgtccctcagttttgccctgatttagacattttattcaaaggaaaaagcttttgttatttctttctctgaccccattcccttcctcaccaacctctgaatgaccagctaaagtaaaaagtacacataatttatggcttaatcataaatttaaaataattatactttattacctctcatgggtcttgaaatgtaggtgctatgttctgctttctgccgaggcaagggaataatacagaaaccagtaataaattataacttcaggctgcagttggtaagctggaggaattgctatttaagtggaaagtgcttgaacagccaaatgagcacctgtcatgtttattttcactttgaaaagtagaaacatgacagtatagtttccactgcctatccaatatgaacttctggcattcttgttatcttctcaggaactgcactgtttgcttcttgtgttcaatttttttttttttccagggatgaggatgtatctctcctcctgaaactttcactctaaaatatgcccccaaatactgacattttcaagcttgtgcttttttacttgatatctgattttttttaaatttttatttaatagggagaaggtcatgacttatggaatttactctaaggatagggatctgagcaggttcctgagtacttgaaaggctttatttacctcttacacttttttgttacatccaggtttttgctcatttctctatcatttgtgtcttgaactttacctgaaatgcatgtcttgagtgcctactaaggtccaggcattgtgctggcagatttgatatatttttgtttattccttattacaggactattacatagtagactctcattctgacactcactttttttttccagaaaaaaaaattaatggagattgattgctaatgggtacagggctgcttttaaggctatgaaaatgctctaaaattagtttgtggtgatggttgcacatctctgaacgtactaaaatacattgaattatatactttcttttttcttcgttttgcagcttttgctcaaaggagaattagatatttaaaatgagtgaattgtatggtacatgaattagatctcaataaaactattttaaaaaaagaaactaaagcttagagaagtataatatcttgttcaatatgacactacctggtaaagcttttgtccaaatttttctgagaccaaagctattctttcttccactgacgcatgctatctctactaattatatagccacggtatcctttttctttaaaaatgtaggaaaaaatggctgggtgcggtggctcacgcctgtaatcccagcactttgggaggccaaggcggacggatctcttgaggtcaggagtttgagaccagcctggccaacatggtgataccccacctctactaaaaaaaaaaaaaaaaaaaaaaaattagccaggtgtggtggcgtgcacctgtaatcccagctactcgggaggctgaggcatgataatcacttgaacctgggaggcagaggttgcagcgagtcaagattgcaccactgcactccagcctgggcaacagagtgagactccgtctcaaaaaaaaaaaaaggaaaaaaaataattggagaaataatacatgaacacacatgtattctcattcaaactttgtggaactatatgaaataaaatgtagacattctctttccccttgctttcccatctggtcctttgtaagtgttagcgtaaagatagttatgttgacatatttaaatatatgttgctgctgctgtatttttaaaaaacataaatgatactttattataaatattactctagtgtttgttttttgtacataatatgtgctggaaatttttttatgtcagtatgtcattcatattattattgttattataaaaatactacatgcacaaggaaataaaaattgaaagatttaaaatggaaagttgaggaagatctaaaatggaaagtgaaaaactccacctatccccaagttccatcccttagaggtaactgcttttcactgtatttgcgttttattctttgattacctccctaacccttaaacatatatatacttgtacttttatttctttaataactttaagcattcttggttgttgatcagttaagaatgacagaaacaggcagattgctggagcccggaagtttgagtccagcctgggcaacatggcaaaactctgtctctacaaaaaatacaaaaaaaaaaaaaaaaaaagccaggtaagccaggtatggtggcaaacacccgtggtcacaactacttgggaggttgaagtgggaggatcagctgagctcgggaggttgagcctaaagggaactgtgatcgcgccactgcactccaggctgggtgacagagcaagaccttgtctcaaaaaaaaagaaaagaaaaagaaaaaagaattatggaattagtgctctgatactacctctcactcttgccaaatttggctagttaacctttacttttaggggtttatttccttaattactttccttagaaccagtttatagatactttctcttgaattttagtgtgtaatgtggggaattaaagttctctttcagccatgtcattactttgacatgattgaggtttacaactttacatacagatctgtaattttgataagacaagcacgcttataagttgatctgaaattagaaagccagtacataatgatgttgatgtaagtgttgtttattgcaaaatgagatagagtgatggaattaataggtagaaaatgtaatctactgtaactatccaacctgcgccaatgaatgaagaatactgcacatgtcaggtcaagattttatacttaatcaaaagctcaaaattatgtacattttagcttgctttgtatttgaatcatgactttgttgcatagtttccctctccccctggagacttatattcgtctttttttttactcttactgatagaagaagcatgctataatgattgctcaatatcactagatgtttcgtcatgtgacttgttcagtgtttgataaacactggcttcttcataccccacctaccacagttatcatactgggatttcttctcattggacacctttgccaattccattaaaaaatcattttaggctaggtgcggtggctcacgcctgtaatcccaacactttgggaggctgaggcgggcggatcacctgaggttgggagtttgagaccagcctggccaacatggcgaaaccccatctctactaaaaatacaaaaattagccaggtgtcgtggcaggcacccgtagtcctagtgcctgttttagttactggggaggccgaggccagagaatcccttgaacctgttaggcggtggttgcagtgagccaagatcgcaccattgcactctagcctgggtgacagagcaggactttgtctcaagaaaaaaaaatgtattttaaatttcagtagccttagggatataagcagtttttggttccatggatgatttgtatagtgttgaagtctggtattttaatgtacctgtcacctgagtagtatacatctgataagtgttttgttttttttttcatccatcacccccctcccatcctcctctcttctgaatctccagtgtccattgtaccactctctacaccttcatgtgcccatagcttagtgcccacttacaagtgagaacatgcaatatttgtttgtccattcctgagttacttcacttagaataatggccttcagtttcatccacgttgctgcaaaagacatgatttcattttttttaatgactgagtagtatttcatggtatatatacatgccacattttctttatctactcaacagttgttgggcactttggttgattccatatctttgcaattgtgaaatgtgctgcaataaacatatgcgtgcagatatctttttgatataatgacttctttttcaggtagatacccagcagtggattgttgggtcaaatggtagagttacttttagttctttgagaaatctccatactgttttccatggaggttgtagtaatttacatttccacccccagtgtataagcactcccttttcactacatttctagcaacatctattattttttgactttttaataatggtcattctggctaggataaggtgatatctcattgtggttttaatttgcatttctttgatgatatgtgatattgagcattttttcatatgtttattggccatttgtatattttcttttgagaaatgtctattcatgtcatttgcccactttttagtgggattatttgttttttttcttgctgatttgtttggattccttataggttctttgtcagatgcatagcttgcaaatattttctcccattctgtaggttgtctgtttactctgataattatttattttgttgtgcagaagctttttagtttaagtaggtcccgtttatttattttttgttgcatttgcttttggggtcctattcataaattcttgcctagcccaatgtctagaaagagttttcttctagaatttttatgggctcaggtcttagatttaagtctttaatccatgttgagttaatttttgtatatggtgagacacagggatccagtttcattcttctacatgtggctatccaatgttcccgcactgttttgaatagggtgtcccttttccagtatatcctttgtcgaagatcagttagttgtaagtatttggctttatttatggcttctccattttgttccatcagtctgtgtatctacttttataccagtaccatgctgttttagttactacagctttgtggtataattttaagacagataatgtgatgcctccagatttgttctatttgtttaggattcattggctattcaggctcttttttggttctgtatgaattttaggattatttttttctaattctgtgacaaattacattggtattttgataggaattgcatcaagtctgtaaatttgtttgggcagtatggtcattttcatgatattgattcttccaatccgtgagtatgggatgtatttctattcatttgtgtcatctatgatttctttcatcagtgttttatagttctctttgtagagatcttctactaccttggtcaagtttatttctaggtactttattattattattttttttagctattatcaaagggattgagttcttgatttgattctcagcttggtcattgttagtgcattgcagtgctactgatttgtgtacattgattttgtaacccaaaactttactgaatttgtttttcaaatctaggagtccttggaagtgttgttaggattttctacctacacaatcatattactggcaaacagagatagtttgacttcctcttttcaatttggatgccctttatttctttcctttgcctggttgctctggctgggacttcctgccaattccacttttacttggatcatttgtatttctctttcttagaattttctaaaaattctgttatatttaaattttctaaaaattataccatattttagattcttccaggcaaggactgttttagctttgtatcctgtacagcacctaacacagtactttgaatatggctggtgcttactaagtatttgttgaactaataagtgaatgaatgaaccaagaactggcttttttttttcatttcatggtagtgtgtcttggttatacaagcaaaaggaagtattaattctatccttgaaagcccctgcctgggaaaggttttgaaattccttctcaaacagatggccattcacctaatgcttggagattaccagagacagaatttagaatcttccatggcagcctattctttttcacagtaactcatgcttcttttccttacatctagtctaactaaccacgtgacatcacagaactttctaaagagacacagtatctggatccatctgtacattcccttctaaatttttttataagaaaaccatcaaagataaaaataatgtgttggtttcttttaggctgaggaggaatgttttactatgcattttgaaatttttttgttctctcatatttcattcaattagagtcaccctgttttggggtaattctgcatctgagtttggtggtggaatttttcccattggctaacagtcttcatatgccctctttggccacctgtctattgaacataattcccaaaggcatgagctatagaaaatttttttttttaggcctttatgtaggttgtatatcctgtgtgtgttatttgccactcctgtaaagacagtggaagaatgactgtgaatgatgccattatttttttcagtcgatctttattgaaggttcgaatttaggactaggccgggaatgagtttgactttcctcatctagtcagtcccagcagcacgtttcaaggtcagactatatacctcatgctggaaggttccttagactttgtaatctaagcccaataaacatctttttttttttttggggggggatatttatttaccaaataaataggacagcacacagccatccgtgaaggtgataagagctttgactagttttataaatcttcccctaaatataattttctatgggagtgaaaactcttttataaaaacaattgagagaccgaggcaggtggatcacttgaggtcaggagttcgagaccagcctgggcaacatggtgaaaggctgtctctactaaaaatacaaaaattagctgagtgtggtggcgtgtgcctgtaatcccagctactcgagaggctgaggcaggagaatcacttgaacccaggaggcagaggttgcagtgagctgagatcgcgccactacactccagcctgggtgacagagccagactccatctcaaaaaaaaaaacaagcatggaggtgaagatgatctcaaggtacataagatacatacctaaaggtacaaagatataaatcatagtccttggtcaattcattatagtggttttgtagtctgtcctacagttggttggggtaacaacctcttttcttatttttgttcacactgctctctctaccccctcatctaggtatgtgtatagctcatttatttaggggtgatgttaaaaaattgaatgcccttaatggcaagggaaccaaccaatcaatgtggatgccacaactttttcccctgttgactgttgttattggtatggaagtattttttttttctcccagcttttatttcaggttcaagggatacatatgcaggtttgttacatgggtaaattgcatattgtaggggtttagtatacagattatttcatcacccaggtaataagcgtagtacctgatagataatttttcgatccttaccctcctcccaccttccaccctcaagtgggccctagtgtctgttgttcctttctttgtgtccatgtttactcagtgtttagctcccacttataagagagaacgtgcagtatttggttttcttttcctgcgtgaattcacttaggataagggcttctagctgcttatgtcacctacttatgtcacctactactactaagctttttgagaacctggtctctctctctctctctctctctctctttctatatatatataggaagtcctggattctggggcttcgagggctgacctggagcctgagtccacaagggcatacctggtgctagagtaggcttggagccttcgtctttggaggccaccctatcactggggttcactggggtggacctctgcttggtttacagagaagttgggtactcacttcattctccttcccccacacaaagggtatccctcttgacactgtgctgctcaggcttcagggagaggtgacgtaggtaatttgaaactgttcttcctactcatcaatgtgtcttttcttatttctgtgctccatccaggcaatgtaatctttaacctggattcctttgctcttataaaggtattctgtgcatggatagttattcaaattgatgtttctacaaggagacaagtgctattctgacatcttgcttgaaagtaagggattaatttttaaaccagtttttaacaattattttcaagaactgtttagtgataagaaaacaatgctcaaaatataaaagtatcagggaaaaaagatgcaaaatgtttgtacaacatgatattaattttatataaacaaaggataaacatattactaagtataaaaaaaaactagaaggaattagaccaaataattataaataatattttctcttctttacacttttctatagtttgcaaattctctacaatgagcatgtaccctaattcatcagttccaaggtagacattttttcttcatatttaacatctctgaaattggaatccatcttaaactgatgccttctttgactggatgatatattattacttttaaattaagcaatacaaactttaaaaataagtatccttatgttttaaagcttcaaacggaaatgttcaataaagagattctcaggaaagaggtattcattcaccaaataaataggacagtaaacagtgatcagtgaaattggtaagagctttggctagttttgtaaatcttccccaaaataaaatttttccatggaagtgaaaagtctttcaacaaaacaagtatagagataaagataatctcaaggtacataacttcccctctccttctcccctttttttagaattaacttttatggaatgctcagtttgttgatgggttttgaagagaatagattcttgaggttaataattgatttttgctttgctttcttttctttttttttcctttttgtgagacggggtcttgatctgtcacccaggctggagggcagtggtgggatctcggctcactgcaacctccgcctcctgggttcaaatgattctcctgcctcaatctcctgagcggctgggactataggctcgtgccaccacgcccagctgatttttgtatttttactagagacggggtttcaccatgttggccaggatagtctcgatctcttgacctcatgatccgcccacctcggcctcccaaagtgctgggattacaggcatgagccaccttgcctggccgatttttgctttctaaataagcaaaaagatctttaatccactttagccagggctacctttctcctttattcttccaagttgtaactcttcccaggagactgcagagtatagcgagttggggaaaaggaaagatgagaagggagagaggttagattgacagaaaagataattaaatggttttctccattttcccctttgtatgtgcagagcccatcacttctgcccacagttccactaaactgtgaagaccagaatctctcaaagttaatgaatgaaacagaagaagccacttcaacctccaatttctgtttctatgtcttctgacctccttctttacacatcctatctcatatccaattttccattagcaattaagaaggatagctatggtttctggctaatacctggggagagaaaaaggatgttctctccaaatatgtggtaagtttctagtatgtgcaaggttctacatgctgtgtgtagtataaaaatatatatcactatatatcatatcaatgatatatatatttcattatatgatttatatatcatataaatatatatcactgtatattaaatatattttaatgatatttatatatatatcatatataactcataaaactcaatagcaggttaacaagtaacctgacctaaaaacgagcaaaggacttgaatagacatttctgaaaaggagacatatgaatgctcaacatgtatatgaaaatgtgctcaacatctagtcatcagtgaaatctaaatcaaaaccacaatgagatattacttcacacttgttacaataactattatacaatagacaatagataacaagtgttggtgaggatgtggagagaagggaacccttgtacaccattggtgggagtgtaaattggtatagccattgtggaaaactgcatggaggtttctcaaacagttaaaaatagaactttcatatgacccagcgattctactttggtatacatatccaaaggaaatgaaatcagtatctcaaagagatatcttcattcccatgttcattgctgcattattcacaaaagccatgatttagaaacaacctaaatatctgttaacagatgattgaataaagaaaatgcagtaggtatatctatatctatatctacacacacatacccacacatatccacacataatgaaatattactcagtcttaaaaaagaaggaaatcgtgtcatgtgtgacagtgtggaatatgttatgctaagtgaaataagcaaggcacagaaagacaaataccacatgatcttacttatatgtggaatctaacaatgttatactcataaatgcacagagttgaatgtggtttccaagggtttgagggatgttgggtagatgttggtcaaaaggtaccaagttttgtttatgcagaatgaataagctctagagacctaatgtacagcatagtaactgtattagtctgtcacattgctgtgaagaaatacctgagactgggtaatttataaagaagtttcattggttcacagttccccaggctgttcaggaagtaggacgctggcatctgcttggcttctagggaggcctcataaaattatgttggaaagcaaaaagggggagccagcccttcacatgcccggagcaggaggaagagagagtgaggggggatgtgccacacacttttaaaccacctgatcttgtgagaactcactgtcatgagaacagcactgagaggatggtgctaaaccattcatgagaaaccgccatgatccaatcacctcccaccagaactcatctccaacactggggattacagtatgacatcagattttgtggggacacagatccaaacaatatcagtaattatatttattaatactgtattacatatgtgaaattagctaagagagtagatcttaaatgtttttaacacacacacacacacacacacacacacacacacacgtttactgtgaggtcatgggtatattaattagattggttttagaagtcatttcacaatgtatatgtatattaaaacgttacattttacattgtagatatataaaatgtttgtcaattatacttcagtaaagttcagaaaatgttttaaatcacaaaataatcttctactttggttattcaagttttttgatattatatatattgctacagtgaacatctttgtacatatatctttatttccataggaaaaattgctagaagttgaatgccttggtgaggtattatggtgtggacatttacacagtacatactctgttgtcagactgttacttagagagattttcattttcattcctacctgcaatgtatgaaatgtgatcatcagttacttccaccaacctcctttaccctactgtatacagtgctaagtgttccaatttacaaatatttttgccgatttgatgggtgaaaatatgctattattttaaatgtcatttatttattcatgaggttgaacactttgtatttttgttggccattcttctttctgttattcattggctgatcgtattttgctcatttttctgttgaggtgttagtgtttttcttaacatttactttatcccttctgcctttaactttattgctttaacccttctgcccacttcccagatattttcttatacccaattttcaattttgtatttagatttttaatatttattttaggtgaaacatctttccatttaagtcttaatcgcaatagttgcattaaattaaataacaatatttgaaattatttaactgcgtttatgcttactgctagcctttttgtactgtgatttaaaaaaaattcttgattgttctcttggtcagccaaaatgtagtttctaataatatttatgaagactaatggcaggggagtggtcgtggcatattctttgagtctttgcattatagaagagtgacttcctatcctttcacttgtgaatatctgcttgattggctataggattcttaagtatcaaacttcccccttaaaactctgtagaggctgggtgcagtggctcatccgtgtaatcccagcactttgggaggtcgaggtgggcagatcaggaggtcaggatttcaagaccagcctggccaacacagcaaaacatcatctactgaaaatacaacaattagccaggtgtgatggcacatgcctgtaatcccagctactcaggaggctgaggcaggagaatcacttgaacccagcaggcagaggttgcagtgagctgagattgtgccactgcactccagcctgggcgattagtgagacttcatctcaaaaaacaaacaaacaaacaaaaaaaccaccaccaacaactctatggatatcgttctgtgacctctgatatttgatgttgggagatgtctgaggtgatctacattatggtttcattttggtaagctgtattttctgtttggacatttgtagtattttatatttaattttttaacagaatatgtttatgtccttgctcaaccattttatagtgcagactctggtcttttcacaaccttggaaaacattcttctagtgtttctttgattattcttatatctttctgtatcttacttttttttttttttttcaagatggagtctctctgtcgcccaggctggagtacattggtgtgatctcggctcactgcaacctctgcctcccaggttcaagcaattctcctgcctctgcctcccgagtagttgggattacaggcgcctgccaccacacccagctaattttttttttgtatttttagtagagacagtgtttcaccatgttggcagggctgatcttgaactcctgactggccttaagtaatccatctgccttggactcccaaagtgctgggattaccggtgtgagccaccatgcccagcctgtattttacttccattctgtgattcctgttaagtacatttggatctccaggatctgttcctcatgtctaaggttttccatcactcatttcttgtattttccctgagttataggagaatctcttgagttcactcatccagctcagtaatttggtttttctgcagcatgttttctgctgttcactccatctattgccgtgttaaatgaagaaatgctattaaaaaagtcagttgccagtggttttttctgatctcatactgtttcagcttcatgtctgcttaccgtattttcacagatgcagtgccttcttgaatcaagtgtcttcttgaaaaactgagaattttctaaaattttatcatgtcagttcgagtaaacttttttcagaaaagacagttttgatcaaagtgcctccattcctttgaactgtagtaattttgcatagttctggcaattactccttgcctctttatcctcatagaaagtagactagtactggctgataggcaagtagctgagattggttctgtgagagattagtatggattcctggccaaatcctttacttgaaggtggaagaagatgtgtccttacacagtcatgtagagattttataaattggagtgtgcttaagaacttgtttttgtctttatgtggatgcttgcagtatgagcaaaccatggtaggttttggcccactcctatcattgctgattgctccagttccttgtttctgcaatgcctggtactcagagtcatggcttataacagcagcacatccaggggtctgtgagtatcacaggttatgtgcacagaattctggctacagtgagtatcacaggttgtgtgcatagaatgctcgctacagaggcaagagccttgctctctgagtgccctgtaagcttctcttgccctcctgctctttgctttctgagttaagaggtgagcattttgctcaggatttgattggtatatttatcaggctcgctgctcttttggagagacaatcacctgtcagccttctttgcccttctttaatctaattccacctatactatattcagcgcaatcatttgcacttctggcatattgagcacctttctctaatatatagtgccaaaagaggttttgatccatttttatgttccattgattgtctcattgagaatctaggaatgggacggggcctgtgtctatactggcatcttgccaggaaccttcccctccccctttcattggctatcaaattctgaaaatgttttcagccatgggtggcccacatctaggaaaaacaaggtcataaatattaagattgagagatgagaatggacaggtaagtaagaatgaaaagcttcagtgattgtttgaagctgggaagactggatttcagtactgggcttatttaccccaagagtgcctttagcaaaagtcatgattgtttctctaagaaatttgggtgaaatggccctggtaatgtacgtgacagcaaacccaaggaagtaagggctggggtaaatttagggtgaccaactgtccttttcgaaaagtctgtgggcaaggggatctcaggatgcaggactttcagtattaaaaccaggaaagtcgtgaacatgaattggttaccctagcataaattatagcattgcttctgtggtcttttatatatgaaatgagatttcatgctacagtgaatgtccagagctctcttctccactgccagggcacgcagcattcagccagcaaagagtgagagcgtcttttctttttgtgtgtgtgttgtcacatcatctacaaactcttactccagttggatacagtgtcagtcaagtttcagctgtattctgagatagctgtggtaaatagacattctttaatttattttttctaaaaattattaggaataatcttttaaagctgggagggtcttaagtatatcctttgagatgcacaatccatgaagcttgtgtcgcttttatagatggagttttcgataaattagaagctcttaaatgaaaattacaagtttctttttttaaagtcataaaggattagatacagttggaagcaatttcaaaagaattgtttgattagagagttgccaaggatttaaatgaaggtggaagcctcaaagtataccttctagtgttgtgtttgccatttggcctgagtcactaggtgactcagtgttcccctcagtggaacaaaagcacttaacaaacctactcattaaggtggtgatttttcccctaattatgactgtgggtcccagtattaatagcataggagtaataaggcttttatttgggtagatgagactggcatttatgtatttcctagacattgtcccagtcttttatgggaatttatcctgggaagcccccttcaaactccactttttattattttgcttgactctgaaacctcctttaggcaacatagtcaggatcaaccaaaactgctcaggaatgtcctcagagatggcaaacgggaagagagaatggccacttagccttcctcattaggccttacagccacacttctgctttttatcctctatattgttgtgtttatatttggatttaaaactccaaatgtatcactgatgttttcatcctcacctctaattgcattttgtagttattattttgcaatgtcctaaggttttgtgacttattcaccttcagtcagttgttgctgtgaaaaccccaagagttgttcttgagtttattttttcctgacttgactcatccagttcattagcatgtcctattgtcttttcctagaacattctgaatctgttgtctgcttatcgtctcctcccctgtctctgtagttcaagtcactgttaactcctgcatgacttactgcaacagcttcctgactggccttctgctgccattcttgtttcccctttagttcttcctctttcctatgaaactgccagtcagattagattattgattcttttgaatttgctacacagacaataatataatctgtgaacaaacatactctaattgtttccttctctatttgtataccttttgttttcttttcctgtcttactgtgtcagccaggtcttccaatatgatactgaaaaggaatgttgagaggagacatccttgtctttttcttactctgagcagaaaagtttctagtttcataccgctaagtatgatatttgctgcaggtttccttacacattctttatatgttgaggaagttcttctctatttctagtttactgagaattttttatcatgaatgggtatcacattttgtcaaatgtttttctgtacctattggtatgatcatattttttttctttgtagcttgttggtgtgatagattatattagttgatttttgtatgttgaatcagttttttatacctgtgataaatctcacttggtcgtggtgtaattctttttatacattgttacattcaatttgctaatattttgatgtggatttttgcatctatgcttatgagagaatactggtctttagttttcctttttgtaaggtctgtctgggcaatgctggccgcaaagaatgagtttggaagtattccctgtgttaccttctagtaaagaatgttaagaattagtataatttcttccttaaatgtttggtagaactcaacagtgaacatatttgggcctggcgctttggaaacatgttaattattgattcaatttctttaatagagataggcctattcatattattcatttcttcttgtaagagttttggcagattttatttctcaaggaattggttcattttttataggttttcagatttttgggtaaataactattgacatcattttaaaattatccttttaatgtccatgggatctgtagtgatgtcatctctttcatttctgacattagtaatatgtttcttgtctcttttttcttagtctgcctagaggtttatcaattttattgatcttttaaaagaaccaacttttgctttcattaagtttctttattagttttctgttttttatctcatcgaggtgcattaacttttattgtttcttttcttctgctttggattaatttgttctttttctttaatttcacaaagtagaagcttagcttattgattttagatctttcttcttctaatataagcagaatgctatattaatgctatacatttgtggcatttaatgctataaattctcctctaagcagtgctaatgttgcttccaacaaattttggtaagttgtgttttcactttcatttagttccttttttttaagatttttttgacccacagattattagaagtatattgttctatctccaagtatttgggaattttccaactatctttctgttattattttctagtttaattccattctggactgaggtcaaatattttttaaaaaaatgtttcagacaaataaaaattcagggaatttgttgctagtagacgtgtattgcaggaaatttgtcagaagaagaatgatatagatcagaaactcagatctacataaagaaaggaagagattttgagatggaataagtgaaggtaaaataaaaaccattatttttcttacccttaattgatagaagagataacaatttattcacaataataacaacaatgtattcaattatgtacgccacatatgtgtgtgtgtgtgtgtgtgtgtgtgtgtgtgtgtttgtgtgtacctatgtatgcttatttgtaagtgaaagtaatgataacattctcttaaatttggtaatacgtgttttatcgcccagaatgtggtctgttttggggaatgctccatgtgagcttgatactagtgtgtattctgctgttgttgaatgaaatagtctatgtatgtcagttatattcaattgactgatggtattgctcagttcaactatgtccttaatgattttctgcctgctgtatctgtcgttttctgatagagggatgttgacatctccagttatagtagtggatttgtctgtttttccttgcagttctatcagtttttgccttatacattttgatgctctactattaggtgcatactgttatatcttctgggagaatttaccactttatcattatgtactacccctttttctctgtgataatttatctttgctctgaaatctgctctgtctgaaattaatataggcactccagctttctttagattaatgttagcatagtatatctgtcttctttgtttctttaagtttaatctgtgtgtttctttgtatttgaattgagtttcttgtagatagcatatgccttgttttttatctattctgataatctcttattttttaatgtgtgtatttagaccatgggcatttaaagtgattattgatacacttggattaatatctaccatatttgttaatgttttctatattttgtcttgttttttcccctgtttttgtcttccactctttttctgcttttatagttttgagtatttcatgatttcatttcatctcctttcttagcatatcaattacatatgtatttttttactttttaagtagtgacctagaggttgcagtatacatttacagctgttccaagtccactttcaaataacactatactgttacacagatagtgcaagtacagtaaaataaaatattcctaatttttttctctcatctcttatactcattgctatcattaatttcacttacaaataagcatagataggcacacatacatatatatatatgtggcatacataattgaatacattgttgttattattgtgaataaattgttatctcttctatcaattaagggtaagaaaaataatggtttttattttaccttcacttattccttctcaaagtctcttcctttctttatgcagatctgagtttctgatctatatcatttttcttctgacaaatttcttgcaatacaagtctactagcaacaaattccctgaatttttatttgtctgaaacatttttttaaaaaatcctttctttctttctttttgtttttttgagacagagtttcactctgtctcccaggctggagtgcagtggcgtgatcttggctcactgcaacctccgcctcccgggttcaagcgattttcctgcttcagcttcccaagtagctgggattacaggtgtgtgccactgcgcccacctgatttttgtatttttagtatagacagggttttaccatgttggtcaggctggtcttgaactactgacctcaagcgattcacctgccttggtctcccaaagtgcttggattacagacatgagccaccacacctggtctgtttctcctttacttttaaagggtagttttgtaggatccacaattctaggttgctgtttttttttcctctcaacaccttaagtatttcacttcacttttgtattgcttgcctcgtttctgaggaaacgtcagatagctttttttttgctccgttatagataagctgttttttccttctggctttttcaatattctttatctttgactttctgcagtttgaatataatatgcctaagtgtaggtttttttcctgagcttcccgagtctctagtttggtgtctaacattaatttaagaatattcttagttattattgcttctaattttcttctgttcctttccctctttcttcgccttctgttattccattatacatatattacacctattgcagttgtcccatagttctgtttttttttttttttcagtcttttttctctttgcttttcagttttggaagtttctcttaatatatcctcatgctcagagatctttcatctgccttgcccagttctctaatgagcccattaaaggcattcttcatttgtgttacagtgttattgatttccagcattttgtttttgattctttcttagaatttccatccctctgcttacgttccccatcagttcttgcatgtcgtctacgttgtcctttagggtccttagaatagtaatcatagtttcaaaaacatttctgataattaatttctgccatttctgactctgggtctgatttttgctcagttttttcaaattgtgtttttttgccatttagaaggccttgtacttttttcttgataggcagatgggatgcactggataagaggaactgcagtaataatgtggtggtaaggtatgttgggaggggaagcattctataatcttatggttaagcctcagtcttttagtgagtttatgcctgtgaattgtgaacctcacaagtgcttctcattttcttttttctcattcttagttccaataggatggctagcaggggctaggagttctaggtggcattgaagtatgttcatgccactacactccagcctggatgacaagtgagaccctgtctcctgagaaaataaataaataaataaataaataaagtcgctattttttcccttccttctgccagaagcatgagaagatgtttttggatcttcactgtgagaacctgttagagcttttggagataaaactcacaaaagtgtgggagttccctaagatggagctcccctggactttttaactctcagtcccgtctacgttgaatctccagcaattcagtagttacagttacggtttttctatcctggaactggttcccatgtgtgtttctgcttcttgttttttactctgataaattgtcatctctgtttccagtgtgtctctctctccagagtgaggaatgacaaaattacatctcattgaaagccactgctcttggttttataatatctttacatctttgatttaccacaatgtaactttgaatgttgtaccacttttccttccatcctcttttgtgctttttcatgtgttttacgtctgcatatgttataaacctcagaatacattgttattattttggatttaaaaaggcatttattctttcatgatatttgttacttatgttactttttattcctttgagcagatctaaattccttctgacattatttttcttttgcctgtagaatttcataactattcttatagtgtaaatctactgaatataaattgtttcattttctttctgaaaagtctttatttcacttttattttggaaagggtgttcactatgtatagaatagtagattgacagttttttcctttagtattttgtcaccagttgtcttctgagttttataacttctgatgagaagtctgctgtcattctaatctttgtccctctgtatttaatgtctctttttctgactgcctttaacctttccactttattactgattttaagacatttcattatgacatgctttagtttagtcttatatctttttttgcttagaattcgttgagcttattggatctctgggtttatagttttcatgaaatttggtgaattttggccattgtttctataaaaatgtgtgtgtttttgtcactctttcttccctagaattcaaattaaattttcattaaatggcttaatattgtcctggctgtcactcatgccctttcatatttttgtagtcttttttgtttagccactttattttgcatagtttttatttttcatgtgttctagttcactgatcttttcttctgcagtttgtaaattgctgttcatctcacttagtgtgagttttgtttcagatactgcatgtttaacctttagaagcttcacttatatatatatatgaaagggcagatatgtacatttagaagaaaagagagatgtgactacctcgcatattttgtgtgtgtgtatgtatctttcatttctctgttactttttgaatggatgttgggtattgcacatcgtatttgttgggtgcctgattttgttatatacttttacatacttttggcttttgctctaatgaataattaaattactaagaagttggatcctttttttttttaaattttgagatggagtttcactctcgtttcccaggctgcagtgcaatggcgcaatctcggctcactgcaacctctgcctcctgtgttcaagcaattctcctgcctcagcctcctgagtagctgggattacaagcacctgccaccatgcccagcgaatttttgtatttttagtagagacagggtttcaccatgttggccaggctggtctcgaactcctgacctcaggtaatccacccacttcggcctcccaaagtactgagattccaggcatgagccactgtgcctggccagaagttggatccttttgaggcttagttttaagccttgctaggtgggactagagcagcctttaacctaggactcatttagccctacttctgcagtgatgctttcctaaggattttctagtatctcatgtagtgggagccattttggctgctgggatcatagaatactcctggctgtgtgtgaaatctgaaattggttccacctgctgcattctggtgcttctttttttggcccttgggaaatttttattcatacatgcacaggtcagtgctcttccaaatacttgagggaaccttcctgcagtctgtttgctgtctctctgtatagctgtttctgttccagcattctgcctttcgaggccctgtggccttggcctccctatactccagtctttgtcttctcaacttggcaagaaagaaacagagactctgggttttgacttcctcttctctattctgtggcattgaaactgtttccatggagtaagttagggcaattgtaggcatctctcacctattttgtttctcttctccatgggattatatcttgctgaaacctttgattcatatttttggcttgttttgtagttgtttaagacagaagggtaaatcttgtcactgttacttcacaatattcataagcagaaatcctgtcttaatatcttgcatttcttttctatgtttagagatgatattgtaggttgtttttgctgatacataaggggcctggtggcatttgcctcttggtttaagtcattatcttttttggtatcttgataaaaatcttgtgttgcctgtataggatgccattgctggaaacattacaactctctttttttgtaatagaggaagtcatgtcctgagcagaggttgtatagattttgcctgacttgtggtatcatttcttaggatatataacaacttggtcattggtttttctcccactgcttgtggttttaggaatattcttcaactgatgaattcaccacctacttcattcttgggttgtgaatccctacacttgagttctgttctaagagccaaacatgcaacatgctgagttggttggtttattgcctggaaaattgttagggcaaaattgatactttgattatggagggaaagaggcagatttttcagatgaaaggtgtgcaactccaaattctggtttattctaaagataagggtagaagtagatgtgtcatgagaaagtgaaagaagctcaattcatatatagtgaattttatagtgggtgggcataataggaccacaaataagtagagtgaccctatatctcatttgctgaggacagtcctggtttatacttgttgttctggaataattgttaatagcatcccctttcactcttcaaagtgtcatactttgtatgatagaatatatacatatttagttatatacatatgattatatatatctacttatatatacttgcatatgtataagtatatataagtatatcatatttattgtatacttatatttatattattatacttgttatgtatctacatatatataatgtctacttataagtagatacgcatataatggaatatatatatatgtagtcacctacttataagggattgattaaagaatacaaggtaagtattgattccttggttattgttatttcttggaagatagatttactgtttactttgtgttttagttaaataatatatagtatatactgactaataaatatggttttatacatttctggtgtttttcctgtagatgatctcaatgccacccaccaacactgtgttttggccggttcacaacctcggtttagttccacccaccgagtggcagaggtaagtgtaaataaaaatgtgattcacacctaattggatgtgacagaagtggttgaatgagcaatttactatagagctttggaagagtatttgatgggaaaattgcttccatctaacttgactttcgtctctgtttacttgctttttgagctttggattgtgttggatacagttttagaaagcatattcatgccatgggataagtgtgttttgcttcttggggttatgtttcttggagaaggaaaatgccgttgacaagtgtttatagttagaggtttatttagagggttgtatctgtcaaggtcaagggcaggagatgaccagaagaattggggcagatttttatgcttgtgcatgtgttagctgtggctgggttcagatgttgagaattttcatttcccttaactttttggtcagacttctgggcatgtgaatgtaaagagaaagttacagggttgccaaggagtttctgagctccacagttgtgttcataacccagactttattgctaaattctgccaccacttgcaatggcccatggttagctgttcagactagttcagaatggaaaactaagaaatgagaaaaactcatattagtcatgttggggtcccatgtactcagttaagaggggttccagagagcaaggcatgaaagggattacaagtgaccttctacctaagcttgctatccatgctttgctttatagcttgacctttcatggaactacaggggacaagtgtgagaaaattgggcggaagtggtacaacaaagtgagaggtacaggtgcaaggtcttccagtggcagtactgcgtgagtctatacggcagtgttgtgtcttttggtcattaagtagctttaccagtggaacgatcatattgctgtgtggcagagagagaatgaatgagtatttaaaccaagatgccagcaagcccatccagcacctctttcttcctttctcccctttcttctcttttccattcactcattcatttaaatatttgagtgcctgttatgtgtccaaaactgtaggcctgggagatagagccgtcaacatgcccatgatgcccaccacttttgtgaactttagttgggggggacaaattttaaacaaataaacacagaaataattgtcttagagacctaaagggagttctgttagaaaagagggaagcgagggaggaaggtaggtaaggacgaacagaggaagaaaagaagggagggagggaggaaggaagagagggagggaggaagggaggagcaagtatttatagagcatctaatatgtgccttgtattatacacaaggatttcatttccccagttataggcatctgtctttctagctataaccctcctaagaatccctttcttgtggatcacttgagtatatggctacttaagtgcgcccttctacgtctttcctaatctaatccagaagagtggacagtctcattagtgctgggttcaaagggctgtacaaaatgataaataaaaagcttgggaaatatgttcatggggataagaatcgtacctaatcgtagtgttcttatgaggattaaattagttaatacatgtaagtctttttagaacagtgactggtatacattcaaagaagtttgccactactattattaaattacttctactgctactactgtcttttcattttattctgttgaaaaactaataggagatgggaacaactaaagttcactgtgtggaaggttattctgtcttcatttgtacactacagtgtacataataaagcaagagagattaaatcatcagcaagttttgattgtaggaactactattcagaagggatttcagtttgttctctcttcaaacttttattgaactttatagtgttcaaggtattcttgtagggacttgtgaacaggaatggttatattcagtgtcttcaagatgcttatggtctaaagagtatgtacagtgcagaatagaatgtagcagatagcccggctaaattttgtatttttaatggagatggggctttgccatattggccaggctggtcttgaactcctgacctcagtcgatccacccacctcggcctcccaaagtgctgggattacaggcgtgagccaatgctcccggcctagattttagtttttgataattgtgtcagaatattcttgggattcaatacagaatgtctttttaaagaaatttacattttatgaataattatattttgaataggtagttaatgcaaatggttcaaaattaaaaaaaatacctaaaggtatacagttaaagtctctttctcctcaggccaaccagcccctcattcccagaggcaaccaatgtttaaaggttcttgttactcttttggtgatatttaatatataagtaaaaatgtatgtaatttcaaaaatatttttaaatataaatggtagcctactatatatatggttctgtagttttgtttcagtaaactttggtaataattactcatcaatatatagcacttagcgaggagtaggtaatggctttttagatatgacatcaaaagcataaacaactgaagaaaaaaacagataaattggccttcatcaaagttaaaaacttttgtacttcaaagggtaccataaagaaagtgtagaggacccatggaatgggagaaaatatctgcaaatcatatatctcataaagcacttgtgtctcaaatattccaagaattcttagaactcaataattcaaaagagaaatgatccaatttaaaatggcaaaggaatcgaattaacatgtcacaggctgggtgcagtggctcatgcctgtaatcccagcactttaggaggccgaggtgagtggatcacttgaggccaggagttcaagaccagcctggccaacatggtaaaaccccgtctttactaaaaattcaaaaattagccaggtgtggtgccacatgcctgtaatcccagctattcagcaggctgaggcaggagaatcgcttaaacctgggaggtggaggttgcagtgaggcaagattgcaccactgcactccagcctgagcaatagagcaagactccgtcttcacacacacacaaaaagaaggtatacaaatggccaatagacaaatgaaaaatgctgaacgtcattagtcactagggaaatacaaatcaaaaccacgacgggataacatttcacactcactaggatagctagaataaaaaagacagtgacaagtgttggtgaggacatgcaggaagtggcacccatgtgcactgccagagggaatggacagtggtgcagccactttgggaaacagtctggcacatcttcagaaggttaaatccaaaggtaccctatgacacagcaattccatgcctaggtagtttcccaagagtgatggaaacttctacaggaatgttcataatcaccaaaaagtggaaacaacccaaaggttcatcacttaatgaatggataaataaaacgtggcatatccatacagttgaatattattgggcattgaaatggaatacagtaatgatgcatgctacaacatgaataactcttgaaaacatacgaaatggaagcaaccagtcacaaaagatacatattatataattcatttatatgaagtgtctagaataggtctctctatggacatagaaagtagattagtggttgcctagggttggaaatgttggtagaaatcagttggggttgggggtgactgccaaatggcacagggtttctttttggggtgatgaaaatgctctaaaattaattgtagtgatatttgtataactctgtgactatacgaaacaacattgcattatatgctttaaatgcttgaattttatgacgtgaattatagctcaataaagctgttaccaaaaaaaaaaaacctatctcaaactaggcctgattatagattatttacataaaacaaaacactatacatccagaaaaaaattattccacatcccacccctctctctttttgttttctgcaaccatacgtcattaaactagttttcctattgttaagaaatttaggttgtttctaatcttgcatgaaaatgcaattaataacctatgtagctcactccatacttgggaaagtaaaggtgcaagtagggaaactttctagatagaagtcattttaaaaagatgttgtaggctgggtgcagtggctcatgcctgtaatcccagcactttgggaggctgaggggggtggatcacttgaggtcaggagttcgagaccagcctgtccaatatggtaaaaccagtctctactaaaaatacaaaaattagctgggcgtggtggtgcacatctttaatcccagctacttgggaggctgaggcaggagaattgcttgagcctaggaggcagaggttgcggtgagccaagatcatgccacgccactgtactctggtctgggccagagagtgagaccccgtctcaaaaaaaaaaagtgttgttgtagaggttgctgtgggacaaaaatgagtggtcattcacctttattctttgtggggttttttttggcaggaaattggagctgcctgcccttatgcacccagcactctgggatcttcatattaaaatacattttagtcaagcttctgtttcttggcacagaaactttgtttttcccaggcttgttgatgtcgcattgtataaaatggcagtaaatgtgcaaggaaattttatatcagaggattagccttcaaggttatttacaagggctcagtttaaattataaataataaaaccaaaatattttagggatacattttcctcattgggactgaagggtatttatagctgactttttattattctaggaaatcattttaatatcaaaacaggcagatgcactgcccatgtgcattggcctcttttccaacatatgatcatttataaaaaggagtttgtccatttgacctctgttttgctcccacggactcagagagggatgaactagttatctgtgtccttgctgaggcccaggtactaagttatgcctttgaatgtgccttgagggcttaagccaaatattctccattatttgaagaatctattctgccaaggactgccactgcctagtgtatgctttttgcagaaaagagaaatgagttctttgccttgtgattataactgcatttttccccgctgtcattatagaaccatttattgtgcttttgaaccagctttgcagcctggttacctttctttcctatctttagtctcagggcatttgagataaaaagtcagtgtccttgacttcttggttaaccagttattcatccaataattatttattaaatttcttccagttttcagactcagttctagatgttgtagtatatatagaaaatgtatttaacatatataaatagggcgttagcctccgggacccaaatgtttagttagagatatgaggcccacgtaaaagaaaaccagcaaactaagtggcccaagtgaggccaaactggcagcacagagcccagtggaacaggccactctagtaattcttgagttcgtgagtataggccgggcacagtgactcacacctgtaatcccagcacttttggaggctgaagtgggaggactgcctgaacccaggagtttgagaccagcttggataatatagcaagatcctgtctctctctacaaaataaaaatttagaaaaattagctgggcagagtagtgcctgcctgtggtaccagctattcaggaaggtgaggtgggaggattgcatgagccccagaggttgaggctgcagtgaaacattattacaccactatactccagcttgggtgacacagcaagaccctatctcaaaattaaaaaaaaaaaaaaaaaaaaaaggagtatagactgagccatggggcaacaggtgaattcacagccagggacaaatatgaacaatcctaggaaggatggtagagtaaacttagattttgcccataattgtgattgctggttctgtctcaacagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtaaggactttctttttttttttttgagatggagtctcgctctgtcacccaggctggagtgcagcggcatgacctcggctcactacaacctccatctcccaggttcaagtgatcctcctgtctcaagctcccgaataggtgggactacaggtgcatgcgccaccactcctggctgattttgatatttttagtagagacgaggtttcaccacgttggccaggctggtctcgaactcctgacctcaagtgatctgcccgcctcagcctcctgaagtgctgggattacagtcatgagccactgtgcctggcaagactttcaagaattgtgaaagatctgagattctaccctacttgcaagctaacaagttaatctgccacaatttcatattgttataagacgtgagactcttaggtcacagatggaggacaggttattacgtatatcaatagcagtcaccagagtctccgtatttttgtgttagttcacgaacttattctgttcaggctgcagtaacaaaattgcataaaccaagttgcttctaaacaacagaaatttatcctcactgttctggaaggtagcaagttcaagatcagatggcatcaagttcaagatttgatgtctgctgaagacttgtttcgtgattcatagatggcaccctctcactttccttagacggtgcaagggccaggcaagctccctgtggtctcttttataaggctactaaagtcttttatgaaagcagagcttcgtgatctctcacctctgaaaagccccacctcttaatgccattgcctcggatgttaggatttcaacataagaattttggagggacatggccgggtgtggtggctcacgcctataatcccagcactttgggaggctgaggcaggcggatcacgatcaaaagatcgagaccatcctggctaacacagtgaaaccccgtctctactaaaaaaaaaaaaaaaaaaaaaaaaaatacaaaaaattagctgggcatggtggcgggtgcctgtagtaccagttactcgggaggctgaagcaggagaatggcatgaacctgcgaggcggagcttgcagtgagccaagatcgcgtgactgcactccagcctgggcaacagagtgagactccgtctcaaaataaataaataaataaataaataaataaaaataaaataaaaaagaattttggagggacatacacatacagaccatagcattctcccagcttctgtttctatagggcaatgcaaaggaggctagataacatgtacatattgaggagttacattataggagaggaaccatgagctatgggaacctagtctttttcaaaggatagtaagcatgcctgtcttttgctgtaggtcaagacactgtcttcatcttccaagcctatatgcacacctgccctttgttctagagggagaaactctctctgtcaaggttgttgctatgtaaacatccttgcaatgagagtctgtaacacaggacagtcattgcttactcacaagacacgcagaagcacaagagactcatgaagaatagtctcccagcaaagactgctgggaattgagggtaggccctgggagcaagtgtcactgccttgcttttcactgatgaaatcagttgcaattctgcagtctgtgagaccagcaggtctggatcccatgggtcaaagtttcgcaaactctacttttcccactaataccctctcaatatttgctttatctttggactacatacattgtttagttacttaatattttactttaaatcaactcttttttaacatgtatacatttctttaaaaagggagctttatattgctactttaagtggaaatccagtatcattagccaaaagaaaaagtatccagaaaaatagatccaatgaaaacagagtaatgttattacattccagcagatattcttgtctggaggaggctctgagcctcaagtttcctttcttcatgttaagaagggagattagtggtaatggttgcacagctttatacattttctaataattattggattctgcacttacaatgtgtgaattttatggctgataaattatacctcaaaaaaaaccattaaaagaaaaaaaggagacactaaaatgtggttgagaactgaagttcattcaccaatctgagactttctttttgatataataagaaggattgatggggaatttggagttaaaaaatgttctcatgcatcctttctataattaattactgagcacgtgccagacactcttctgggcgctttagaatatattggtaaataaaatagacattctagtacagggagatgatggtaagtaatacacttaacacactggtaaattatacagtatgttagaagttgataagtgctacaggaaaaaaaaaaaaaaacagagcaagatgatagaaattgagagaactagagagcctccctgttgaaaagatgtcctttgagcagagaattgaaggacatgagaaacagccatgtggatatctggggaattgcattttgggcataaggagcagccactgcaaaggctgtgtggtgggggaatgcctggagtccgtggaacagtccaggaacagtatgtttgagtgaagggagtaaggctgctacttgtaggagaagaggtcatagaggtagttccatgagactggggagcagcagattgtataggtccttggaggcccttgtaaggacaaggcctttcctttttactctgcaggaaatggggacccattgaagagttttgagcaaaaggagaaataatgtcgtctcccatggcaacatataatatcttttcaatgcctttataagttatttaatatcttgtgagctgctccacactttgtgaaacattgtcataatctccagaaccacaggggaagcaattctgcctttcaggggagtagtaaccacttttgatgctgagctcaagtctgacttgctgcccttcattgtgcctgatgggtgttctactttctctcttattagtccctgctggagacattgctgatagccagaacttcaggaaagaatacatttatgggcctgatgacctccctgaattagagcaaagttatgtctttctccatatttatagtatagaaattctaatctcaaaatgtagttatttccttcgcaaaaaatctcacaattttcagtgtcagactagcagaatgggtgctttctttaacatgcatatgggctgttgtatttccctatcctttctcatctcttgtgactgactgtgatgttttttaccatcaatggatgggagaaatctgtaaaatcacactgtgtatataacagaatatcgtcatctaagtctgtctgcttcaggctgggtgcggtggctcacgcgtgtaatcccagcactttgggaggccgaggcggtggatcacctgaggtcaggagttcgagaccagcctggccaacatggtgaaaccccgtttctactaaaaatacaaaaagttagccaggtgtggtggcgggcgcctgtaatcccagctacttgggaggctgaggcaggagaatcgcttgaacccgggaggcagaagttgcagtgagccgagattgtgccattgcactccagcctgggcaacaagggcgaaactctatctcaaaaaaaaaaaaacaaaaaaaaaaaaacaaatttgtctgcttcagaaagtgactggctgcttttgatattatgtgttagggaggtggggcagagatgtactgtatcagaaacctcggccccctggggttgaatagagagattgatcttgaatttaaatagcgtgtgtgccagtcttcaccatccccccaatctctgattcttcaaggtcatctccttactttcacaattaattccatatgtcagggcacattgtcagatattgttcttttgccatacaagttggcctgggatttagcagttgcatgctcgctctctactttgtcctgttgttcaatgaaagcccacgtgtctgtaagagttctcccagtttctttcttgcttgcctctttctgcaaggccatgtgtcttttctggacaaatcacaggatgaagcccttggttttacatactgcaagctctcagtctgtgtgggttgaaaagtggtttgttttccttgtctaggatggtttctaactaagcagtttcggaagtttgggcatatgttttggagtaccttatgggagatagtttttccaatttaagatgcttaggaaaggttcttgtttaattataagcagaatcttcttccatgttattaaatggcccactttcctttttaaagatagtaaaatgtggaattcagcctcttctcttagtaaatgtcccctagaagaatggaatgtttgatggtattgtttggctctcattttcttctgatcagacctgtggcttccttataactactgcaaaagggccttcatagggtatctctttgtaggcagagccttaccatgtcttcctggtctaatttctttctcagtgaagtaacttctttccgttattacagtgagacattaatcccaaggggcgcagtcacacatctcataagggagctctatggctgacttgggaccaaatcaagagcctaaataaacttggtagaagaaaagtaggtgacgtttgctgacccgttggaatgatggatatgatttacaactatatggtgataaagtggctcagaaatattcttttgaagtcttattagctttgctctccaatgcctaagtgcccaatgactgaagtccagatatgtgggttgattccatttctttctcctcttctaggcttatttccattaagtgcatgttcaaaatcagggagtttggtttgtaagtatcatgaaaactttgagagaaccctgagagctcctgcaggttgtttccctgctattgaggtcttcagggatgtgtcacccgtggaatgttccttggccccaagtcagcatttgtcctcctgacggcttgcctcttatttctgctgtgttagctatgagcatcctttggcggcctacaactctggagaagggaggaagacccaactcctgtcatggttaccacttcatcagtcagtcaatatggttagacattgatgtttgtttggttttttagccccaaagtaataaggactcactgtattttgcgttctgactctttggttttgtgcagtgtccatgctgtagctttccttcctaatttccagagtttattacctcagactctgaatcaagcaggtggagattttttttgccttcttaattaagtttaaggagagagtcagctacttctttctcttggcagtggggaaactggtaaacgtggcatttgattaaaatcctgtaatagtttttacccacaacattgaaatgaaaaagtcaggtcatggagttgaatagaaggcatgccagtggacttgatgtccagagattgtatctcatgggcagtacttcaactcatgaataaaattgtgttgggagaaggtcttcagtgctgttgaacgtttctgactggcattagtgggaaagggtgggcatgaattgacaaggacattaaaacttttcctggtcagaaaattggtaagattgtgagatgcttgaggacaggaagtccaaagccttgtggtcttgtttagtatgcattcttgacatctagcaagtgcctaacagatagtaggcagtaattgtttctgtcttacagatgacatagctattctgtagtggtacccacttttgaactgactccagaacccatattccttttttcttttagagacatggcctcactgtgttgcccagactggagtttagtggcgcgatcatggctcactgcagcctggacctcctggctcaagtgatcctcctgcctcagccatctaagtagctgggagcacaggcgcgtgccaccacaaccatctaactttgtttatttgtttattttgtagagatgaggtctcactatgttgcccaggctagtttcaaactcctgggctcaagtgattctcctgccatggcctcttaaagtgctgggattataggtcagagcccttatttttaaccatgatactatctgcctcaaaacatggttgggcatccaagggaagatgaaggcattatttattaaaatagccagggctctctctttgctctcttgtccaatagcagagcccctagatatagccttctccttgcttccaagttttaatttactgaaatccagtttctagtgtaccctgatagactggataaactaattacatatgataatctatttccagagtcaccatggttggcgagccttatccattctgtcctcttcaacaggcataaccagcccaaagactggaaaatcttttaaaccttttcaactctttctaacatagggcttgatgttttgctaacaggctctttccatagtgtgaacaaattttatgtgaaatccatcaaaaagaactcatttttttcttgaagtaagtatgttgttaaaccagtatcttcacagaagttgaaccacacttgtattaattcttctttcaaagtactcaaggttacatctgttaaccactgtcttttaatagcacagataagttttagcaactgttgttttaatattgtctacattccttttttgttttgttttgttttgtttaaacaactttaactgaaatcagtcctacatagcaaacaaacatttagttaatgtaaactaaaaccttttcatacaacttggtattctcaggttacttatttgagccatttccaccatcgttaaatcttcacaagttgcttttgtttgcctcatgaaagttcaatatggataaacacacaaaaaaattctttgcggtaacaggtgaagattataatagctccatgtctatatatggaacatgatcaccttagcaaagccagacaatccagcctgaagctgtggtggctccacgtttctttagcgggcagtggtaaaaagagtatttaagatcggtagcattgtaccttgattttcaagttgatgaatgatagaagacttagaaaatggatagaaaacaattttatatatttccataggttaactcagcctctcatctaaatatgttgggattattttagttgcaaggggcaaaacgttcaacctgaactagcttaagtaagaacagcttcaggaatagttcgatcaagggtcagttgatgtcatcaggatgtggtttttgtcttttcatcttgcagctacccctactatgttggctccattcttcccattgctggcaaaatagctgcagagtcttcttcctgtagtttctgatagtcttgagactcattctgatgggacatattcctattcctctcaatcctagttctgtgactagagaatctagtgggctgattggcttagacctgggttgcatattccacccctggcattggagctggagcctcctcagaccacatgggctgtttgggggaagggatgggtgggatttgtctggaataggaggactgccaaggtggcaaacagttgaagtttaccatagtagattcatcggaaggaaagtcaagttacttgagtatttctgatctgaaaatctgaaatctgaggtgctccaatattcaaggctttttgagcataaacatgatgctcaaaggaaatgtttattggagcatttcagattttggatttgaaatgcttggccaataagtatataacacaaatattctaaaatcagaaatacttttggtctcaagcatttcagataagagatattcagcttgtactaatatgattgctactcttgtttttaacctattgtcacctgccctgagttgacaagtgacaatttgaatggctttgtcggtttaatgtatgcctccataattagttttatatatataggttaagattatcaccagctcctcctggcccatgggtaagttattttaatttattgtaatttaagaaacttataattaatatttcctaatatatattggtgttttgcttgtaataccagccttaaataaagacatttaataaaaacgtattcagtttatgcctttcccatcaaacatagtacagcctgctttataattaggatctcagtatttgttgttgattgacttatagtttcctcacatctgactaataaatgtgtttgaaaacccctctctggcgtgagctgggttgtgtaagagaatttcagctttttaattgttttattttattttattttgacacagagactcttgctctgttgcccaggctggaatgcagtggcacaattatagctcactgcagcctcaaactcctaggctcagggaatcctcttgcctcagcctcccaagcagccaggacgaccagcacacaccactgccaatttatttttaaaaataaaaataaattggccaatttattattaaaaataaaaataaattggccaatttattagtagcttggccaatttatttttaattgttttattagtagcttggccaatttatttttaattgttttgtagagacagcatcttgcaatgttgcccaggctgggcttaaactcctggcctcaagagatcctcacgtctcagcctgccaatctattaggattataggcatgaaccaacacgtctggccagacctcagttttaagactactcttttcttagctttgcagatatgctctggagatgccagcttacactgggaactggttaggctgacctttctcaccttttctcatcctatggccatcaagttactggaggagaattaagagacgaagtcattgtcctcgcttgtctatcacaagggtattaaaaccaccatcttctctttatggtccacaggtcgagtttgagtggctgaggcagttttggtttcaaggcaatcgatacagaaagtgcactgactggtggtgtcaacccatggctcaactggaagcactgtggaagaagatggagggtgtggtaagtccatcagacctgggaccgtgttttctgggctgctgtgttatacaaatcctccactgcctcatttgcttaggcaaatgtagatttaattattcctaattatcaagttagattcttcttggtaaggtgatgggtatagccaggattttgtcagtacaacctcagtttagttcaataagcatttattgagtattttctcctcatagggcatgtgctggacatatactatgaagtggtgataagaggataacaattcgaaaataatatttaacattcatttgcatttttatatgcatcaggtgctactctgttttctcagtattaactttaaaaaatttttacagcaatgctaagaggtatagaaacttttccaggccttaatttgtggatgtgaaaactgaggggcagggaaatgaagggcctcccccagggtcactgagtaagtggcacagcaaggtggaaactcaggcaggctggctccacagcttatgctctcaaccactgtgtcccaacagttgaacaaggagaggggcacgaatatcaccaggtatgacattagctaaattgaaatctggtaatagatgtgaaacgttaaaagaaaatcatagttccagaggagggagtattacattcagaccacttgagccggctgggatggtggtgaaatggcagatgtggtttttggggcccttggatgctgaggagtatgatgggatgggggatctggggaagaacattagaatccagaaactaaaaacaaggccagaagtcaggtgtgaccagagcaagtagtgcagatgatgtgggaggaaatgtagctggaaggcaggttgaagccacatggaggtcttgcattaagtcttaatttaaataatagtaataataataataataacaaacacttacataatacttattaagtaccagacattattctaggtgttttctgtaaaacttctttaacttttatgacaacccacaacataggtgtaatatattccccatttttctaacgaggagaccaaaacacaaagggtttgtgtaacttcctcgaggtcacccagctaataggtgagggagctggaatctgaactctagaaggctgcctctggggtccttgcccttcaccacctcactgttctgccttcaaacaattggatttggaatgtagtagaaaagtggtaaaagcctgcaaactctggagatagtacctctgcacagaatttgaaatgtactggaaacaatgaactaatctgcaaaaatggatagctattgctaatccctattttatttttttaaagccattttattggggtatgattgccctacaaaaagctgtacgtatttaatgtgtacaacctgagtttagagatacatgtaccttcatgaaaccatcacagcagtctatgccataaacctatccatcacctccaaaagttttcttctgtcttatttattataattattattattgtgataagaacacttaacataggatctaccctaattcctactttataataatgaaaatgtcaagtcacaactttgaaggccccagtttaaaagtctggatcagaatccaaaagtccttgctttccagacatctcaaatctttaaatcataccttttcatggatatacgtctggggaaggaatgttataatccttttaatgtattaatagtatcacaaaaattgatttctccaaagacctgaatcgatgcaaaactgagcattgtgaaactgaattggagttaatgaaaagtctgtgcctaaatctccttagtcagttctgttcctaaactaagcctgttatgagtactctccatttttatgggctgcttatataaaggcagcttcaatttcagggcaacattttttccccctactgtgtaattctgattttgtccatttacatatgagttagaacctcttaacttgatgaaccttggctctaagacatcagcttgactttgaagttgtaatttgacaactctgtgaattagagttgaagagcaaataagaaaggagctcttattgatttttttttttttttgagacggagtcttgctctgttgcccaggctggagtgcgatggcgcgatctcagctcactgcaacctccgcctcccgagttcaagtgattctcctgcctcagcctccctagtagctgggataacaggggcccgccaccatgcctggctaattttggtattttttagtagagatggggtttcaccatgttggccaggctggtctccaactcctgacctcaggtgatccacctgcctcagcctcccagagtgttgggattacaggcgtgaaccaccatgcctagcccttgattttgttttttaaaaaccaaattaaaaaaaaattgtttttgttcaagagcttttttttttttattttttttaagtaaaatctggcccagcatggtggctaatgcctgtcttctcagcactttgggaagccaagttgggaggattgcttgatcccaggagtttgagactagcctgggcaacatagtgagactttgtctctactaaattaaaaaaaattatccatgtgtggtggtgcatgtctatggtctgagctacttgggaagctgaggtgggaggatcattggagcccaggagttcaaggctacagtgagctgtgatcgcgttactgcactctagcctgggtgacagagtgagaccttgtctcacgtacacacacacaaataaaaaataaaatatttggtattgtgagcttacaagtgatattcattatgaattcatttaaggaatttagttatatctatgtaaatttgtgtataaataatttgaaggtggtggcacatgcgttaagaggaaatatctgttatttgttttgtcgctcttgtataaaaaatactaaaaggaaaagcaattctgcgaactctctggtgctggtttcccagaagttggcgtgtcatttctaagtgttctgagggagatcagtggcctcagtgtctctcctcagcgtgtcttgggatgatctttatcagcagagtgaagatttaggtccagataaaagggatgtttcttccaaattaaatgtaagcattgcttcaagccttttacagtgactttttacaaattcatagtgatttcttttttctattggacaagacagaacagaataattgttggatgaatctacggttctgtggttctgttcgtttagtaccatctggtatttgtatactcgggtggaattggcagtggctggttagatttctacttggtaccagcccacctcatattttctcagttgcaagcagtagggggcaatgttgagctaccagattgaggccccaagatgttagcctttcaggaaaacgcatacaaaaataccattaactgtcaagaattatccctgttgcttcaagttagctgtaatctccaagattccatagcacaggatatcagttgtgggttaacaaattcaacagcaatttaacataaaaagtacagtgtttggtgcacatttggattctatagcattagactaatccaaatggaatttctgagtgtcctcactttgcttccagggactatcttactcaaaattattatcattttagacaaatgattcttttttatctttatacttttttttgaattgtaaaatcgtgcgtgttgtggaaggatttctttaaatcaatgcattttgtctgttctgcaaaataacatcgatctcttttgctgagaaaataaaaaacctcagggaatatgtgcattacttttccccttttgcttatgagtaaagcaacctttatcggccctcgtaccagggaagagacttgcgctgtgatttctgtctttgtgctcttttttcactttgtggctgcaaggtgtagtctcaggaaggatatagaagaatggaaaatgagctttgaaatcgcttttcttccattaatggtaattgcttcacatgtcataaccagtcacatatttcaaaaagtttagtcagctgtctctaaaactcccccatcctccacttcccatttcctgtcccagaaaacaccatttttatcacactgtttattcttgccattttttctcccagcggatagttttactccatccatgctcttgtgatgtaaatgttaaaccttatatttgaatgacattctgataaaatatcacattttccctgaatattacctcatgaatttatgagccattaagcccaaagcaacataaccctttcttataacccaggaatttagtctggcctttcccctcctctttgctccctattgaggatggcattataacactataatactattcaaatatttgttttttattttaatttttttaaaacccgatgcacttcctacccccaccgcccctgccatccaagatgattgtattatgagaagactcttcaggataagagagagttaccatttgaaagaaactgtacagctgctttgctttctgggtaaagagaaatatgaaaagctgaagtctcctgtgaggtgggcaagtcttgctgtagccagagattcaatggataggccatttgtctctcagggtctggtatcgctctttgcaaaactgacatttattttacctataaaaatgttttaacactatcaaattcacaatgatacagaaaagaatgctaggtgcgaaatcctctaaattgatgacatttattcatttcctattgaccttaaaaaaaaaaaaggtcaatttggtataatccagtggaaatattcgacaatcgtttccagagtaaacattttcgaaagtagtgatgatttcgatactggagagaaattcttcttgctgttttccttggttttttcttttagaataaaaagtagatcctgatggttttgaatgttttgaattgcgtttcctgttctgacaattccttgtgctgttatagcaatgcatttatatggcagttggccttaataacctttattgactttagtgggtaggagccaagactggattattttaatgtatccgtttggaaacagtgtaaaacacaacatataattatgttaggtaagctataggctacatttaattctatccatttatgttaaaatttggcacaggagagcagagacatgtggaaaatgagtaggtgttttatttaataatgtaaccagtttcttgttgttaaagttttaagagagaaatgtacttaagaaggtaaaggttgtgcctgacaagttagttataatagtttaattttaagatgagtcatgccttttcccctgctattttggcctatgtaaatcatctgggaaggcccttgccaggagcctgcccatggctgtgtggatgagtcttcctcagcataggttacacttcatgtagtttacatagtcatagggaatgactgagccgagcagtagtttgtttatttttggagagattaatgaagttctcatcacagtgctttagattaaattctttaaaactgaatacaggaacaaggctgctttttcatttactgaaatttttactgagtatactggtatttgctattgtattatagttcaattagctaagtttattttaaacttccttctaggattgaagatttttggggatgtgcagaagaaagtgatggaaatataaatatcgaatttttttgtttgcattaatgggaaagtcaccaatttttgtgtgtgtgtgtgtgtataatttttttcacccttcttttcagtgttaatgtgcacattaagttacatcagccaacataatccagtctcccatttttcagggttagcatttctgatttaagagcagagtatattatagtaatttaggatcagatgtgagatgtctagtggttttaaattaaaatgtaaattctcttttttgactggggcagtgctgagtgactcaagataagcacagattagaggtggataaagagtcataagcatccaaaaattcagtttctgaaactggtgtgcaggcactgagttttaggacctttacgtttagctttgaaaatctggaaaaacgaaaaagtcacttgcagctggagcagcttaaaatctttggtttaaatctttggtttttggttatcttaaaggtgttcagggaagctcggttctttccattctccttcctacccacccactctaattccccacccactccaattccccacagctatattgttctattaaaagtaaaacatctggggagaaattttacatgtaatttagcagtgaatttcttataagtttttattccttttttgattatcttatgaatttcagagttttccatttttttccctgagtgtctgtacctttagtaaggaattttacaagaaagtgttgtgtatcctgtctttttgggaaaaaagaatatacaattccaagagaattcaggcttaagcctcaaaaacacagtgtgcttcgaaagcacaaaggactgtgtttatgattctctttgaagtgtttttgcaactggataaggaaaattttagaaaccgtctgatagtgttcagggtaaatacttaaacccctttagagaatttcacacacagatactgtgcagcagaaaaaagggatacttatgtttcttaaagctgctacagcctacagctttgtacttaaagacagaggtgttgaatagaattctactgaggatacatccagtgacagtatctccaggaacatcagagcaaaccagtgggtaggactttctgtttttaacccttacatgagctgtgtgagagttgagctttactggtaccaagtcctaggatgtgcctggtacatctcaggaatgttaagaggatcgttcctagtgcctctgctctgcacacaataggaacaacactaaaaatgctgaagatgctgagacaaagtgacaggagctaggaaattccaagtgacagccttgccatctctcttaactcttagtgtgtggagagaaaaactggagtaaacagccagggtttgtgttttaaccttgtttctgtaggatttggctaaattttgacaaccttcgttaaatatacacacgcacatgtgcacacacacacatacacacatttcacacattctatatgtaaagaaaaaaaagatgaattctgctgctttaaatagttttaaccaccctgaaattcaaattgatgtaaaggtgtgaagatcctgctattttccctggggtgctattttagccttggctgctagaattcattttggattgctttgactagcagactatcatagcatttcagatatgaattaagaaaccctggtgcaagattggaatgtcagaaatttctctttttcctggaaaagatataacataaaacaaattatgtaacttatttcatctagggtttttttttttttgtggggagcatggtagagggattaaattcagctctagtctgttatttactttattataattacctctgaaatatcctagaagaatctcagtctagaagaatgaagtagtgtacaaaataataataataatcaccagacctacagatttgaaaggaaaacaagatttccaaaggatgtcgtgccatttatttggaatattatcaagatgttagaatctttttcccccaagttggttaatgaataatcactaaaactgttgcctcttgaaaaatattgttatgatgatccaatgagaaagtttgtaaaatataaaacatacataaatgcaaggtatcaccagtattgattttaaaaggaagcgtggagagtcttcaactgaggaatccttacttcgaggccggttgaccgagtcttccttattgacagcatccctttcctttcctaattttccttcctctggagctggggttcagtccaggagctaaagggactcacaacaatttggaactcagcgctcctcttgcaatgcgtctatccactgtgggttaaatactttgagaggctgggctgggaatctttccatattgtacagaaatgtctctatggagaaatgtactcccagtgccaaaaaatgacttacagagagccccgggaacacattaagttggcccttccgtgccttatggtaacataaccaccatcctgctccctcctcattgacatctgcaaaataatgacccttttttaaccaaagggaactgtgatctattttttttctgtattcctgaaaggatctctgtgattatttgtagatgatatttttaatagcatgttttccctaacaagttaaatgtgattgacatttttttttgcattttctttgcatgatctcagtccatctggaaccacctgtgacagtctcaattgtaaatttttccttcatatgtataaaaatctcaggcagatcatctcctacttgtttcttttaataccgctcaataaatctcctacttgtttttgattgacaaaattagctttcaactaaaaatctggagtcttcgggcactattcataattaaattttaatgttttagacatatctgcatagccatatctgcattggttataaagacttagagctggtggtagcttgagcatatatagccctcttattaaatattattaattgaaatgacaaattatgaaatatccagaattatgcgtcagatgttctttaacagatgttgggggattaagaggtttcaaattttacttgatgacataaacttttcatgcagttagcagtgacattttttaaaggatgggagtggtggcatataccaatgcttgtaatacattaatatgttcttgatactgaagtctcatgtcctggatacctgaacattgtttgggaagggtgggcagtattcagccatccagtaataaatatctcaaaggtaccaaatccaaaacccaagttttgatttctgtagtccctagtgtttcacagttcagtaatttgaactgtccagttgcccagactaaaaccttggagtcttcttgatgtatctcttgatttatcagtgaatccagttagctctactttcaaaatatactcatgacctgactacccttcactacctcctgtgctaccaccttggtaaaaactaccatcgtttataaaatagcctctcaaccagctttcctgcttctactaccctatgtccatcccagtcagaatgttcctttgagatacaagtcaggtcgtcgtttcactcccctgtttcaaacctactatcatgtttagaaatccaccttccttgcagtggcctaatgccctgcaggatctgtccattcctcgacctccatcagtgctccccctctttccctcccctaatgtctgccttactatgtctagaacatgcccagcccactcttgcccaggatttttgcatgtgccgctgcctttgtctggaatgtctgtccttctgtaatttacatgactctctccctcatttcattcagatctctgctcatgtcactttcttggagagagttgctctgaccaagcactctctcattgtagcagggccttactcttttctactgtactcttaacactttccaccaactgcaattatcctatatatccatttgttgtctgcctctacctgaaataatctccatgagggcagcagggacttggtctgttttagtcactcttatttccccagcctctagaacagcatctactgcataggaggtactcgacacatgtttgttaaaagaaagagttcacgtgaggtctgtgttctagtcctgccttttcctcccacccatgttgatcagtgtggccttaaatctttttttgggacggtcttactctgttgcctaggctagagtacagtggtgtgatcatagctcactgtagcctcaaactcctgggctcaagtgatttgcccacctcagcctcctgagttgctggaactacaagccatcatgcctgactaatttatttttatttttgcagagacaggttcttgctgtgttgaccaggctggtcttgaactcctggccttaagtcatcctctcaccttggcctcacagagtgctgggattacaggtgtgaataacagcacctggccaataaattctttttaactttatacattttcctaaaatattacctcttattacctgcttcacaggaatatttttgggttagttttattcttaaacaaacataactctcacaataataccccaaaacgtctttaacttctttttaaaaacaaaataatactgagggcacagaggacagtcttgttttatgcctctggcatttatagctgagaagattgagcaatcacaggcaaacaacttatgcaaatatggaaaatctttttttttttttaatgagaggcttaagtaggttattagtttcccagagtaccagtgttgctaaaagttagaatcatagtgttttgtcttatttgtgatcatccttcatattttagatttccctcttctggaaaaacttagtaaattgtcacaaaattaaatgacttctccaacaaagcttggactttcttgttacaaattttcaaaattatatagagaaagcagcatggactggacaggttttgggcacaggactagggaagtccctgaggagtaaactgacttcctctagacaagctgaaaactgattaaaatatttatcatcctttgggtatgcaatagcttttgatgatggaaggcatattaatattcatctttgctgcttgtctacacttcagacagatcccaggaaaggatgttcagatgaccagttttctttcctcaccaggagtccttgagaaaccagtacagcttggaaccaagaaatgccttgtgatgtggattgagcttttcctttgggggacgggaataggggaatacaaaccaggggagacctttggactggaaagctttaaaggatgactgctttcacacaggaagtcttttgctagaacaaaggaaaaagtttggttgtaattctataagcagcagaactattattgcttatctgaatacatgaagctgacttcattccttaggtaaagtcggaagattgaagccttataaaagattttgatgtgaatgccactgggggctgaagatttttcttcctccccaccaacccaccccaccactttgttgtaggagagaaatcagttgtgtttgtagccgatgctcaggtcttctgactggttctagagtgccccatctcccttttgtcctgagacagaattcgaatgcatatggcatccacatagcctggcataagtagcacagggtggccttctgggattctcaggatctgtcttttaatttttttttctttaatgtgagaaagagtctggctttattagttgagttaattaagcagtgttgttttttgtctaggttgaaatagccttgattacatttttggatgcaaataagacctctgaaagaactcgatctttatatgagcagtctgaaaaatctgaaagttaaatagaatattctcaaaaaaagggcaatgtgttaagactcttggtttccgtcttttaaatctgaaaattcagaatcctcttctcttgcatttcagtttttattattccacactactgagatattttgatgaaagctagccttaaacattggataataattatatttgaaatctattttaatatagtgacatcagaagtgctctttcttcatcccagtcatttaatcattcatctgctcctttttttttttttttttttttttttttgcagataagtgtggagttatacaaagagctaggacttatgtctcccaggttgataaggcacaaggcagtaagtaattcagaggaagaaaaaggagaagagcagattctgacagaggcctttgggaatacgaaggattttgatagatggagatgggtggagaatattcaaagatggcagaagcagggccatcgcagtgggaaaacacagacctgctcgcaaacttgattagactggatggagtttggtttgtgtgagtccagcagctagagataagattaggaagattagcaaggacctttttttctctaatgcatttctttgcaaggtatggcactttcaccccttaatgactggcttcctatcaaagtcatgggaagcaaagtgctaaacatgtgcaactaaaaataaaatgaaaaccgtttgattatcttgcacttgcaaaggttttactttgaaagcaagtcaaattcagttatttgcactactttcaagacctgtctgctttgtgagtacagcaaacaagcaacaccatacatttttagaatgagaattacaaatgagattaggtaatttttctaccaagattctttgtttttctctgataaattgaataccagcttaataattttggactttggtcagaagcaggtcttcccatgtatgaaccacttatgattctcttccttgttaggaaccctaagtgtatttcatttgatcttttgctattagagttgtggtttggaagaaatgacatcttcattgcctcttgtccaggtgacagtcttgtgaactcaatacttgcataaaaattattttgaaataaagccaaagtgtcattcatgagctatttgatttggttcaagagagtggatgtggtcttctctcacttccactgctgaaatagagtggtttctttcccacacatacctctccactccttggctaacagtcccacattagtgattgtgcactctctgctgtctctatttgccattgcacttcagcttgtcagtcacaccaattgaaagactgagtaaatgttcagaacgtaaatggccgttgttcactctggtctttcccacctttgcacataaatttctgctagaccctcatgttttccctctctatgtgatgctgttattttccaatgactggttttattacttctaaggcacaagatgttaattgttgagtgagtaataactctcagtttgttcttcaaacgtgggcttctgaaagattgcctttactttgattctgcttaggaatctagggtcttggggtaaatttagaggccactattctccttaaatgatagtgacatagagaaatgatactatgggactactgtttcattttaccaaagaaactgaagaaagtcacaccagagggtcattgctcccctagagaacaaatgggcttcaggctttttagaatgccttcttctttgatatctcattattgctcataatgccagagaaacaggtaacgtcggcatagtgatattgggcattgcttaatttctttcaaggcctgaaacatttatcctctcttctttatatattaggtattcaccctaatggtactcaaactgctaggctctgacaagctgaggtccaagtgccatggcattcaggaatgtcaatgttggaagggacctgagaggtgatcatcttctcttcctttttggaaaggaaggactcagaaggatgtaggcttttctggagggcatagagccagataatatagaaccccagatttcccagttcccagttcagtgctttctactactccctaaatatccatggctgtgcttgggatatttctctgatgcattcgccaactttcaacggtgtgccaatagcaaaataagataaactgagtgtttctctggaactttttctctaccctgtgtttggacctggcatatcaaaatgaggctctctggtgttgagatggacactgtttttgctcacccagcattcattcctccttctctggcagcatcctcatgttgccttgtggagccattttcttcattggctagagggtgaggtgcattgtcttattctggctactccatgagcatatgacctgagccagatctttcacatgagctttctcagagctgtttgcttataaatatacatacaatatcatagacacaggatgcagaattcaaaagttatcaacgtggccgggcatggtggctcattcctgtaattctagctcttagagagactgaggggcgaggatcacttcagactaagagttcaagaccagcaacatagcaagaccttgcctctacaaaaaatgcaaaagacttagccaggcgtagtggcacatgcccgtagttccagctactcgggagggtggggcaggaggatcacttgagtctaggagttggaggttacagtgagctgtggtagcaccactgtgctctagcctgggtgacagagtgagaccctgtctcttacaaaataaaaataaaaacaaagttataaaagcctatgctgtgaaaagtgtgtttctgtcccctcaatcctccagccactcattcccttcccaagaggctagcactattcttagttctttccatacctttctagggatattctagttttttttttttttttccttgagacggagtcttcctctgttgcccaggctggagtgcaatggtgcaatctaggctcattgcaacctttgcctcctgggtccaagcgattctcctgcctcagcctcccgagtcgctgggattccaggtgctcgccaccacaccaagctaatttttgtatttttagtagagacagggttttgttatgttggctagactagtctcaaactcctgacctcaagtgatctggccgcctcagcctcccaaagtgctgggattacaggcgtgagccactgtgcccagctaagatattctatgtagttacaaacgtttatgtgttttttccccacatggataacactatgtcttagagattgttccaaatttgtatgttcttttaaattactgtgtagctttttattgtatggttccataacttatgtaaccagacttctactgtctttagtcttctgcttttacaaataatattgtagtgagtatcctaatacataacgtttttcacaagtgagatctatggtaattaatacctaggagtaaaattgttggatcaaaggatgtgtgcatttttaattttaagagagatggtcaaatgccttccatagagtttgtagcagagtttatatgtgtgtgtgtgtaaatgtgtgtatttgtagatatatatactatctatatgtatgtatgtagagtttatatacatatataaatgtgtatatttacatatagattagtttatttacatatataaacatagacaatatacatatatgttatctatatacatgtgtatatgtatctatatttacatatagatatatgtatatacatatacatatatgtacatgtgtacatatgtgtccatataatgccagtttcccaacatcctcaccagtgcagtgtatcatcagacttttttgcaagaatgattggtgaaaaatggtgccccatttccatttgcatttctctcattcctgttttactgagaaagaaactaaggctcagatgtatgaaaagatttgtcaggtcataggagtagggagcaacagagctggggtttgcactgaggtgggagcaactgttctcttaattgctataataatctttacccaggctccattctgttactgcaactgaagaatcccaatacatatagcggttcccatgaggaacacccatctgtccttgactggtaaatgtgggaaggttgttctctttcaccatggacttgtgcgtcaaatcaactgatcagtctgggtgatgggtgcggttagcgtgacatgcagtgatgttattacgtggtggaactgagttccacacgggatgtaggtggccctttatgtaccctgctgagttctaggcctttgtgctataactatttttggcaatggaaggtgaagggagggctccccatccctggaaacatggcactttgcctgattttctgtttaaagttatgttcctgttggaatctgttcaggtctgagtttcagttgtcaccttctgatatgatgagcctccttggcctctcctgctcgcctcgttcttcctccacctgtcagtcttcattaggatcatttaaacactgactcattctctgctctgggccttttcctgcttggctatggaactgcaggttgaagcctttaccttgcacacatagtttgttaggtaagagttttatttcaagaagactttgcggggaactgtgatgactggggagtggttagaacaatattttctaataaagacaaggacgaaaagagatctcagcaggggaggagagctttctttgaccccttactatatttgagtgggtggacactaattctcaggagttgggggccttactagaccacatctcttgctgtgttatctcatgctatgttgtaaagtgagcatctgttgctggctgtatgacccatgtgatcagccactccatcacctttgaagtggtcaggcttagatattcttgggttaagagctttagctttcaagttaatcaaactggggtttgggccctgacttcatcattttgttgtgtatgacagtggcagtcatatggagagtctcaagtttcttcatttgtaaaatggggataataatagtatctcccttagcagatggttgtgagatttgcctgagataatacatgtagtgttttgtccattgcctggcatcttttgcatttttgctttgaatctacttcttttattcctcccgccatcctgctaatttggtgaccccttaactttcacctgagttcctgttgctccttagactctcatcttaggtttgtgcatatgtataatccatgctttccattcagttctctgttcaaaagtcacctcacagtggccctttctctttttaccatgttttatttttttcctgagagtatttatcactgtccgaaattatgttttatgtgttcacctattacctgtgctattctataagcaccttgagagcagggactctgtctcacatactgctgtgttcttggtgcctgaaacaaagtcataacacaacacatattggatgaacaagtgaagaagcaaatgtttcatgggtgtacgctctctctgaggtgcacccttttatgctagtggtgctttgtttgtgatatttgttgaatgccttgctcttccttctttttggcgtaatccatttgaaaaactcccttattttaaaagattcaataattatccattactaactgcagaaatcttatctttttcaccttctctggaatgtaatttctctgcattagactctgtcaacattagcatctatatcaaagacacttcatgcaactttttaaagacataagcaccagctccaggcatcggggttcagtagccatagctctcgatcttggctgcatatttgaaacacctaggacaatttttaaaatttttcatcagttaggtcccacctccagagatacagatttaattggtctaagctgtgggtcccatgtgattctaatgtttcaccaagttgcagtatggttcaaaacctcccaagtaatcctgacatgtgtttagggttgataattactgttcaacaggcacctgacttctcaccaagttagatttgattgaacggacgaatatatgaacagattagcgaatgaacaggaaggctccctcactttaaacgaacagagaggtattgagtgcctgctgtgtttccttcattctgtgggggactcgggagggaaacagctatgtttatgattcttatgtaaggtggaagatgatgttgataactatagtagaaacagactatgaaagcttggaagatggtaggatacatttaggtggatccgatttcaaagcttcacagtgaagcattttgagttgattcttatagaatggagagaattttaacaggaggatggacatgagaaaagagtggctatttcctatggagagaataacgtgtagagtggtagaagcaggaagatgcaggttatataaggcttctaaagtggaccagtggctgtccgttcccccaaactagcccccttctagagttccctaactgaagaagcagcaccactccacatccaggtcttcatgccagaaggagaggaatccttcttgaaacttccctctctccaccccaggtaccctgtgggagaactcttacctttgaaatacctctcaaagttgtctgcttttcatctctcctgctaccagccttcctctgggctattgcagtagcttactctatggtctcctatactcttcacacagcagccagggtaatattatcatatgcaaatctaatcatactcctctctgtgtaaactcattaatgggttccacttgctcttaggataaagactaaaatatagatgctcctcaacttacgatgggtctgtgtcctgatatacccattgaaagttgaaaatattgttaagttgaaattgcattcaatatacctaacctacccaacatcatagattagcctagagtgacttaaacatgctcagaacgcattagcctacccttggcaagatcatctaagacacagcctattttataataaagtgttggatatctcatgtaatttattgaatacagtacactgtagagtacagtattggtggtttgccctcatggtagcttggctgacggggagcacaaactctctgccacagcccagcatcgtgagagagtatgggactgtgtgtcgctaacctggccaatgatagaaatgcaaaattcaaagtatggtttctactgtgtgcatatagcttttgcaccctagtaaagttgaaaaattgtaagtcagacaaaccatcataagtcaaactgtcataagtcagggactgtctgtcctttatcctcagcccatcttttcctcctcacctttcctccaaccccttcactccctgtattcctaccacaatggccctttctcaatcagtctaatcacatcatgctcccttcttcttcagggcctttgcacacgtcatttgttcttcctggaatgtcttctctcaccaagagaggaatatatttctactcacttttaagataccagctcaattactccttcctcagtccagactcccttgatctgtctgactagatcaggtccctgcactatactttaccattactctcatgaaagccatgcttgagagctcaagctttattctggaggcactgagattctatggcagatagagtttgagagtacttacctgtttcgtgaaggtccagtgctgctagagacattaaagttgctgaagtggtttttggtcatataatttgtgaatcttattaaccatcccttgacaaagaactgagaattgttgatcatattgtaaaatagaatgtaaatggccatgcagtttctttgtatagattctccaaattattggaatatgagccaattccatgggattaatttaggtcctattatctgcaataagacatcccttgtcagattttcgttgtcaggggcaagtctaaaatgtccaaccattgcatgcaaactcgtagtaaagccattgtctagttattaacaaatgatgagcaggtgagtgaattgacaggaattattcttttgggatgttgcctctggcagaacctcagttatggcctctgtcattctcccttcctaatttcattatcttccaaatattattgacctcagatgttaagaaaggtccaggttcctgggggtcggcacatcgttccttcttttgccagatataagaaactttggggaccttggctaccagccttttcctgtcaggaaggtctggtgccatcctctttgatattgccctgtgcctgtctaggttggcagtcttgtgacaaatcagtacctgtcatggcccgtgggtactttggcacttcagagccatgcagaatgtggacagtgggtttggaattgtcattgagatgccactttcttattcttcttgtgttggtgcctagagtcacaatccggcctgaagggccaggaggttttctggcccagggtagatcccccttggcccacgtacaagaatcttcatgctgactgagttggaatctcctggtgagaagtgatttgttgtcctgatgagaatgtaaacacttgctaaagttgagtatcgtttctcatgtgagttctattatagccttctgtgtttataaacatgtcttgagcatgagggagaaatgtggtaacctttgagtccccaagaaaatgttcatttgttttctctgtgggctgaaattaagataactcagcatccttctctgagcatcccatatccctcttgcttttcctagcaggcctgggatgatgcccagtttgccatttcctaattgttccatcctcttccagtagagtctgttatcttttgaaaaagtacagttcatattcagcaggcatctaccagcggggctcaaagtccagggaagtcctcagtccagtctaacaaactgttattaaatttttttaaaggtttaaggtgtcgaacatttgagaaaacagagttgctgcccttgtgctgctcacatgtgtgttagcacatgtaacagacatatacatgaataaggcatgatgtgcagtggcaaatgagggggtagaaaatacatgttctgagggtgctgcagagaacagaagtcagattcagaaaactgggcaagactttatggaagaggagtgcctttcaattgtgccttgaaaggtgaattagattttaacaggcagagatttggtgggtgaaaaagagggacagagagccccgccttttttttttttttttttttttttttttttgagacagagccttttttttgagacagagtctcactctgtcacccaggctggagtgcagtggtgcaatcatggctcactgcagcctccgcctcccaggttcaagcgattcttctgcctcagcttcccaagtagctgggattacaggtgcccgccaccacgctcggctaatttttgtatttttggtagagacagggtttcaccatgttggccaggctggtctcgaactcctgacctcaggtgatccgcccgcattggctttccagagtgctgggattacaggtgtgagccaccacgcccagctgagagcctctttttttaaacaattttttttaagggacaggatcttgctctgtcatttagactagagtacagtggtataatcatagcttactgcagcctcgaactcctgggctcaagcgctcctcctgcctcagcctcccaaatagctggaagtatagctctaccaccacacagtctagctactatgcccggctaatttattatttgtggagatggggtctcactttgttccccaggttgggacggagcccattttagacagtacaaacaataggcacaagagggatggctctgtaacgttagtagggcatatttgcagaaaagtatgtggtgccttgtaaccagtacttccggtacctaggtggggtagaactagagaacaagtagaggggggagaatggggccagctgatgaagagctttgaatgatacacttagaaatttggcctttgttctggagacagtggttggagctggattcaaagatttttgagtaggaaagtgatccaatcgacccattcttcaaaattagaactggtagcagcattgtggatagactagagaggagaggctggaggcatggggacctgctgcaaaaattttgctgcaaaattatgaggttctgaaccagggcaataattggagggaattaaaaggggtggtaaattcagagtttttgttgattgttagtttgagactcagtcttactgtgtcacttaggctggagtgcagtggtgtgatctctgctcactgcaacctccgcctcccaggttcaagtaatcctcctgcctcagcctcccaagtagtggtattacagatgcgcaccaccatgcttggctaattttcgtaattttagtagagacgaggtttcgccatgttggccaggctagtgtcaaactcctgacctcaggggatccgcctgcctcgacgtcccaaagtgctgggattacaggtgtgagccactgcacccagcctgttttgtttttagataggtacatagaattcaccatcagtctggatgacagagctgagagatgatgaagtcacaggcaattttacaagatttcttctagtcttagttattagatggatggtgataccatttactgagctacacccaagaaggaagtttaggggcaaatgagtttgagcagccggtataccgaacatctcagaagagctgaaaataccagtttggaacttggtagagacgtcagagccaagcgtagatttgggagtttgatttatgtctgcagtaggcattcctttcatgcctatcatgtgccaggcagtgttctctcatatgttaactcaggcttgaaagcacttagcacatggcaggcatctccacagagacagtggctgagcgattggagtgagtaagagagaatgtagtttcaagagtaaaggagaacaaagtagggtgacctagtctgaaggacaggcgcagaacagtcagtggaacagccagagatagcagcgagagaggtgagaagaggaccaggagtaggtggtagaatggagtggaggaaagtcagcgaatgtaatagtgtcgaaccctgcagggaagttaagaagtggccataccgttgcattcatcatgggaagaatttcagtagaatggtaaggacaggaggacaaggtgggggaagataggtgaatctatagatgcatttgtgtcatctgatctgaggagacatttctcagaaaccattctgtgtggcactgatgtttacaggtcaacctggaggttcctgagaggaagtgcactgtagccagacatgtggtatcccagctagctttactctgttctccagaaatcagcctgtaaacattcagttgcctggtagctgactaaatacaggctaacctaaagccttaaacattttaatttgcaaaacctttgttgtattaaatcacaaatgggaggcaatttagcaatgcatctctaaaattgcactgggctctggccgtggttttgcaatttatgttgaaaacgaaaattgaactctgtggcataaaaacagattgttgattttgtgattaatttggtctctaaggccaaggaaactgttaatgctgtatatcagttataaagttgtggtagtatttgtggagcaaaatgaaaaatcaatatcgtaactacaggatagctcttttaaaatccaaggtgcattttgttgcaaattgcatggaagaaactgtcccccaaagggacaaacataccttccttatttcacaagtgtgtgtctgttgtggaaaaacagaggaaaatggttgggcattattacagtatagctgggggtactaggagaaggatcaaattgttcaatttagagtaaaacctcacttacagttacctgtgtcctaaggcaacctccaggagtaatctctaggagggttgtgagtcagaagtccagatacctgggtaacactttagcctctgctaatcacttgctggtatcagatgagcctcttcccctccctggcgtgttttgtggttttatgtgttaacttcagagatgcactgacatgcgtcagtgaaaaaggagtgtcttccattagcatcattatgaatactacaccaaaggggtttgtttatgttttccattcctagaagtgaatagacttcttttctattaagcttgtgtatttagagaggagtgtggggaaattctttcttgttttgccttttgttttgataaaagcaaatggttcccactcgccgtagaatcatcatcaacagattgcatggggaatgttgaggttggagcctcttcttaatggggattttgagaaccaggacatgacttgttcaccggttcatttctgctggccatgatgcttagatgagaagtagatctctcaacatccaggcacatttgttctgcgattccacctaccattttcctgggtagtgctgggattaattaagtctgatacgccatccagttgaaatttactaccagcttcttagcctagtatatattatccttacaagtcaggcctcaccttgaggtcagaagaagatgcagcttgttcaagaaagaagtgttagtggaaatacgaagagttccttccagtgaactgtgcctcaagtggcctttgtaaactgcttctgttctgtgtgacttataattatctgagagctgggggttttgtggtagattttctttgatgtatgggcagtggtggtaatttgtttctttcttcccccttctattttgctttgcctcatttcaacttaagcaatgaattgtgtggtcttttataatatagagattagtgtagccatttttagccagtttttatcatctcccttaggagctgactctatgcaaaagaaacacttctgtcttgtcagaatgacggtgattaccccacagtttggatcatctccagcagctttgttccctgaaaagcgaatttgatttgatgaataaaagtttggtgtatttgatgagtcagagggcaggagaatgtccttgtctctgatgaggctcttacagtcagacacattgaacatcagggataaaataaaccttaatctctgaaggaaaaaccctggagcatgaaactgttcccactagaaatgctgtaaatcttgcaaaccatgtaggttttctgttgggggcaacatcaaagcccagtgactttagagattaaagtgtatttgacaagcaaaactttccctgtgccttgctctttatgagatttggcctgtctcttgcctttgtttcacctcgctatgacttcctttcttcctgagaagtaggaagtatcacctcaagtctggggtaggcggccatggtttgttcatttaaagccactcgtagacctggcgcagtggctcatgcctgtaatcctagcactttgggagtctgaggtgggtggatcacctgaggtcaggagttcaagaccagcttggccaacatggtgaaaccctatctctactaaaaatacaaaaattagctgggtgtggtggcgcatgcctgtaatcccagctacccaggaggctgaggcaggagaattgctggaaccctgggggcggaggctgctgtgagccgagaccacaccactgcactccggcttgggcggcagagtgaggctctgtctcaaaaaaagaaaaaaaaaaaaaaaagctggtcataggccctggccacagtccctcggccttctcgcattgtcctgccccagtggaggacagcgtcttctcacgatcacttcccagggactctcttatttgtggaagagtttcagagccttttgctgactcgaagaagatcaaaagacaggaagacagtggtttgcctcagcttggactttagcatttctgtttcttttaaaaccatctcctgtgatgtcttagaagaaatacttcttctttctttcttttttctttttttttttgtcctgtttcaaattctgtttcggagttctcagtgctttctctttcacacattggaaataaatgactgcatttttgttgaaataattttttttttgcagataaataattgtttaacagaatagaaacttttcttcagtaacgtctttttttggaaagtaagttacaagattttgctttaaaaatacaaactatttttaaagaattgtactctctaaagtcaaacattcctgcctcctgtcaagtccctataagatctggtctgtggcaacttctcagggtggtcagatagcaagaggaggacagattgggaaggcaaaatggctttaagggtaaaccccacagcgtaaaatctcattactggaaaagcgctttgtgtttaaggataggtattcccgtgtggaaggacggccatggcgaatgcttaagggactcactaaaatatcttaaattgtctccgttaaacatgtagcatccttagaggtcagacagagctgaaacttgaacagctgtacaacaagcatctgagattgtttttaattgtgtttcctttctctaacagcagtaattcttgtttatattgtcaagaacctttccactgagcacaagcgcaccatacttgaaggtcaaatgcttaacccttctgcatggttacaatgaaaatggacccttttgttttcattaatgtataccccagccatgtctacagggagaatgggggccccaagcgttcaccaagctgaagcaacttattgtaaaagagccacaaagagagcatatttttgtttccatacaacagttgtttagcttttgccttgtgcacccaaccataagacggtatgcttacttatcaatgggcagaattttgggggaccattttgttcctttgacctgtgttactttttactgacccaaccaaattgcttaaaaattttccctttctgctgtcagtgtttaaagctgcttaatgtctctgaagtgatcccttctttctttttaacactttacattcctgtttatcacagcacctgttactatagtgaaccatgaaatcacaaatgctatgcagctcttattgaccaataatactttattaaatataaatagagtatcctcccagcttctgtatggtgtataaaggtctcagtatatgaagacaaatgcacatatgtccataggtgcacatgtattgtttggtgggcaacaatcgggaaaggaggatgttttatttatttgtcaggcaagaaatgtttctttttctgctccttaagagttaaccaaaactaaaggggccagttcagcaaacactaaatgtgagcctccaacatgaaggcatctttgttactgaaacaaaaataccacagcaggtggtagactcgaacacaggagggaggaggaggttcagttgttgcccatttttctaatcctttcagaatacccattgtctgaaccccaaagttaacatgttcctgctcagtctcatggagacaatttcagcgtgaaagggctgtgcccatcactggttttcgacaacagtttaatctttgggtatggaatgtgtaaccactcaacaaggcaggagaggcaattgtctgtctgagatgagccaataatatctgcttatcaaagcataaaactattctggatgtggcaagtcagagttaagtaggaattcatgccaaccgcagcagtagtttgcaggttttagactgtattaatcaagacagaaacatgacttttgttgtccttggggcagctcaaagcaactttgtggcaaccacactggctttctaaagctaaggctaaactctgcacagtctgcatctatttatatcaaggtgcttcagtggggatatagcttttaaaatggattcataattgaagttggaatattgttttcattccctaaaactgaatgaaatgtagtttataactctggacctcagagtgccctacctaagtgggaggcattaaaagatgagttaaggggcaaaggcgggctagcagactgatgcctattactgcttatgatgaagggtaccactatccggttcatatgcttgggtctctctgtgttctcattgagccatccacaatcgtttcttttattctaaatcaccgttggaatgatataagaaaatgaatgcagtataatgagaattaaaaaaataaatttgtaagaagtatagagttggaaatcttgttcctataaacgtaagacacaaattctaatgagcttatagatggtccgtaaatcacgttttgctcatgtgaacattgaacattgggtattctttcctaaccagagagaagctacgattctgctgcctatgccacactttagatggaatgatggcctcttttagtggcactaaatgtatacacagagcactaaacatatacacagagcagtatctgcaaacttaaggacttgtgtgatcttctggataatactagcactcagaagttaacatttcatctgacgcattcctttcatatgtagtattcataaatgtgaaaatagccttaaatcattattttcacccttgacctgggacactatagctagggagaatctctgggatatctggaggggagctaaggctcatcaactatttggtggttgtctttctgagtttaaaaaatgatgctgtttactgtgacctcaggtgtctgtctgtgtgtccaagtgagactgtagtcggggagagtccctgattggagtctcagtcaccagaagtccagtcaccacttcttccaccagtggagactgtctgtgaaccctagtctgtcagtgaaaccatggtcaagggcgtagcatcattaaccccaattctgccagccatccttactctgctaccccatgagaatctgggccactcattgaacactccaagcctggattccttcacttggaaaatgagtttgctgaagataccaacctgccgtgtcagtttgttaaagggaatacatgagatgctgcattcctgcctcacagaaagttccttatagtttgtcatttcatagtttaggaggtaagagagtgaactctactacccactgggtttaactcttgtccccactacttatcagctctgtgatctgaggcaagttacttaatatctttgtgctttgattttcttttctgtaagctgggataataataaaaccgatttcactgaattgttataaggatttaaattggggttacatgaaaagtgattaggacagggcttggcacacggtaagtgtaaaataagtaatagttattgttatgtttttgttattgttgttgacacatttctgattatgtgttttaggtagtcattgtgatgggtttttttttcatggctactattaatatgttaataaatgcactgatatttccagttaataggtcctgaattcctatttgagagccataccacaaaattgagtgagtgtgtgtgtgtgtgtgtgtgtgtgtgtgtgtgtccatctgtccatccgtcgtccatctcctctgggtaaatatgtgccgagtagcaggtagttctgacattgaagactctgtagacagtggcgtttaggcagggactgcatttgtcttaggtagatattatctaaggacaagtacagcaactctgcccgtgtgattttcactgaattatccttttctaccagattgttattttatttaagttttaatcgttacaatgtcagtagcatgagcttagtgagacatagctttgacctcaggaatcttaagaaaaataagattattcttatcttaataataatagaaaaataagtttattaagagtgggccgggtttgtggtgatatttgttagttatatctttgttcctacaggtctacattttagttccattgtctcaaaatgaaaagataatagcacagtcatgtgttgcttaatgatggggatattttccgggaaatgtctcattaggtgatgttgttgttgtgtgaacatcatagagtgtacttacacaaacctagaaggtagagcctactacacacctaggctatatggtgtagtctgttgcccccaggctataaacctgtacagcatgttactgtactgcacactgtaggcaactgtgacacaatgataagtatttgtgtatctagagatatcgaaacatagaaaaggcagagtaaaaatatggcatgataatcttatgagaccactgtcatatatgtgatctgtcattgactggaacatcattatatgacacacaactctatttagcgaatcagtattaaatgataacatgaagattatgataggcaaggaacaggacattctagtagagcagagtaactattttataaatcaaaatcaaccctaaaagcttaatcaaatttaacagttattttatgtcccccttggtcatcctccaccctgtgtatatgttgtatttcccagcatagattgtaagctcctagtggccaggtattgtgaccttctggatgtcttctgtatagcagagactcaaatgtcattgattggtttatcacatggcagtttaccttcagtatgttccattccatatgttctgtataaaccgtgctgggcctggagttagaacacctggtttctagtctgagctcaacttctttacaaactttgatattaaagagttacttaatttagctaagcctcagtttccttgtctataaaaatgtgattaatacttgctctacccaacacacatagttagtatgaggatcaaatgagatgaagttaatgaaagcactttccgaactttgtcagtttacgtatatgttagttttgggcacaggcgcctgatgtctgggttagatttggctctgttgcttactaatgatataaaatttgacaaattacttaacctttctgagtctcagttttttcatttgcaaaatggaaatgataatacctttatcttatagacttatttttaggattcagtaacatagtatatgtgagcagcacctggcatatagaaagcacccaataatgttggctgctgtatcattatcatcattatcatgagtcagaaagtgtcgaggttaagagatatcagcttacctgatatcagtgcactctgctaccccatgagaccctggggtaagactgaataggggttggaaaacagtgtggagatgccttaaagaactaaaggtagaactaccatttgatccagcagtcccactactgggtgtctacccaaaggaaaagaattcattatacaaaaaaagatactttcacatgcatgtttatagcagcacaatttacaattgcagcaatacggaaccagtccaaatgcccatcagccaacaagcggataaagaaattgtggtatatgtatatatgtataccaaatggaatactattcagccataaaaagaaacaaaataatggcattcacagcaacctggatggaattggagaccattgttctaactgaagtaactcaggaatggaaaaccaaccatcgcatgttctcactcgtaagtgggagctaagctgtgaggaggcaaaggcataagaatgatacaatggactttggggacttggggaaaagggtgggaaggaggtgagggataaaagactacacattgggtacagtgtacactgctcaggtgatgagtgcaccaaaatctcaggaatcaccactaaagaatttattcatgtaaccaaacaccacctgtttcccaaaacctactgaaataataataattttaaaaagactaaatgggggaaagagaggaataaagaaaggcttcatttttatgactcattttagtagatttaatgtgactctgactggctggtactttagatttatcctaaatctcagtagcaaaattctagggagaaaaaggagctaacacttacagactggctgccatgtgtcaggtactatggtaagggccttatgtgtaaaaactaaatcctgtgagctctctgaagtagctgctataaatatcctcattttacacatgaggaaactgaggtccagagaggataagtaacttgcctgtggccagcttggtcgctaagttggccttcagggccttggttcttccttcctgtgctaaagtcctcaagtacaagggagacctcctgaatcaccaaaaataattttttcttcattgcagccaaaagcagagaagtttatgcatcagctttgctctaatttgagtttttgtactgtccagatcgcagcctacatagggcacatataaagtgtagaatttgtgtgtgtgtatatataattttcccaaatctttcatttttagctatacatttctctcatgttccaaaatgctgtctgcttaatgttccaaagcatctccaactccatgtgtctagtatggaacgcgtcccttgtgactttgcagtggcaggggttggcatgagggatatactgtctttgtgcctcagttttttcatctttaaaatggagatgcttgatatatggtgattgctggatgaagtgagataatgttgatggaatggttgttggcatggcaggtcgtaagcactaaataaacatagctgttgttcttattgccactctggggggaccagttctctaggcctgggggcagtagtaaggtctcagtaggaccttctggcttcactctcctgagcagataaaatttccactagggctttggtttgggtattgctgaaagaggagttgggtgggtaggtgggtgggggtagatatatacaaaggagtgaattataacaaagagccttttctgcttcaattcttgtgtagaaaacatatgttcagtgatgcaggcagcagttgggttaaagacacactgtagggccgcagacaaaaggcctgtgcccttcctgcattcacaatgtttccaaacatattcacttgtctcacttgttagggactgagctgtcagctggatcctcttgcaagtgtgatttctttttcccgtcccctttcaaaggccatccctcccttcccctctcccccagtgttttacacttcatataatccagtgtgcccgacagaccacttcagcctttgtgctgctgatgtttaggggaaggagagaattgatctgatggagatcttgggtaacttttcacttgtccaaggatcggaaagtgctaagccacttttaggccaaacatcatcagtggctcaattatttcgtacttggtatagttagccgttcttcaccttcaattaacagttaggacaacgaacagattagtgcagtggaattcttagaagtagcgtctgggaattaggggcatgtgtgtgttgtggtggggttgggagagttcttgcttttatttataaagttaatagtttttgataaaaagataaagataaggcaaggcaccgtggaagtatttggagagaagtcagctgtcattctagtattaattatgtgaaatgtacaggtatgtccatgtttaattctagattcaggtagtattgctatgtgccatggctgcagtttgagcattttcattttctttattgaaggttttgtggctctgatggttttattttcatcagtgagactttaaaaagatatatttatgtatattactttttgtgatatatatatatagcataacagtattaggtataatacttttatgtataatctaccaacactactattgaggtaacagcgagctagagatttaaagaattagcatgctaagtacttccatcactgattactcttgggcatttcaccctcccaaaatggacaagtgaaaatctgcaaaatgggaattacatgatcatcatactttataaagcgtaccatagtaaaataaaaacagttttatcgatgatggtcaacaacaacaattttcttgtctttgtagagatcttggattgtgtcttcattcccatatcattgagtcagttttaatgctctcatttcctttttttccccaagagttttgctcttgctttctgtttcatgctattgtttattagttgggttgctcatcctgaaaagcagcagcatatcccaaggaaggagaggcagtaggcaggcagagaatttcccattggcttaaagctgtaaatgggttgttagctcattttagcagtggagcaattataatcctgctaatgaatacgcaggcaagtggagtttcccatatatggtgtcttctggtgtgaggataatttcaacacctaaaaatccacagacaaaaaaaaatgtcatataagtattttttaacagaaaatgccaacaaagtcatcctcccaatacgtgtcagaaccgacaaaggaaactactgatggtgttataacttttagtactgtcatctgaaaaatccttgaaaggaaaacactgtggtaacgcatacatattcccctcagactgaaagtaacagcctgcaaagatcttagtagtgggtgaagctaatagactgcaagttgggatgaattgcacctaaggtggcacctttctcttgtgcctggagtggaatgtcacccagaaccaacagtagaacaactgggaaataagttgatattctttccaacatcgaatggattcatttcacagagttggggaggaagtgagggtaataagagtgtgtttctgaggctcttccttccagcagataggttttgttttcttggttgtaaaagaggctaatgcttcagaagctagagtgattcctggactctcttggtaagactaattatgctgtttcctgctcccgtctgtgaatcagctttgttacatagaatgcacgtaatagtgacgaagagtagactctactgaagcaaaccaatctattaggctgcttggaaaacagagggagaaagaagaacaatgattttgtaaactccataaaggccaaaaaaaggctttcagtaagtatgcagagactagaaatcaaatcccatttcctatcataagaagcctgttgtttcagccgtagtagttaatgtactgtatgtgaaagatttaagactggttggaaagctctgcttctgttttattaggctgctattgaaaagccaacagcataacttcgactaggtgctttgagatttcttaatgggctgtcaggggcaagacaccagggctgtgctatactagctctttcctgtacattaaaacaacaggggccaaacgatcacatacagaagtatgaattacttgatgctttctctgttccatatggccagccatgtctttggcaattaatcatgtacaaaatcagtcgagtgctctctgaagcattgaagtcaacatttagttgtacctgtgccagtaggggcagtggggttgcaggcgtaaaatagcaggatgaggggctgctggcgccaaggcccaagcagctggcttctataaacaacacttttttttcctctttacctttctcccccactttttctttctttctatttttttttttctttccttgacaagtacatggggctgtttttcaccatcatctgaaacaccagcgttgccaactggagctctgaggtctagctttcgtacattgccccagcatccgagcttaaacgtatggggcaggccatcttttcccacagcagcctgaacattccagcggtcgcccacatgactgtccccgagagtttctgcagtggcaggcaggctgctgtggctccatggctttttgtcaaacagaggaggcagagtgatttctctactcgtagaaggagagagatgggagatatggtgtaagtgctttggggaaaaaacaaaaataagtagtcattcatagtcatggctgtgatattttaggattttgggttttgtaaatcaatatccatatcttttcttctgtgatatttcccccaagacttcatacacataatgctgctgccaatagtcctaataccaatttctaacatttatcaagcattttgtgtatgctgagcactgtgctaagcactttacatggattatttcatttactcttcacaagagcttcacgagttcggtgctattacttatacccctttatggatgaggaaactgatcaaagaaacattttccctgaattctttcctcatagacattcttgattactctcagctagcccccttagctcaatagtacatgatggaaaaacactaaaatatgtcttactggcacatttttgaggagtcatgtggtgaactctgcggagatgttcagtcaaataaagtgggtctttgagatgaactgaaccaagtgtgtctttaaggtgggaatgaaagcctgctttgttggcagcctcttgaagacttctgcctttgtgccttcctttcaagacagtggagtttatctcctgctttcctgggtgagtagactatgaagggcgggggaggggaaggaaggatgaagacagcagccttaagtagtccagtagacgtggcacccagtggtgacttggtgttatctcttagccgaggtcatccaggatgcgttttctcaaattcaggaaacaggggaaagaaagttttaacattgtgtaaacattggcacccccaaaacctcctccgggagataaggtaggcagaagggctgggaggaatgtttatttgttctgccacgctgtggatccaagcatgctggaaatctttggtggtgcccagtccagtttagaaaatgtgaaggcatcactcagcattgagccaaagaggcctcacaaaagagccatcttaaactgacaatcactaaatgaaggaagacctgagatcgacctttctttgatgggactaaggctatctcagtgggttctgtgcctttcttcttttttttctttctttcttttttttgtaaaaaaaaaaaaaaaaggaaggagagaaaaaaagtgttcctggacttttgaagaggggagccctggttggggcttttgacagcctgtggcaatgttgatgtgaggaaatagctttcccagctgataacatcttaaaccaagtttcttcacaagttgaacctttagccctcattatcagtcagagcatatctttgtaatttgtgtgtgcagaggggaaatacagccctaacatgagacagctatgtatataaaaagtgttgggggtgacatttttcccgtaatgacagtattacttctgtggtggtagtgaggatgggtagatggggaggtcagaaaggtacgcagttctgggatcctggtgtttaaatgccttttgaaattgcaagaacagtagtagattttttttttaatgaactctgaagagggattaccagccatatttgtagaatgccatcctgtttccatgcatttccttagacaacattctttgatttgtaagacggagagattaagtctgagttttggggttacaggcctatcagaagccgttgcatcatatcagagaggaaccaaaaggattaaagacttgtatagaattattagtaaagagtaaatggtgtaagtctccttttaaatttcagagtggttcctctctgaaaaccctacatgcaacaaattctgctatgatacagtggaattaggacatactgaaagttactgactgtagcaatatgccccacaagaattaggtgaattgctgagttttaattgaatccgttcagaattgggagactttttccaagaaagacaggaaacttaagcataaaattcaaggctccttagagttcttggcttttcttttctaatttgcattcagtctctctctctgtctctctctggctgtggattttttgctttggttttatacatgaagttttgagccaggagaaatgaaagactctgggaaattcttaggggtccttaatatgctgtgtgttgccagaatccaaactagttttctctactgaaatggagaaagtgggacttcttcctcctatacataacctcatattaggagggtatatttttaggcacgtccatccaaatgagtattgtccttttaagtagtcacctaccaagggcatatactcatttttcttgattctgttacttaaaaatagtttttccgaccccgttcttagactcatcttcaggaatagtttgaatcaaatcacagatggtttcacatactgtttttgaccttgaatagtgctctctggcctgatcattagcttcactccccagacatgtttcagcatgtcatttggcttcatttattccaaagtatccatcaggagtccacttccgtggcatgttgccatattaggcaccttggagattattaagaaatggtcatggacccttctggtctaatggagcccacactctggaagagaaaaatttaaatgaatatgtaagtgcaatggagtacgacatggtggtgcataaagagaatgatcagctccatctaatttggtggaaggacgtagtttgtggaagacttcacagaggaggtgtttttgagatgtttcttgaagagtgagtagttactggaaagttatatggcaaaggtacaaatcgaagtatagtatagaatagccatgtgtttttagggaattacagttttatatgaaacagaagatgatagaagataaaatatgagaagtaagcaggacctgtatcaaaagggttttttttttccccaggctaaggaatttggatttaaaaaaaaaaatcattttttgtgtgtgtcctccaaatgccaataaccgaagcatatataaacaaaggtgctctggtttaggtgggattttgaagccaaagctccttgtctccttggtgaccctaagaaacttcgtggaagcactggggcttcatgacgaaagcctaaaaaccactattataggtgatgctgaattatttaagaggaagtaacatgtttggacatatacttttaaaagatcactcttgaagcaggaaaattaatgaaaggggtgagatggacacagacagatcagtttggaggccattacatggtccagaagagagatgggcctgaactaagcctatggcagtggggaaggggtaagtttcagtcatattgaagagagaagaatcacaggattttttatgtttaggtataggcagtgcaggaaaggaaagggaagaagattagggtgattcttagggttctagtttgggttattgcattgatagtagtgcagtcaccactctagggaaatacggtggaaggagagcaaaaatagttcaaatgtggacaggtgaaggtcaaatcttatgtttgaggcagtgtgtttaaggaagatagtcagttgttggctgtatgggaccagagcttagtggaaaggtccgcttgaaggtagaagcgtagagatgtccgcagtctacagggaacccttaaagccattggaagggcagatcacccagagagagagcaaaccgaagagatgagaggaggatgaaaggtatgaccttgggataacaacagttcctcatcctagaatgaggaaaggcatacaggagactgagaaggaccagcttagtgtcgggcactggcccaggagagagaggtgtccactaatggagagagatcaagtgaaatcagaacttgttctaaaaataaaacccaccctcaaaggataaagagataaagattttccaccactagggatatgcaaaaagatatgcctctggcttctggtacataaaaattttatggttgtgattgttcagtggttgcctgatttcctttaaagtttttccacttaaagtaatagacattttcaggaatccctttgttaaactagcataacctagcacaaggtagattggcagagtttaagatgaaagtaaacaataataatcatgatggcatatgtaccaggcaactaatacaagaattgtggagaggttctgttattatcaccatttggagttatgggaaagacccacagctaggaggtgacagcggggatttgagcagccagcactctaaagaatatattaatacttagttctttctgatctggcctgcatttccatagatttctattgaaaaaaagtactaataaaatgaaatttagccaccaggacacgtttcctaatgaaatgaaatttagccaccagtgcacgtttcctaaacctgtgggggttttctcctgtattttgggaggaggggagggagaatgtgtttttggtaataggagactgtttaaaaattgttacttgtttgaagacagttctatgttactactaatgggaaaatggtctataaacatttcctggggaagtcaacccttgaaaagccgacactattataaggagtaaaaatatcacattaattgccctgtaaaaagaatgctcttttgacactgaaatttccttttgtgcaatgatttcttttcaccctaaattttagagtttgaatgttcaaagttcacccttccttttctaatattaaaatagttttttgtaacagaatttgtttttgtcgttaagttatatttctttatatttttactacttatttgctagatgtgtttacttgaaacttgttttctgcattctttcttgttttaaaaatgtgatgcaaatgaagtttttgagttaaattaaattttataaaatttacatacaataaaattggccttattttggtatacaaccctataggttttttatggtttttatttgtttgtttgggtttttttttgaaatggagtctgctctgttgcccaggctggagtgcagtggcatgatcccggctcactacaacctatgcctcctgggttcaagcgattctcctgcctcagcctcccgagtagctgggattacagaagtatgccaccacacctggctaatttttgtattttagtagagacagggttttgccatgttggtcaggctgatctcaaactactgatctcagatgatctacctgcctcggcctcccaaagtgctgggattacaggcatgagccacatgtcctatgagttttaacatctgtataaactcacgtaaccaccaccacaatcaaggtacagaatggttccatcatgctcaaaaattcccttatgctgcgtcttgcccaaccgaatccctagcaaccaatgttatgttctctgtccctacagtattgcctgttccagaatgtcaaacaagtggttttgttcactgagcataatgtctttgagatgctgagtgatggcatacatcagttgctcagccctttttattgctgtagtggtgttctgttgtatggatgtaccaccgtgtatttatccatttaccctttaaggaacatttagattgtttccagtttttggtgattatgaagaaagttgccataaacatttgtgtacatgtttttgtttgaacataagttatcatttttttagataaatccctgtaaatgaaattgctaggtcatatgctaaacgtatgtttaactttataagaaattgccaaaccgtttgtcagaatggtagtattttgcattcctcctagtagtgtctcaacttttaaaaacttaaatgctattttagatgctcttgggttggggttggcaaattgtgtttcgcagtgccttggggctttgagaagatgccccaaaacaaagggaggacttctaggtcctccataccagcttcaaagagaactgttccagttttgtttgttgtatatattgggagttgcatgtaaggatacatttggggagaaaagagttttatctgcaaagtgtttaaaaaccattgcagtagggaagtgcacccacaatgtgagatgtggaccacaggtgatacagggtgatgctaggtggcacttggggactctgcacatgaggaccacactgtgaggcagtgattctctcttcagctccatctgtttatgtgattatgtcaaggaagtcttcatttaaatctgctgcatcgttattctccaccacttgttaatatcttcctttacaaagagggagcatgctttagtctcagagccctcagcaagcaacagtatctctctagaatgaaataaatatatagttttgtttatatttacttttatgattatcttcttttttttttttttttttttttttttgagacagagtctcgctcccaggctggagtgaagtggcgcgatcttggctcactgcaagctctgcctcccgggttcatgccattctcctgcctcagcctcctgagtagctgggactacgggcacctgccaccacgcccggctaattttttgtgtttttagtagagacggggtttcaccgtgttagccaggatggtctcgatctcctgatcttgtgatccacccatctgggcctcccaaaatgctgggattacaggcctgagccaccgcgccaggccaattatcttctcatttataagtaccatttttcttttgaagtgaacttatagttttaaaaaatgagccaattatcatagtatcattttttctttttttacttttatctagaaattactacgaaaaatgagtcaatttaaagaaaaatattaaatactgtattacatagttcatatacaaatgtggcaagaattatgaggatgtgctagaataactgaagtttaggaaactcttgaacttctagaggatctggttatttaaagaaaccttagagtgaatccttttgtgaagtgaagagctccttgataaagcacataactatttcttagtttatccattttatgagtttataatttatgtaatagttcttaaaagaagatagccttcattgttctttgtttttgtaatacttatttttcaagtcccttctttattcactgatttgacagatattttgtgggcaatggggatacggtgttgaactaaacaggcgacatcccctttctttgtgaaactttctttcttacatccttcccctcttagaggctgttcagagcctatggaaaacaagggcccctggataaaatgtaaatgatatgaaaggcaaggaagaggtaaatgactttaaaaaataaacattttaatagattcacaggggggaaaaattttgttttgatcatgttagctagctagatgtctactttgtctttcatttgatgcatttttgcattttggtaaaataatatgtatccacagatataaccacaaactatgtgactttttttttttttttttttttttttaagacagaggttcactcttgttgcccaggttggagtgcaatggcgcgatcttggctcactgcaacctccgcctcctgggttcaagcaattctcctgcctcagcctcccgaatagctgggattatagacgcctgccaccacacccagctaattttctatattttcagtagagacggggtttcaccatgttggccaggctggtcttgaattactaacctcaggtgatccactcaccttggtgtcctaaagtgctgggattacaggtgtgagccactgcacctggccgataaagtacttgactttttgaggttcctttcaactttaagaacatgaagtagggtgtcacagacaaggagtagtaccgttgttagaatacccgctaatgctcagacctctctgaaattagacatcttttagattagagatcacaaattggtagctgcctaagttctattcagcccattggtgtttctcatttgacccacatggtatttttttaaaaaattttaatgagtttacaagatttacaaaaatcagtttttacattaaacacacacacacacacacacacacacacacacacacgcacataccagatttcttgtttattttgaaaattcatgaatctagcatcagtgagccagcttttctgaatgtcagagctggctggatctgaatagtgcgtgccttttttaggcagaacatgtgctgtctttcagtaacctctgcttaactcattcatgttatgtgcctggcccagtgagtatttgaatttgcaacctgtggatcctgggtttcatgcactggaattacctagagaagctgaacattcctccttgtgctggagggctgaaaatgttgttgccacagaagctgcttgagtgtccaactgggcatatcttccagcacagtagatggaatactgggataggaggcagaatcagggtccttttcctggctagtgtcaggtggattatccaggcttcttcacaatggaggtactattttctgacttacctgtttgtatcagttaacatttttgatagcaacagaaacagattctgatgtggtttttttttttttttgagatggaacctcactctgttgcccaggctagagtacagtggtgtgatctcagctcatgcaaactccatctcccagatttcaagcaattctcctgcctcagcctcctgagtagctgttattatatgtgcacgccaccacgcctggcaaatttttgtatttttagtagagatggggttttgccatgttagggaggctgatttcgaactcctgacctcaagcaatctgcctgcctcagcctcccaaaatgctgggattacaggcatgaaccactgcactcagccctggtgaatttaaacaaaatgggactttattgaaaggatattgggtgactgacactatcaaaggaaaagcgaatgatctggcctcggaaagttctggaaactagagatactctgaggaccatgggtggaaggaattaagggaattgataaattgcctcagcattttcccccgtttctttatcattcctctcaagagtctgaaatcctggaaaagaatcaatttggtctggcccacatccttcataggggaagataggacaccttggttgacagtccctctaagactttataccatgaaagaaaagactttgtaagaagagatttaggtgatgttgccagacaaaggggatgaggtatggatttaagcaatagaaacaacaaatgttcactactcctcttctcaaggttgtcatgaagatattaaatatgcgctgtcaaatgctatcaaagagtaagggagtagtgtttcaagttacaggagaaccaggttatgggtatgctctttaagtaaacaaatatattggcgtctgttagataaggaatatattgaatgacttagaacacagacaatttcattgaaattgtagtggcaatttcattccttttagcaattgctttggttataaaatctccaaagaagccacactaactttaaattataaaacaacatctataaaaatctaaagatgttctttgagatactcattcaaagaaatggtctttctgatttttgtgttcccatttttttctttgcaagatcttgatttgcaacaggcaaggaaaatgagtgaatcttcccccttcttcccccacaaaacattgctggcatgggtagaaatttaaagtaatgattcaaataagagaggcagagaaagcctcagctgggtggcaggaaacaagagagtgaaagtcagaggctgctcttttttaaaaaggcaaaacaaacaactcacagtgaagtgtacgtgaaaatcatttctaataatagctcatggtaggcaattcccaggaaaaaaaaaatcgttggtgtgctgagaaaattagagtaagaatgcgcagtatcttgatgtgttacttaaggcaatggagctttagagtttaccttatgtgccatgtacattgattaaatacaaaatatatgccggccatttttggccatcatttactgcattgatttgttagcaggggaactgtaataaaaaagccattgatttactgtccttatttgcttatgggcttttttttattattaatttttcactttttctttctctgttttggatcatttcttgtagacaaatgctgtgcttcatgaagttaaaagagaggggctccccgtggaacaaaggaatgaaatcttgactgccatccttgcctcgctcactgcacgccagaacctgaggagagaatggcatgccaggttagttctgttgtgaaatgggatttgttgttcttgacaaacaagaactatatttggccaagcccttccttatggctggcctcatccctttcctttgagggcccatgaaaaataagcacgtttaagatgctttcagctaaagttagctttcctgcccacggcacctacattaattgtaatgatccattgacgtcatcagtatatttacacaatttgttcccaaatataacatttagcataagtgtttgcattttgagcataatgtaatataagtacctgatgctgaagaaccctttttaatcaacagtgtaaaagactagcattgctatttcattagagcagatgtctgagaaatccatatagtgctcctatatcactctatgcagggcagattacttgaaagtatagtcatgcatcccttaatgatggggataggttctgagaaatgtgttcttaggtgattttgccattgtgtgaaccccgcaaaccttgatgacatagcctactatacacctaggctatatggtgtcgtctgttgctcgggggctgcaaacctgtacagcatgttgctgtactgaatattataggcagttgtaacacaacaataagtattagtgtatctaagcatagctaagtatagaaaaggtactataaaaatatggtgttataatcttatgggacgggaccactgacatatataaggttcgccgttgaccaaaacctcaaaatgttgttacgtggcgatgactgtagcctatttatcaacccgatttttagggttgaccaactaggaatgactcttgtttcaacctggtctctttccatagagttgcctgtgcttagaaacggtgttactggtgaaaactttctttaaatcatcagtttttacagaactgatgcttgcatagtaaatatcatgtggtcctattctgttttgaaaaacagttgatatgtgggaggctagaactagttctcgcaaatgttaggattatcttttagatctgtagtttgtaaaaattattgaattgtcatccgtctctaagccagagggagaggaatcaggaagcgtatggcatattttgtctcagagtcttatttggtgcttaaaaattctatgtgcctggaagtcaagaacatttattgatagacataatattctccaaatgacttcatgcaacagaatttataataattgatagctttactagtaataattatcataaaaataagtttgtctgaacaaggctgaagatgagcattttccaagaaaggagacagtatgagtatttattctcattggatatcagaaagctgctttttcaaatatgtattatctttaaattcagacttgtatttaaacagtaatttaaaaattcccaatgatattcaccctccccttcccccatctttttggtggtgtggtcggagtaaatggcagacagtttcttttttttctttttagaaaaaaatgtttataaaaatagacacaggatcttgtcatgttgcccaggctggtcttaaactccttgcctcaagcgatcctcttgccttgacctcccaaagtgctgagattacaggcgcgagccaccatgcctgcccagtggcagacggtttcaactaaagtaatgactaaatgatttccaatttacctttcaataattaattttaaaattttctctgtattataagttaagcatgtatattcattaaagtatacatagtaaggaatggaatatcagtttgtggacatctaaggggtttctttgtctctgtttgatgtcttatgtcgccctcacgatgattccaattaaatagaaagggaggaagaaagaatttccctgtaatatctcctctgcttcccttccgtccaaagaccgtgtggcccagtgagagcataaatggatgtcttttgttgagtgcatttggtttgttaacaataattttttaatacaccaaatcattagacaacatggtcaaagtggcctgtttaaaaggaatctgctttcagcatttctggcccttactgctaacaatttaatcaggagctggagccagtgttgaagttgatgtagtctagcaactgaaacaaaaattctcaagtcctttgtgttaagggaggaggaaagaaagagcttaacagctgacactgtgcagacccccttaaaactaaacacctgaaagaaaatttcaagaggctggtgtcttgagatctcagaaggaaaagtgtcctcagagtattaaataaccataatccttctccccaccacttctccacctccatttgatgtttcccatcttagtgacctatctacagactcatccatgcgatccgtataaacagacggttaccatacacctttcttttcctcatcaaagtgtcatctggctgtctggaattgggcattgcctcgagtagccgtcaaatgggtggtggtgaaagttataaaacatccactgcagtgcttactaagcagcctgtgttttagagattggcctattgtgtacttcggaattacacaaggaaaaatgtgctttgacagaaaataattagcactcaccaaaggccaagcaataggttacagtattttactttcatcaaagctatcaggggatcagttagattagataatagaaatttttttcctctgaaagttaaatacacatgactctaattaccttatattgcacattagagagtgcattatgaattgtacaacttcaagaaatttaggtcaacggagccgccgcagctggcagtaactttagtataagtcttttgtaataaaggtttttacctctctttagcaggttcatttgcgatcatattagggagaatttttaaagtaaaacttgtaacctggttgtaaaatatttgtctgtctctcaggtcaggcgccaagccattgtttgggactcactgaagtctcttaaactgaagcatatgttccttgtaatttagctttttgaggaaagtgtcaattttgcatgacttggggtaaccgagtttgtcacagtgtcacacaacccagcgactctagaggcacatctgagtgctgtgggtttccttctccaagcttcgtaatcccataaacaaccctctccaaataggcttattagggctgtctattcacttccccagagttgaatgatccaaaggacatcgggagaagctgtgtgaatgcagggtaagtgttaacagaagtgggacagaatttctgaagattcgcctttgtttatccagtcccctctgcctgatggacagcttgttatagcttttaaagaactgggcgagccctctgatctgaccccttcttgacctgcgtagcccaaaggtcagtctgcagctaataaactctgaggttcttagggtctactgtaggaaaaggcagaaaaagagcagctgcaaggaccgggtgtcccaggataggctactttagggtcactctctgataatgaaaatgattaccaaattatatggaagtttaactgcaatcgtgagtgagaggagggtggggcccggcgtattaggtttgataaatgaactgtgaagaggcccatctggctctcaacatcttttctccccctctttccctaccaaggggaaacattttaaaataacagcagtacatatagactcaatgacccatgcaaggagctggaatggattaagatttaatggtgacagtggaagaaattatcatttgaaaagtgctccaaagaaaaggtacagttcaatgtccacacccgagttgtctttctaaataaaatataataaaaatcagcgccttgtttattttctacaaagccctggcgtctttcctagatggctgaaaattttgagggtgttgtttattatgggataattattcatagtttagcttcaggaacggaatgggcttcctttgccttgaagaagtcagaatgagaatcaaagattttgttctgcctgcctgcttcatttcagtgatgtaggtaaatcaagtgttagagaaaatgcttttccaaaaaaagtgtgtccatgtcagcatctgaccactgattattgtgcactctttagtactaaatatatgtgtgactcttgaacagagtcttattcctactacaacctggcagtttttctgtaaatataagaagaaagcacataatgttaactgagtagttacgtttggttctttctttgttccttttttcaaagaaacatcatggtgatgctaattattgccaacaatggatggggtcactatacgctattcgtctatttatttatcgctaattgataagattagtctatttaaagctctcccccagtttctcatgaacatagagtcttgatttcagaccagtgatgatggaggccatgtagctctgttcttttgcagagatgagtggcacatgccatgagtccactttctgaagggagaatgatttcattcagtgagcatctttttgtgtattttgtatacctactgcatgagatgctgtgcataatagggagtgagctaagtggccaatttcagggtttatctggggatgagaatgtagaaagttcctagaaagaggctgtggaaggcagtggcagggaaagcagtggaaccatcgttaccacaacagagcggcaagttctctgacccactcaggaaagtatttaatggtagatgtcttggaagactagaattgttgtgttactgaaaaccctttggctgggcatggtggctcacgcctgtaatcccagcactttgggaggcctagacgggcggatcatgaggtcaggagatgctgaccatcctggctaacacggtgaaaccctgtctctactaaaaatacaaaaaaaaaaaaaaattagccgggcttggtggcgggtgcctgtagtcccagctactcggaaggctgaggcaggagaatggcatgaacccgggaggcggagcttgcagtgagccgagatgacgccactgcactccagcctgggagcgagactctgtctcaaaataaaaaaagaaaaccctttatattgaactatactgactcgtaatacaggcctcacccagacaataattatgttaaaaaatcaaaacagaaggcttctaaacattatccaaagttagcatatttttcatcaaggttttggcttgactatctatgtctgggggcatttcgagtgagcagaaagccaggtagaggataattcagggagatggcaaatactttgagaatcaattgtgctttttaactttaaagccatggccctaaatttttgctaagtgaggtgtaaatacaaaaagcaaaccaaaaaaagagatgaaagcaaggtcattagggtttttaaaaaattgaggtacaagtcatatataacgtaaaattgcatataacaaaatttatcgttttaaagtgtacagttaagtgattttttagtatatgcacgagattgtgcaactgttaccactatccaattccagagcatcttccttccccagaaatgaaacccggcatctgttaacagccaccctccattcccccttctccccacagtcctgagcaaccaccagtctactttttatctctacagatttgcctatttataacatttcttataaatgaaatcatacaatacgtgaccttttatgtctggcttctttcatttggcatactgattgtaggatgcatccatgttatagcatataagtacttcattcttttttactgctgaataatattccactatatcgatgtgccacattttatttatccagtaatcaactgatgggcagttgggttgttggacagtaataaattgatggacatttgggtgggttgactttctggctatcatgaataatgctgctgtaaacattcatgtacaagtttttgagtgacatattttcagttctcttgggtatatacctaggaatggaattgctgggtcatatggtaattctgtgtctaactttttgaagaactgtcaggctgtttttcatgtctgttacaccatcttatgttcccaccaagaacgcacaaagtttcccatttttctatgtccttgtcgttacctgttattttcatttttttggactgtagatatcctagtggtatattattgtggttttgaattgcatttccctattgactaatggtgtcgagcatcttttcctgtgctttttgaaaactattgctttttcaatcggacattttaaaacatggcggacttaaggacttacccctcttgttggtgataaagagctcagaagcctgttaagaatatttggcttgtagaagaggtgaggttccaaatggggctgtcattaaattgcagcagtgcacgtttccccgttaccatggtcaggcctggctctttatttatttgcatgtggccccacttatttttttctagagattacctacttatttctcctaccattctcttacatttcattcaacattgcacactggataggaatgtagcctgattaaatggaaactcggtacctttatagctctttagcttttaggctcaaacaggagttactgtactcccataggagacaacttcatttgggtcgaaggagccttaaaaatggtgctgagattcatttcaactaatgtttatggaagtttcttcgaaaagcttttagaactacttgcttctacttaaaagtgactctcttaagatccagataactttatgtaaaaatatcttcctcatattggtctaagttcccatttttttctggactggtaaaacaacggtcttattattagtcatctttctattctctgtgaccccagccatcccatcaccacctacccccagaatggatccactctggacatctttgttaaggctgtaaaatctggttgttggaacctagaatgtgtaatgaataggatttactattccaagttaatcagctttagaactttgatcggggctcaacaagtataacactttgtataagttacttatatggatcaactagcacactgaggtgttctccaccggtatctgtctccccttctgcctcctagctagtcacggattatatgcaaaaccgacaagtcggcaccgtccagtttagcaattaactattatttattgagtgtttgttaggtgcaagtaactgtgctagacactgtggggaatatcaagatgagtatgacgtgagtctcaactgtggaataatttactttaatgtggaggtggtagttaataagaatacaatggctagcacacaccctttaactcttttttctatgaggcactgtgaaaccataaggtaatttagcaatggggtctgccctaagggaacttatattttgatagaagcttaaaaaatgaagtaacctgacattaattatatatggacttgattctgtgtttacatttttatctctcctaccagaatgaaagttttatgaggattggacgtttgtttgtttaccagccgtaaaacatacacctcaggccaggtgcagtggctcaggcctgtaatcccaactctttgggaggctgaggcgggcagattgcttgagctcaggagttcgagaacagccagggcaacatggtaaaaccccatctctgcaaaaagtgcaaacaactagccaggcacggtggcgcacacctgtagtcccagctacttgggaggctgaggtagggggaagcacttgagcccaggaggcagaggttgcagtgagccgattgcatcactacactccagcctgggtgacagagcaagaccctgtttcaaaacaaaagaacaaatttgcaccccagatctttgtaacattaagctatctcttccatttgaataatgccctctatcaaaggacctcattgcctgtttaccacatatccctggcatctagaagaatgcctgacactcagatttgtgaaatacctttcctctcaatctattccagtgtttataagtactttgtctgctttattaattttgaagaggaatgaccacttgtgatattggcctgttgctttttttgctctttttctcaaccttgcctggtgtggaaatcttgaaattcgaagtcaggatggatctctgatattggaagtaagcactggttattcatctaaccttgccaggggtggaagccttgaaactggaagtaaggagaaatctctactatgcagttctctggtgtttaagccccaacatggtaccacaggcccttattccagcatgagcaaagagggatgccatgtgcacaggctgactccagtgtacttgaggaagagaacaccatgggactgggctaagaccaggacaaaaagacatggtctcctccctgagccaccattcctaatttgttgactttcctagaagtgaaatggagctgggtgagaagaggaagaactggcatggcgaggaagaagagagttataaagacagccctgggacatgcctctgaataaagggatgggttttagttcagtagggataggaacaaagctgaggctaatatggcttccagtctgtaggcagctgttttttcctggtcacctgctaatgtcctcgtctgctttagtgatatcagcacagttatgaactttagcgttggtgattcggcatgtggactagaacttggagctgtgttcacaaaaagtggagctcctcaccttgaggatgggctgtgggataatgagactgatgcagttatctgctgagacaacctgtgattgtgtcatcggaccacgtcagctgctatcattcatgctaaagagactggctgcttactccggcacagctggttagttggaaactagaagttgtggcatctgtagttcggtagctgtcagttgctactaggtaaacttgtttgcagtgttggggtgggcatgaggaataaatggaagagattccagggagaagcagggaggcactggcctgctagttgccatccgggtcttttttaagacatctgtcccttcgcttttaataattacagtctctgctttttgctgcccttagcagaagaaagttctttgtgtttctgatccagattactccataaaacctgataactccataaaacctcctcaaaaatgtgtaggaattgaaacattgtataaatttagagcaaagattaaatgagtctagagatagggttacttttttcccccaagatacagcaacttatcttaaggaggcaagtgttgttaatgttattaccattgttactgtcattatttgaacagttttatgggggacaaaagccaattgacttctgtgcatcttatttataaaatcaacacatgggctttagcatgaactctgtttctggcaggtttctgactgtgatcagttgctggctggctgtttcttaggggcagtgcttcttaaactttttgagaaaacattgattcatttatttatccaacatacatttattaagtgtctattgttttctaagcactgttccaggttcacagcagtgaacagaactgatgacagttctttcatggagcttatattctagtggaatgacagatatgaactcttttcctaagcggaactctgaaaatttcttttataaaatgtgcatatagttgctatgccctgtatattcaccagcactcaacagtgaccaaaataaagtcattcagttgagataaagatacacagttctcttttctgagctttgttataaagtaatcacttgttataaaatttacatttcaagttgcagtgggtcatatttgggaagtagccgtgggatgccagttttctgaggaacaccatcctagggaatccgtaacataaattctccttcaattatccgtaccgtggttcccatttacttttccaagacctgcgtcactttaaaggtcttcatttgaaggaaggcttaaattcaggccacattatattgacaaatctctctgaagagagaatgggcaaagccatacctatctcataggtgttgggggattacctgtgataatgcactcaagtacttcataaatgctgggttttgttgttgggagtgatctgtcagtcatgcgttggttctgcaaatatttcttaagtgcctacctggtatgaggagctatcttaggtcctgaggttgtagagatgagtaacatttgattaggggaaatgtattacacaatgtagaatcataaatactatggaagagattgagtcatgattccatagaaacccacatcccagggaagaagacaggctctccttaagtgttctcataagactctcattatgtgcccagcgacagtgagaaatactgctccattccccaattgtgttggctaccagtagataggtagctatttgtctcaaagcatgagtgagaaataggagagaaatttatacgtgaggataggtcattgtataaaagttgtgctaccttctttccattgtataaagtttgtggaggaaaaatggttttctttcagagtaaatttaattaatatgtttgggggcatagattctgaatcagattgcctgggtttgaatcttggatccacttctataactccaggcaagttacaattgtggattgtaactagatgagttacttaacccctctgagcctcaattttctcgtttgttatttgcctaggggatgataataatagaacccatttcatagggttgattaagtgattaaatgtaaaacacccagagcaagtacctgtaacgtattaggtgttcaataaaaatgacctatcatgatcttcagatcaaaacaataaagccaggaataaacccagccacccttatccaaattggcctctcctttgagagaatgcctcatgaagtaaatatcctagcctcctggtaggggcctgatattgcaaaattggtgcagggaagaacactagacagagttggtgctctgtgctcagcagtgtcacacagaattgacaggtggagggctggactccagtttgaatcccatcattagtgactataggactctgggcatgtcacagacactctacgccttagcaactttatgtaagaaagaagcgacttgatctcgatcgccccaaaagtgggaggcatcttccagctctcacaaggagtggctccatacgtgagatccccgggagcagggaaaagtggatgttactcctgatgggtttcactcctctacttccactttccctgaagtctgcaattgtactaattttaacaacaatagcagctgacatttattgagaagtcactgtgttccagacagagttttaaatgttttatatgatgagaaaaccgaggcacagaggtgcagagtaacttgcccaaggcaacagctagtaagtagtgaagatggaatttaagccaagacggcccaggttggccaagagcaataacaaagctttagtttttaatcaaccactgatacgattcacttagtattttagagaccttctaggatccttctcagtgtggagataggcaggtatgtatctttacatatttatttcctctggtacctaacatgttttacactttttagttgtgggtgcatctctataaggaaatagtatccagctaatgcattatcaatctccctgccatggatcttttaaaggaaagttatcacctttatatgctctgtcatttcttttatattggttacagtcttttagaaggtgggagagtaggggtgaaaattagaacaccaaagtttagcctccaagaatctgtaaatctctgtaaatcctctaagtcaagtaattttggggctgcgttagtcaaggctgatttcagtgggtgcccttaaggtgaaagggtagcaatttatctactccataatgggttaatcaccagctgtacagtttgtttatatctaggaaacaatttaccacacatgaagagtagtaattttattctatctcaggggtatccccagtgtattttacaaatttactctgtaatgttatagataaaagtttaactctggctttcagttgaggaagtcatggtggaggaggatgggggaaggggaaggaacagctctactggcctgtaggggacactgttgcatcatttattagaattttccagtctattgtcccaggacaaaaaaaacaaaaccaaacaaatcagaaaacaaaaaaaaatagttgaatcaccttgaaaatgcttattagaattatttgaatcgttccaatgtgtttagaatgttcaggacttctcaggtattggtcagactgttcagtatccatgcgtgaaagaaataggttagtggttctttctgagacaggagtgtttgatgggactcttctgattacctttctctccatagtcaactttggatagggtgctcaggacgttactttttagtttaataaacctttaggtttagttaaccatcttcattttttattaagatatgctcatattaagttgttttgcttccagaatgtatgctaaataaatgtcccaatccttggaagggcgttttggaagttcctattgtcttctttttattcttatattttttttcactgaaaaagttgctgtttactgaaaaaatgaagtcatatctacaaggaaggcttatgtagggcctggtctgaactccaggaagcatatgaccagatgctgtgctacggctctctttccagactgttgacagccattgtatctgtccaggtaccccatggcctggccagcaaaacctccacccctctgcccagctctggcctctttcctaccagaatacgggcctgggaggcaactgcaatgaaccctcggaaagcataggttttgctaaggcagcctgcacagtaatgatattgttagcttgcttcatttccagtttcaccatcaattacgccatgtgtttcatccagttggtgctaccctcccagtgttaattataacctacaagactgttacagttaattttatggcaagcatattgtctcttcaaggctccagagcagctcataaattatcttgaaggtaaaatgtaacttggggaactagttatgaaaattccatccatctcgcttaggagctgcagctgctactgtcagctgccttgctgctgcactgtgaaggaattatggtgggtcaagtttaagagggtaggcccaggctgtcactgaggagaaaggctgtcctggccctgtcagacaagtaccttctgccaatccctggtggtttcactttgcaggcaggaagaggcaggcagcgcaggtggatggtccccaagctgtctgtattcattactttacagaaacttgttgtaggtaggcaggtccagagacctttcctcttctctgttgtcatgatgttaggcatcatctgcaaagtgtgagatagataactctataactaactctgggcttggttcaggagaggaggagaataagggggcggaagctattagtggcagcacttcccagccaccccttactggtctcctacttggtaatttctatcttgcaaaagcccctggcttgaacgagcattttatttgtggtggtgatttttcatataatctgataaagcgagatttcactgtggacgaatgtactcgaaaattgcctactaaataaattaacaggttatcttattgggataataaacacactccttttctatttcctcacacgaagtctaagctttacatttcagccctcggggctttagcattattatttttaatgactgaacacaagtctttcatttagcttgtttgtatagttactgtaaatgatctttctgctgttggtacttcatttgaaattctgcatgttatgctagctttaaaagctttgagggggccttggagaattgggaagctgtattaagcacagcatcttctagtggcattggaaacgggctatggcagaaaagtcagagagggtgtgttaagaaagtacgcctgcatgtataaatcaaagtctgagtttgagtgacgcgtacacaaacagtggtggtttcggtggcaggttgagaactcgccattgtaaagtaagagagccattcccttagctggtgatttctccttgtgtgtttctgagcacttttattgcattcacacatctactagtttttgtacgaagagtgcctcagatcattacactgcggctgtataagagacctggtttggagggatttgaaggacacatggaatagtgaattcatgtccaaagaggcaccgggctttctgaaggaagtattcgtctgagcttttgatgatgggggcatgagagttggatatttgtgagttttctagtgaatgctagtgaactcagaccagggattgcagattcagatgtctgtaggccatggtaatcatgtatgtagataaagccagagaggtgagacactgttaagttcaaggcaaaacacacgtgtgtgtgtatgccagaatctgcatagagtagaacaatgttacaaggtcacagaggcaatacccagattgtcttctggtctcctggccagcggacattcacactttgtctcaagtgggcagccaggcagctgctatccagccttgcgaggaggcaggatctatgttagtaggtcttccacattttcaacagaagtggaacattcatattgtatgtgtatgcttccgaagtctcacagtgatttaaatgttagcatgaattcaaatatttgtaactgttaggctaatcaaaacatgtgtggagcctggacattgtgggcaggattctgctatagaatgaaagtcctgactgctttgaattaaaaaccttctccatcttctcacacttctcaagaatagaaggaatgaccctggctgggagaccagtacacaatctgtgtattgcctctgtgaccttgtgaccttgtaacattgcattattccatgtaggttcttgcgcgtgagtgtgtatgtgtgtacgtgtgtgttgccttgaacttggcactatttcatctttccttttataaacaaagtatatgagagtttccaaaagtgaatgaggtgtatatggtgctcattgtcaccataaaaaggtgtccacaaaaatgttggcagttttgaatttgataaagggtttaattctcagaaaggaaggactgggacttattgctagtgaatcaccatttctcctgttacacccttgagctcctgctttagctcccatctcctccatgggggaacccagctgttctttcactgtagaagtgaagcttgaacaaagatgtcatgtggccagaatcatcttttagtctcaccactccacactgatggtcacatagaggtgtgagttgggaagttgttaaatacaagagggtttgagcttctggagaagaggaaaatgtaaaaatattttttcctttaagaaagataaaaaggtaagcctaaaccttggcggccaccgaagtcagctgttacgcatgtgtagttaaatttcactgtaaatatttcataagggttcttagaatggagccaggttgacatcacagccccaactgtaccaaaggaaccatttcattaaaataagccaacatttccaaagaaacacgaatgtctatggcagagttaacataaggtcagaaaatcctctggaagaaatttcggtatcaatgtttataatctctgcatttatggatttgcagtttgtgcaaaaaaaaaaaaaaaaacccagtgagactttattttggttaaataagactagcttgtgaaatagtctgtatatccagatccatcctaacccaatgccttggcagccttttggataaataatgtcttttccaaaatgtgtgtatttgaaaaaggaagaggaaaattaagtggcaaactgtgtctctgggttgccataaacgaacagaatccagaaacagaaagcaaagactgacagttcattcgttctttaaacaaattacatagctgtacgtttatttactgatgcatgaagggttgcagtgaagagcaaaatgtttaccctaactactttcattttctttttttggggggggaaagtaaaggtttatttaaacatttttttttttttggtgtgtaacacaaaatctatatgaggtttagaggcatttggcaggaaaaaaaaagatattcacatttgtaaaaaaaaaaaaaaaaaaaaaaaacttaatccatgctcacagatggtcctgttcaggtgctattttaattatgaggtaaaaaaacagccccacacagtaggaagtcgtcttaataaatggactggagcttttgtcttcaagcgtcaaaaagcctcgttactgagaaatttaaatactttgtattataggggagagtctcaaaatgaccaggatacttggagaaagcaaaatgatggattcttctaaagatcaaatgagtatacgagaaatgttttacaattgtatagctttgagcttccttagtattggtcattttagtgatattttttccagtgataaatgtcgtagatatattcatgcagccagaggaaaaataaacagaacaaattacaaatacatttaaaaaattttaatccacgtggaagtatttctttcctgttcttaagcgcaaagggctgctttgcccttcatgtgagagagtgcccagaagaactaatagtaattcaaatgatgcggtaacttacagcttgcattaataacacacaaatagaacagtcttcttactaaatattagtaatataataatgttttactgtctttcccatagtggggaattatgaggacctcatgttaggacctcagtgtcctgacatagttaattatccgtggataatggcttcagccaccagagttctcagtgaggcagctttgttgttgagggcttattaagtgtttgcagactcaggtgcggtgcacctaggctctttcctacagaagcaaacagctgtgttggctttaccgtattatacatcacataaagcatctcatttattataacgaagctaatgatgctagtggaaacctttatgtcccgttctatatagtgataatatatttgctgtaaagttgttagcttgtttttcgtaagtaattaatcttttcttataccaaatgtatcacatgaaaatgggttagcacagggtcaaaatacatttaaaccagtctgcagagattggataagacctttgaatagagcatcactttttttctttcacaaggacctcaccccgtctccaagctaccccccaacacaatgctcacattactaggaacttaggctaataacagggaactgctttcagttttttagtgctgagataggattcagacctgaatgtgtactaagccaagtaagcttagtgacagtcatccatgttcagtcccttaacaaggctgtgtattgtccatgtggataattttggtggtgggtttctgtctaatctacagtgactttgagtttgtgcctagggagactctagtgaaatgtgccaaggcctagttcagagagtcctgaagtagtgcgctgtgcgtggcacacaagatgattctgtgagacactgatgaatactttttatttgaaaatttatatgctttgctttttgtgtatatagggagacatttgaaattcactctcagcaattttgaaatcatgcactctattattattaactgtgttacactgctatgcaatatatctcaaaaactgattcctcctgtctaactgaatatattttacgttaggttagaaaagcataattagaatattggatccatggttttcaactaatattattgaggacaagactcaaatcaatcttgtttttttttttaagttgatttaaagaaaaatgctagaaatgcaataatgtgggtggttcatggatatggctaaaatcatgatagtggatcacatcatcaaagtttataaaatgctggccttataaactggaggggtgcagaaacatatgtttcaatcataattatgctattgattatgaagaagatgctgatcatcatcatcatcataataatagcagctaacctccactgagtctttactgtatgccaggtactattctacgtgttttgcccatattccttacttactcctcacaccaacccagtgaagtagttttgttttgttttctttcattttatagttaaggtgactaagacccagagaggttagggaatttactcaggatagcacaggttgtcagtggtcaagccaggatttgagcccaggcagtcagcttctggtgtcttcttcttaatctacttccttttgtgatagattaagaaatattattctctctctgttctctaaagaagaaaggtggagaagcaacatggaaacatgcaacatagcatatgataatgccatgattatccatgttttctgaagggctctaacctgtgcagctgactggaccctgctgagcctttggcttccttatgtagcatcctggatgtgtactagagcagatgacaagggtcagtggagcaaaaaaaatctttggcaacttcccatattttcgtacttagaaaagtatcataattcttttccccagtcactttaaatatatgcaagcagtatctaatcttgtgggaaactgaaagtgaaactctctagcaaagagcatggttatattccaaggcagaagagacagagttaacctatgaaaattaaccttgactgtcaacaaatgtgctgaaatgggtggaagaatacagcccacaagactgagatgtgggtgggaattggatctgccaggtcccagagctagacctaatgcacatgtttgaagttcttctgtgactctcgattaaccttgatttaaagttccagaaaaatgctcaagcaggtgagaattctcatactgtctttctcatttgatatttttctgagccaaagtgcctactttttttgagcggtatttatgactagttacattgcacaaggaaacttgacttgggtgaggtgttaaggtatggagaaatggataattgggaaacttagaaaacccgtccaatgaacgtttccaagtcaccctccccacgggcctagagtcatcatgaacaattacttgagaattgtgaagggctcaaagaggaaaactgcagaacaaaatgggttgaaagaatgtatacttttgtcatttcgacttgaagccaggggctaaaactcatgtcttacaccattgtagtctacaaccatttaatttgctaacaagacttaactgatcaggatctgcaacctccttctccagtataatcaaaacaagaagcatttggctctggaaagtaaacgttgtctatcttttattgtctggccccaccattttctttctggcaggctgagatgaaacagaaagctgatatttggagccactggaattgtaggccttgtaatttagaaatatccattttatcccgtgtaatttcttccctaagattcctcagtctaaatctgatacaggtaggagccaagacaaacagtaaccatttatagtcacccagaccagtttgaatttcactctaatgtaaagcaaaaagagtttttggcttcatttcaggtgtgtaacaggggtagaaaatgcatttaaaatttagcagcaaatgttaccatatgtttccataacaactgcaaacttttatgttagaaaagcaataatataaacacgtaggaatcttggaacagcaaactattaatttaccaaatataaaaaaatccagcatgaaggggcttttatagccacagaagccatgaggggcccagcatcctgtgaatttctccattatgtggcagaaaatgctgctggttcatttaaatgagcaaatcttttaaaattataggtacagtgtccattctccacagtgcatttttgtgaaacaatgtgtggtgatgccagctatggctgaattcttcttaccatattgaactagtaaaatacgcttcggaagctactcccaatgtatatctgtaaaacaacagcattttctaccttcacttatagcttcaaacttaatgacgaaggctagggtcctgcagaaagtgtagtgcccagtagttggccctaatgcttggcaaggagtagatgttcatagattgttgatagatatgaacaaggttctcagttttctcacctacccattttgaaatataaaaagacaaggggaaaaggggaaaggtggatctatttaagcacatctcgagaatgaggagttagtaagagttgttgaaatcaaattctctgttctctgatttccctgtggaacaaagaaataatcttcttttaacatggctacctgtggatgggcctttcatttaaaaggaggcagaactttttttttccctagacctacctcagagggtacatagggttttgaatctttactacaataaaaccaacaatgttaccttgtcatttaaggcagatggcgtaccttgactattcctgaaacttgggttcatgatgtcactatcattaaacatataccaatcaatgaagggtaagtaaagtcaaagagaaaagaaggtcaaagggaagtggctgacataaaacttaggtgcagaactctgggtgcacaggggatgcattcaggaagggtgctggtgtggctgcagggtagagagaagggtgaaatcttcagaactttagaaggcagagtaaagagacgacggtttcagctgtggcagggttttcaccttggcccctctttagctttcacagtagagcccatgggctgttgagccggaagtggtgcagcaggggcattggttaggaaggctcacgtcgttagtgggccaaaggagatggacgctaatgtttaaggagcctgaatggatctgagaaaacgtggccaagcagaagcaagagtgagtggcatgatttagagtagcagagatgggactggcaaaagaagagctgctttgtgaagacctgattcattcccaactctttggtggacctctatttttagagcagaaacctaatttcacccaagttaccaccgtctctaattagaccagtaagaaagtttctcctgtttctgtcagtgcttgaccacttctggagtgttttatcccataaagcattctttaagcattagtgccattggagtctagcattgaccatatgggtccttaatttgtatctgagtatccagttgcatgaagatggatggttaagaaaaaaaccaagagctattcatttattccacaaatatttactgaacacctaacagtgtccctggaactgggtatacaagagtgaacaaaaaaaccacagcctgtttcttgtgctggtagagcttacagtctagtggcaggaggctgactaaaaataagcaagcaagtaaaaaagaggatgtcagataatgacatgcactatggagaaaggcaacaggtaggcaattggggaggggaatggaactttttagggaagcctcatttaagctgagatgagggggaagagaaggaaccagtcaatatgacagagggagaagtaagtgagatgggatgagagaggaaggaggggtcacattttagggttggagtaaagacttcatcatggagtttgctgacagatgaaacataaatccaaattctatttacaaagtatacggaaagtttccactgtgtggccagtgctgtgttaggtgctgtggaaaacacagttcctctaatcaaggttatagtttagttgttgggaaagagacataattgattgtgagataaatgccaagttaaataacattgaccataagtacatcatgagctctttgaaataagtagtcagtgtgaattggggaagtctttatggagagaaagagggcatcaaaattggagctcaaaactattgaggctgggcgtgatggctcatgattgtaatcccagggctttggaaggccaaggtgggaggattgcttgaagccaggagttcaagaccggtctgggcaacatagccagatcccatctctacaaaaaaatttttaaataaaaattgaaaaaaaaatctattttgcacctcctatgtgttgatggtttgtgtgtatctttaatttttttccttgtagtaatcatacaaaggtgagtggtttcatccccatgttatagatgatgaaactgaattcagagaaagttaaagataactattgacaaaacttcagctcaaaccatttaacatctgagaacctaaaaatcactgaccactaactaaaaatatgacgggctttgagcatccctgtgatatttctctccctgtctctttctctgttttgccgttgatatgctaaatgtcagaaccaagaggatctgtgtgcttgtttttagggctgtggggaggaaagagtgctctggggagtggatggtctattatgaagcctgtctttgggagaaaattctccaaatcgagcaggtagtggcagctactaagtgatgaagaaagcagatctagtcactggaggagaagaggaaaattagtggaagaagtaggtacttcttccttaccttgtaaggttcaggagaccatcaggatgaaaagatcatgaagactattgcaattagaacacatctcaccggtgtatttcccacagacaagcagaaatgctataaaaggaggcataatacagtcatgaaacatctaaattttccttttttttttttcttcttttttattttttagatggagtttcattctcgttgcccaggctggagtgcaatggcacaatcttggctcactgcaacctccacctcccgggttcaagtgattctcctgcctcagcctcccaggtagctgggattacaggcgtgtgccaccacgccaggctaatttttttttatttttagtagagacggggtttctccatgttggtcaggctggtctcgaactcccgacgtcaggtgatccacccacctcggcctcccaaagtgccgggattacaggcatgaaccaccgcacctggtcccactttggttttagaactaaggcaaccctatttaaaatgtatttctataatatgtagatgtttgcttcagggatcctttccttagattatctttttaagggttggcctgggcatagataggtcaactttaagatgatcttttttcaattgagggcatatcccaataaaattttcttatcccctggcttgcccggggctggcatttctgacagacgtgtaaacagatgcaagcattgttgctaatgacaggtgattataagaggcatggaggccaaggtaattaaaccacgatttgacagggacatttggcaatgtgatatttcagcattagaactctctttgcaacgcacttcctccacttggcttggtgaatataattcatttttattcttcagagtgtgttgctttgagatctgaaactgtcctctctgaatttcttcatggttcattgtagaacgctagaaaatgattaccattggacgttgtgggaatctagtcagtatctaagaccctatccaaggttcgtccagtagtagtggaatagggtctgtgaccctactgctggcattgtatttgaatattattatgccctatgtgatagtgatagtgcctttggagagaaacatgagttattttcataccactctaatttcagtttctctgttacctggatttacttgacgttgttctcatgaatcaaaagatagcttattcaaatctcttcttccctaaatttccactactggcagtaggagaaatctcaaattatcagtaacctggtattaggaggaatgatagtagaaatgatcatcaagacatggaatttatttattcattggagttgaatgtaatttttttaaagtaccttctttttgctatcagtaacaatgcctctttaggcatttagagaccacctcctgctaaccgctaatgtggcaaacttatgaatatatatttgggggaatcctatcttctattgtttaaatagcagaccctcatggactgaatatttatagttttgatattgactagctacatgaattatattatttatagtgaacatagtagtgtggtttcatctaataaaataacaggtcacatttactatttgttatggtcctggcacttgtctaaaatagcaacttttcccaagtaggtcaatccattccttgactgcaaaatcagctttttaatactcttggtatagggcatgcgtggccattttaagagatcagtgaatcggcccacttagagaaggttaaccactagctagatagctgttacttttcctcgaccaattttgattttccccagaaagggatgtagagggaaatgaacttgtgagtatagtttcttatggcagaggagtgctgagtgattgtgcctcttcctgggttgcctcctccagcgtggaaagcttgggaacacttcggcgggcagcctgggaagctggcggccggcttttacattctgcttcaggctgcagtctgtttctaagcagaggcttttttaaagctttgtcagataggttaaaaggtgtcccacccccggtgtataaaaaagagagagcgagattaagcttactaagcctgccatgttccctgtaaaatatcaagtcaaaatgattttgaaatccaaagttaccaggcttagggggtgtgaccttgagtggaagcagcctgggaactgggaaggagagatctgtgcaaaagacaattggccacaggctggtggcctcgggaaagctgccgaagccaaagtgaattgtctcatttctctgccttgcagccaacagagcacaaccccaaataaatactcagcctgacatctaggccggtggattcaccatggagctccaggcagccaacctttctcagagtgcctgcttaaagcaaagcctgggttcagctccagcagctgatgggggtgaataagacagggtctctgccctcaggaagcttaaactcagaagaataccactaaaaattaaaatcctcattgaacccctacaaaagcatccaaatcctttgcatgtattatgaatgtgtttaatcctaaataataataatactaactagtacatattaagtgcctctctgtgccaagtactttttaagtgctttatgtgaattaactgttacaatggtaggtatgtttattatctctaattttaagaaaagggtacgtggagccaaaagatgtcaagtaaccttcccaggggcacaaggctgggaggcaggggagctgggattcccaagcaggaagtttggttccagagcccatgctctaggccagtggttctgtaattttagcattagaatcacctgtgggcttgtgaaacacagattgcaggcccttcctgaatgggcttgaatagttgcagtcctaacaaattctcaggtgatgtggatgcccacagctctatgccaagtgggaagagcacagtggaaaccagtcactataaaacaaggaaaagtggaacatcctgttactgatgtaagcagagtgctttgagaatgtcagtagtagctaataataatattatttattattattataattattattgtcattataactgtcatttattgagtgtttgtactggacacttttgtaaccatgtaaccattataactgttactgtgggtaatctcatttaatccacacaacaaccatatgaggtgttaactgtactgtacagctcaggaaactgaggcacagagagtttacaaacttgcctaaatgacaggccaaggattcaaactaccccagcctaattctggagcctaagcttttaaccatgaagaagatagtgaaaagaagggaatcaaacacccatccatagagcaggtagggtacaagctgggtcctgaaggaggaagatgcccaaaaaaggcttcccaaatggaatggatatgtgcaaaggcccaggggcatgaaggtgcaaagtgtgatagagagtgaataacatggagactcgtgtgtaaactgcatggcaagaagtgatgaaccgtaaggatgggaaagcaggttggttgaacagccttgaaaatgaggagtcaacagtattcaagactggacttggggatttttgaacctgtcagggacacactcagcctcaaaactcattttttgagacttccaaacagaatgacagtcatactttgttaaagatgcaatggggtcatctcttctctcctttacatagtttgagagtctcaaaatacgttcagagaagagctggatgtctaaggttactaaccctgtgacagtgaatcacaccctgccaggggaagggtattttgtacacagccacatcaaaaaaccagtgggatcatgtgtgcccagctgtgagtgtatccgtgtataaatccactcactacacttagaaaatgcctgccgtgcgtggcactggtgcaatggtatcgttggagctgccaacttgttttatttctgatagtgcttggcagcccctgaaggagggaaagtatgaatttttatctcccatttactagactttcattgtattgtgcttacagacacagtgtcagcacataaaatgttaaacatcactggtctgaaagaggctcccattgtcttacctctggtgctgggggaatcttgctagctttgctgtagtggttctgtcagtgtaatatgacatgaagcatttctcagtaatgacagacattgaatatgagtgacaggaaccctgaccacaaggaatgggttcaattaccagaaatgggggtggggggggcgcggttacctgagataaaaccaaagggcccaattgtgcttggttttgaccccttgactcccagatccagagcaaagacaaatggctgattaaccagcccctaaccctctttttcagtgataaacttgtttggatttctctgtccgaaaaaaaatctatgggtggcatggtttctaaaggaaatatgatcagaaacaggaggactggtgctcgtcatttttgtctcttgcaagcacaaaactgaaaactgtcattctatcttggactggatctaggacggtgtccagaaatcaatacaagataaatgattgctctcttcaccccacctttcttctgctgcagtgcctacattgctccagttcacctgtagccaacctgacgccagtgtaaatgagagatcctgccatcagaggctctccttttttttttttcccctctcctgcaggctgttctgctctgcatcgagtgcagctttgtgcttgtttatagtccactgcttacagcccccagatagagttatagcgagcagaccaattaaactgtcgcaggctgccctcacttgactagctctgcagagtcatttagccagcagacattcctgactattaaagctagtagcagcatgtctccagtgctggagataaaatgaatgaaatttgttattgtgggctgacacttgatcctagctgttgaactaatgctgttgcacctgaagtttttctttatggtaattgctgtctatgttattatttcatatactaaattggagaaaattgcaacaagtattaaattctttgagctaattcacgagagttctattgtgcattcttccaaggtagatcccaacttctgttgaagcctgggaagacagatgtagctagccagatgcactggcttgtgtttcatcattatcagagacatttcaatttcagatctggccaggcatttatcagctttacctgaaatctcttttaaaatacactttcgcttctaattcagtcagcatatgttgggatctaccctggggaattcagttatgatgaccaacattgacagtgatttgcgctagtctggctgattcagtgacagatacttggtggtatcagtaagtctctggcacagtatacgcttaggtaagtgggcagtgtgaaataagacttcccaccgggcacctttggaatccacagctctaactgggagtccttgaacacctcaggtagtaccacttcaatgagaacccatcagaacaggtacatgcaaggtacaccgcctcccaaagcatccgaatcactagtcctcactgccctgcccatctcctaatttctgttaactccttttaccagatctctttccagaattagggagattattttagacttttcaatataaaccatattcagagtttagtgaaatctctgaggcctctgtttctgtggtagattgcatagaagatcatttcttttacagcattcatttgtatgcttagcttgtggtcagagctcgtggtgaaggctccagacaggacccagaataagaattcaggcctggtttgtggtagaagtactatgcttgctttcatgttaatgctttgggaagacactgaccccaatcataacgttactttaatttctacctgaagaccacacctgacagacatagcagggctctgtcaattacagggacatacatctctagaaccccaagactttgtcacctccctactaggaaacagtaggctggttgtactccatattttgattagaggcaaatgtgagaggcctgaacgtcgaagtactagaagagagacatggggttttgttattatgtttcatcattctgcccccaaatttagggacagtccacagataatgatgcgtcctgcataagtgctttctctcttgacatagacaactgtaatttgaatgataatggctagcattagtgtctgtggtggaggatttagattgcaagttgaagtccatatagtttgtgaggtcccaaatatactgaatgtatgttggtctgcattatttctgatattcataacctttgtttaataaagaagctcttttaacaactcaaatctgctaaaattgaattactgtaatttgcagcaaagttcagcatgagaaatgtatattttctttccccactgagaaaatgaaagaagcattagtctttcgtttatatatgagatgggtagattatgtatagagtatcaagtttagaagatttattttcccacgctcaaatccaataggaaaaactggcattttcatcaaaactaaactaagactaatctttattctattttctgaaattgccaaatgtacaagttttaggtattttaaaacagtatagtcacaggcaaacattaacttgttcccagcggtccttcagatgcacattcattcttgtctttggtatttgaggatcctaatgataccataataacacaagtaaaagttgctgtataatagctgcatgtgtgcatttcagacccagaactaattctccatgtttctgtctctgtgtctctcaagcaggagtggtaagctcttctctccaaatcttacctggacttacttttctgtatatttgtgttattgttggggcctagattgacctcttttgtgtggacagcacagagaacatagggaagacctcagcatgcaagctgattgacatcatttggatctgtgtctctgaccaaatctcatgtcaaattgtaatccccagtgttggaggaggagcctggtgggaggtgtttggatcgtgggacagagttctcatgaatggtttagcaccgtccacccttggtactgtgtagtgagtgagcccttgtgagatctggttgttaaaaagtgtgtaccacctctgccccgacccttgctcctgatctggccacgtgacgtgcctgcttcccctttgccttccaccattgtaagtttcctgaggcctccccagaagctgagtggatgccagcatcatgcatcctgtacagcctgcagaaccatgagccaattaaacctcttttctttataaattatccagtctcactctgtctcccaggctggagtgcagtagcacgatcttagctcactgcagcctccgcctcccaggttcaagtgattctcctgcctcagcctcccaagtagctgggattacaggcacccgccacaatgcctggctaatttttatatttttagtagagacagggtttcaccatgttgaccaggctggtctgaagctcctgacctcaggtcatcctcctgccttggcctcccaaagtgctgggattacaggtgtgagccaccgcgcccggcctaccaatgtatttcttaaaatttaaactttaaaactgttttcctaagtgtggataatttagaatgggttgagctgatatggtccttcccatgtgaattataggcctttgttcaggtcagggatcagcaaactttttctttaaaaggccagatagtaaatatctcagattttgtgagccatacagtttctgtgacaactgttctcctctgttgttgtagttcaaaaacagccctggacaatatgtaaatgagtaagtgtggctgtgttccagtaaaactttatttactaaaagaggtggcaggatttgactgtcaggccatagtttaccaacccctagttgaggccaggaggaagggttatgtttaagggaaccagaacacaaccaatatgttgtattcttttttcatttgttgttcatgtaaattgctggtgagagagatgttctctcagcagaacttgaaaccattttcattggctggggtttaatatttttttaaatctcttgtttaagcacatactaaaagtgtccatgttctttccattaaatgtgttggttgccttcccagacttcaaattgcagtgaatttatccccaaaagatgtttggtatcaattctcaagatgcaatttgaatgtagtctgcttctataatggaaacagtattccaaatcttcattatttaagtttcatagaaaataatgaatcattgaattggttattactcaacattgttaaggcatatactgaattctttgttttcttgtcttatagccttatatcagctcaaaggataaaatagtatgaagatttcattttatggatacatatgagacattagattattattttctagctaaatcgtggtaaacacaaattatattataatgaagcttttttcccaataagcattttataagaggaaaacctgaaaacaaacaacaatcagcaaaaagtttatgagtcattcaccctaacaattgtaatagtttccttgttactccattcctgtagtgatgaaccccccgccctttttttgttttgagatggagtctccctctgttgcccaggctggagtgcagtggcgtgatctcggctcactgcaacctccgcctcctgggttcaagcgattctcctgcctcagcctcccaagtagctgggactacaggcatgcgtcaccacgcctggcttgtttttttgtatttttagtagagacggggtttcaccatattggccaggttggtcttgaactcctgaccttgtgatccgcccaccttggcctcccaaagtgctaggatgacccccttttataaaacgtcccatcatgttagctccatatagtagggattagtgacatcaaattctttttgggaatttatagtggcactaggggtagcagtatcatttaactgtgtggcatgtttgggtaggtagcttttctgtttaaaagtaatcacccttccccacccaagggcaactgtactggggatggaggagaggtgtcagcagaaattgcattctcaacatctcaacttccttgctccctgcctaagtgcctcctgaaccatcagcttactataactaaagtttcttgtgttctcttgatttatctcatgctgtacctgtgaaatatttagttaccctcattctctcttttctctctgttttctagagcaacgacatagggcagtggaaaaagaatgagttttggagtcaaaacccctgttatcttggaaaagccatttaacttccttgaccttcagtttcatcttgtgtaaaatcagaataataatgccaaccttatagagtaattttgaaactttttttttttttttttgagttagagtcttcctctgtcacccaggctggagtgcagtggcacgatctcggctcactgcaacctctgcctcccggattcaagagattctcctgcctcagcctcctaagtagctgggattacaggcatacgccaccacgcctaactaatttttgtgtttttagtagagatggggtttcaccatgttggccaggctgatctcgaactcctggcctcaagtgatccgcccaccttgtcctcccaaagtgctgggattacaggtgtgagccaccatggcagctgtaattttgaaacttaatgaggatgtatatttaagtgctttgcaaattgtgtttataatgtatttgttatttttactgtttaattgtctgcccctaccctgttctggagaatcttgtaccatcattaaaataagtaaatccatagtgctattaatcttggaacattctatgtggaattgcccatatgaaaagcagtttgattatgacagaatgccaggcagcagtgttcccattgtgttgaataaatggcatccccacaatcacaatctcaaataccaaaatcaacaaggaaaattccaagcagctgcctttataacttctgatttgtgggccacatttgaaaccacagtttgatttctcagtctacaacattttaattcatagagcaggtctttctctattagcacattctcaagatcttttgttgatcttggtttcagttgctctggagaacaactgccttccaaagctcccttttaaagtaaattttctttttaatagctaattctatttagaggtggaccaagccaagaatagcctccaagttcagtgaccatctttgcagtcatatacaagtgatgcaatcacaaaaagaaagaaacttaattttatgccgctagatatgaaagacaggtagctatgaatgcatggctccaggaccttctgccatgtcaaatgagctaaacccttccccgaaagccagccaggaaaacgtatgataccatttgcaatggtagaatgttgcatgctgttcttctgtaattataatggcctgatccgtgtggagtgggtgagtcctgcttaacaatcgttaatctactgagtcttcgtatcagcctcccatcttgaggagcagcagttcttggctggatgagtcggtctttgatttcattataataaggatagctttgttaaaattccgctgcgcagtggtgcctaaggattctgggaaaaggtttttctttttattttcccctttttttgcacggtggggatgaattgtttctctctcttccatcccctaggttactgtttgtgctctcccttgatctcctgcttgtccctttatttctccacgttgtgaaagtttctttctgtgtgaccaggagtctgtttagcagaccatattgtgagtgaagggccagcgtttgttgcctgattttggcaacgctgggtagtcagctgggatgtaattaagactctgagaacaggctgtcttctccacgggaagggcatgttagatggtgctgggatttggggctgtcagtttggccaaggatggagacagagagctagggacagagatatttcctttcatttataatccctttatgtacagtgtgtgcacttggcaaagtttacatataacctagtggctagagcttacaagccaacgcagtgaaattagcatatgttacatgtattttttagtaatattttaaagcaagtgcatatttccaaagtgaattatgcatggatgacagcaatagggttgtgttgcactgggtgtcaaatcccacaactttttgtcgagactgtgggttttacactaaaaaggcagaaagactaaacgaagtaaaacagttttaatttttaacagtttggttcggcccaaggagccgggctgtgacagatataactgacatttgaataattggattaatttagagaagggcaaatccggttttgacggttgtgcttgtgtgtacatctttttttattattatttgcaggaatggagttgtgtggtttaaatatacactttttgtgctgcctagcaaatcttgagaaaacatcacaaaatttatgaaattatcatttaattaatttgttttaatttatatgtatgtatatgtgtgtgttcacatattatgcagccttcatatgtatataaaagaaattcaccatatatacttgattcgggtctatcagtgatatacatatatacacattgcacatacaagcacattgtatgtgcacttaggaacttagtaaatccagcttgagataatgtgcatgacttcataggatgtatagaaaatgtgcagacaaggaagctcactgtgacattggcaagcccctttcctccccatatcaatgtgttgcaaaacatcacagtgcagaagcagaaaagcctaatttggtatctggggtatcagtagccaaattctacatggttgattcctcagtcctaagttccttcagattcatatggctttttaagtttcatatatgaagataatcttggcaacataaaaccaagtacagcaccatcatcgccaccctcctccagaaattctggtaatgaaatacaccatctaaaatcagcaggccaagtctaggactcgtggcaggcagtcttgaattgtggctgtgggctggctctaagagccttttccccagcaggacattaatagacattaacactctcggacaagaagtgttgatgtgtggtttataatgttagcacccagttaggcaggtataacacatgctgtaggaatcttgtaccaacacatgtgtgtgttgagtcagattaatgagaaccataaaaggagagacatttcacttgagctggggacctcatcctatccttttaccaagtaaaccagtgctcagctgggtggcagtgtcctggtgggatgttttcaatattagcataaggaggatatttgaaagttttgttttgctttgttgttatgtgatcatgaagcccaaactgttagtcagtacagcacattcaaactccttttcatctagtactgtttggctcagaggaaaggaaactttcacgatattcacaactacactatggggcaaaagttattattttcctctctcagatttacctgacccttcttcaagtgtttctgaatgattctgagacactttctggtttactttgtaaatggggcaatgaagcattcttatctcctgactggttctccttagagaattctcaaagccttttaaaattgtgtgtttttctggggcagccttgaaagtcccaggagtgaagttgccatctgtcctttatattaaaagaatcttctgtattgtatacctgatgtgcttgtcccagagatagatattgttaattaaaggacagcatttgtcctttatctgaaataactctcttgcctgaataacagtttcccaagccttaggaaacaggtaaggacattcggcccagagccctgatgtttactaaaggtccttggtccaggagctgtccctcagccttcactagatcagacatgtagactagaaaattacttgcttattttttggggggggcttgttttctattaattcatctaccaacattatggccttttgcatgcgtgtaagtaaatgaacataatatatactgtcattggtagtttgtgctttttttgtggcgactcacaaacagcgagttcccagacattctcaccacactgcatctttatgcaatagatgtgacaggacctatatcctccagtgtcacctctctactactgcacactctctgtttctataccttctgcccctgggaaaagaaaaatgcaaacatctgcctacagcaaacagagccagagttctgccaggtgatagctagaatatgtatagggagaaagaaagcctcgcccgtaacctgctctatctctgtctcaggaaacgcagaaaataatttgtctctgtaatatagaaaagcagttagggtaacgtggctgtgaactgctgcctaaaagtgtgctgtgtgctcgcctctgtagttgctaagcacggaggaggaggctagccagggccttgccacagactaacttcaagaaaagaggaaaagagtgcaccagcagactctggactgaggagcatgtccaacggaggaggcgaggtgtggccaatggttcttttgttgataagaaagaccctgaaattgcctgttgcatggtgaggagagtagtagattggaccgtaattttctggtgacctaacaaaccaaactaaagctcaagtttaataggcaatgattcccgtttaaaagggaattcaaattatttacagttctccatcatcatttgcctcccttaatcatatggactaggaattgggcaggtgacatacaagagggaagccgacttgggtgaaaaacaacaggggctgggcgcggtagctcaagcctgtaatcccagcactttgggaggccaaggcgggtggatcccctgaggtcaggagttcgagaccagcttggctgacatggagaatccccatctctactaaaaatacaaaaataagccggttgtggtggtgggcgcctataatcccaactactcgggaggctgaggcagggagaattgcttgaacctgtgaggcagaggtcatagtgagccgagattgcaccattgtactccagcctgggcaacagggcgagactccatctcaaaaaaaaaaaaaaaaagaaaagaaaaaagaaaaagacaacagggatggtggtgggtatggcaaacaggtgggcacttatgctgtctacaagggacagttgcttccaactccaaacagttattaccttacagaggtgtgggcccaggattgcaagactagatttttcggtgaaagccgccagtgtgacactttttgagttttcagtgttggcagataattcactgttttaaaacatgcagataaaactcaactgtagttggatgtactttacgggttgctagtttgcacacacttatatacataatgcagaacataagtgggaatattctaaataatagacagtgtggaaacttttcttaataatagtaagaaactgagccccaaacaactattaatatgtttagatgtttccctttgggtctttatttactgcatatacattttatatacatgttttaaaatagttgtaatcataggagcctgtgatttttcacttactgttagaagcagtttctttatatgatttataatggctactggatattccatgtagaggatgtattacaatatgcaaaatcatttccttattgttggacctttaagttgcttttgatttaacatagttataagtaatgctgcaattacatatttgcttataccgctttctcctttttttggattagatccttagaatctaaaaggaagattactaagtcaaaagatatgaacgtttttatggcttttggtacatattaccagattgctttccaaaagcgttgcaccaatttacactgcaatcagcaaagtatacatttatccttgaagcattattatatttttgaggtttttccttctaaactggtaggtgaaaattggacttcattgatgtttgagtttgcatttcttgaggttttcccgttaatctgtcgactaattgtatttgttcttacaacatctgtattttctaaggttaaattttgtggaggttttgtttgctttgtgtatatgtgtgtatttttaaagttctctttataacaattgataaataatttgggaacagcccccttggcaaggccttcctctaggggaccccctgtctcagcagtgctgcagctgctacttttaactgtgtgttaactcggagttgggccagggcctaagcaggatccccttcccgaagaggggctcttttgtgtctggtgaaccacaagctcagggctgtatctgccaatatgtttttggcagaagccatctaataaaatcccatccgcgctgttctatgaaatgcagtcacaaatttggatgatgattgcctgatgccatattttggtaacagctaatctccatgtcttagatggtttttattcattgcctccccccttccctccttcaccactctgcttggtgcatgttttaacgacaaatgatgtataatctgagtttcatgtagcatggtctaatggaaaggcactgagccagtcatatggagacaggggtcctattattggcactgccctttgcttaataatagcttaacaactacaacaaatatttatcctgtgctgaaatgctctttcagcattcttcatgtattcttgaatcttcctaacagtcctgttagacaatattattatcctcgtttaggtgaggaaactaaggctcggagtattggaaatttccagtacttgtattggaaagtatgatattggacaagtattttcaatacgtgtgttgaagatattggaaatacttgtccaatatcatccttcatctctctgaactaaaaatgagttttttatttctagtaatctgtctccccatctgcaaaatggagttgcttctcttcaactcagaatggtggcatggaactaaaatgatgccatgtagatattaagttgccttgagtattgaaatccaagacaataaattggtaataatatgtagttattaactagttcacctctgtgactctcagcttcttcattaattaaatgtagggactgaaccagattcatttcattggttactttcagctatcacattttcccatcagccacagactcaaatgttggtggataaagcctgcgtggttcccagaggctgtgcatactgcctacatttcaatcagctctacattttaggtacatccatccctctcagctagtgttcttaggaagaaaatgcaaacttttaggaaggagaaatctcactcttcagtgtttgtggagagtgcagggaaattctcttaatggaatagtagagataccattgtctgacagccactgtaaagccatatggagctgcttgcttttggctctggagatattgtgacctcttaaaatatatttttctaaaaaaggaacatgccttatttctgtttttctttatacttcatccccaggtaggaatttaaccaagatggttaacggagaaagtaaggcattgactcagctccatacaaaaatgcattctggcttgtttgcataaatatcacagaaaaataggggttcaggatcccatatggcacttagcctcctaagcaaagatcatcagccatagacaagaagcaggtggcctggcatcgagagcagaggttatttttgctgctgggctcccgccatttcagagtttaacagtggcaagtctactcagcaggaggctgaccccagatgctctccccttgtcggacatggagccgtcccatgtcccacctccactgctgggagtaaacctgatcaaatctaggccacagttagactcccagataagtctctgtttaagcttattcccatttgctacttaaataccacttccaaatctgattcatttggggtgaagtcacagacttaattgttcacccatcctgggtggctcttgaaagcctgtgataatgatatcttggcattttcttttaggtgaaccctagtgcaacaggttggaaagggctagttttgaggatagtgttagagaccagaggtgtggaaacctggattctgcctctggttctgcctctccctagagctcagtctcactgtgtgtaatatgaagagatttggaccgtgtctggggtttcaaattcagttgccaacagggaagtataaaaaatgaatgagaagggaaaagaaaggaagagggagacccagtggaaaggtgcatgagggaactttggggcgagtgtgaaaatgcatatcgtgattggttgatggttatatgggcatatacatttttcaaaacttgtagaacttatactaaagatctgtccactttaccgtatgtaaaataagtgtaaaatgagtgaaatggactaggtagtaaactgcagagcatatacctcatttaaaaggggcgaatgataagctctagccaatggcttctcttcagaatagaggcccagtgttgctacattttcaagtaaagccagaaattcacatatttatataaaatctcaggatatgtagatttatgggccctgcttggtcaaacaaaatgccagttttgtgatctctgaactttgggcttcttaatttgagtctgaggatcattttagcttcaacattggatgatgccgacttgcggtgagacctcagacaaaaagattaaacttgcctacacctcagtttttttcacctgtaagatgttgataattcatgactaatagtacaggggtctgatgaagagcatatgaggtaccttgtacaaagccactttgaaacatgaataaataacataaaaatgcaagtcactattaccttttttattattataaagaattatttccgtttttagaattgttattgttcagaattgaagcactaaacttagtaaagatggctaataaaaacatcaagattcaccatgagtaaatgacttgcctgcaaatgatcatgcaaacctttcactatccttagaggggaatgtttctgttgtgtgtgacaagaagaaaaggcatttcatttgtacagctactcatataaattgcaaaaaccatgggagctgaagtccaaggtacagcaatagcatataacgaaatgaacttgatgctgtattaaagattctttgtcacacgcactcactgcctaggagtcgtaatgctcccagccttgtcactgacattttgtgaacaagcagcctgtattggatggtgataaatggattatcttaaatgtcattctgcactgttttagagttgcaaagagagttttgatattgagtttttggttagtatattctgtatcaatcctttctgatgaaataatctcctcaagttacatccagaaatgtcaaagttgcttatttcttcaatcacccatagcaatgtttccattacaacgtatgcagagaagattgtgtaataatgtcaaactatttatagaaacatttcctaggaatctctactctccttgagttgtttgtgtatttaatactagagatttgtttttatatgtatatatatatttctatttctaaattgacttcagctgaggatgttgtactttagtttttatatagagcacattgaaaacttggtaatattagcattcgacaactaaaactaaagccacgctaacattttgtaaatagaaagagtcacgtattttggttttaaatattgtaagtttttttttttttggtgttgcagttgcagctgtgtcctaaaggttgtaaggttgttatattcataacaaatttaaacctatttatttagtctaaagtagtatggaatactttgcccaaagaagttttcatatttattttatgctaatttctccattattttatctttaatattttttgactttccaaatttaatacaattattgctattacacagaatttagtcatttgtataaagatttggtctggtggacttgtgtggaaagaagcacaaaatagattttgaaagcatatctcacattttacttggcaaagttattctaaatattggctttcttccctaaagataagatctttctagatacagatattgaaaatactcagttagcatataccgagtggctcccttcagactctctgtactctacgaatcttaccctcatcctgtcattctacagtcctcaaaaaaaaaagacatgtaatttatattttaaaaatccaaacaatataaataatattagattggaccatataaaattactattttttgtagatccaaacagtcacataggagcaattttatgtggctcacccaagcaatgaagatttatattgtatttactacatgccaaacatgtgctggatgtatatgaattcatatactgattatagcaaccctatgagtaggtgctattatttcccctaacctacagatgaaaactttgaggcacagattgattaagtaagtatcagaaccaggcagcctgccaccagagtctttgctgatcatcaggactctgtgctacctctccaaaatagcaaagttccctggctctcccaccccagtgtagtgcttttcactgtaaaaatttaatgatgtctttcatcttacatgtcttaatgtgatattcctttcagctattctaatcaaatatattattcttttctcttacagtttttgtgcattatatctttcttaagatcaactttctttaaaaactatgtttttaaagaaattcactttaatggaattctgatgctttcatagttttgttttcagtgtttacctatttaatccacctgaactttacttttgtgactggttgttgagtagggattaactttattattaggttttcaaatggacgggcaattggcacaacaccttttatggaataaaccattcttgcctccactgatttgaaaagacacttttatcatatactaaatttgcagaaatttatgtgtcaggtttttttttgcctaattaccaaaactttgtgtgtttttagatattatagggccttccctcctccattttctttttagaaaatttcgttaactgttttcatgccctttttgtcagatgaatcttagattccgatagtcagattccataaaaaattttaaatcctgttggcattttaatataaatgcattgaatttataggtatatatgttggagaattttttaaatgtcacctcatctattaacatgttttatttcttcatttatttatgtcatcttttgtgttcttaaatgagttttaaaattttcttcacattctcctttatttctagatatttgtgtttattgctgttgtaatggaattacagatatgtctggtagctgttgagtttttgcattcatatagttaccttactaaattttattagttctggtagtttttcatttgattcttctggaatttctaagtaaggaattaaataatccaaaataaaatgatgttgcctttctctctccaatgtacttttgttggtctctttttcctgtcttggctgatattttttggaataatgttaactagtagtagggataataggcaccctttgattttttttcctgttgttaattaggatatttcaaaagttttgcagttaacctggagatttgctgagatttctgatcaatatcctttattaagtaaaataattcttattctctttaattctctttaatggttgttgcatttaatcagatattgttttgaggggaggaggttatctactgagatgatgacatgggttttctcctttgttctttaaatgtggcctattacattattggatcttatattgttgaatcatctttccatttctgaaatagagcttactgtatcttgaggtaatatatgcaggaacttaatttggtgacattttatatataattttctataggtgatatttttctatagcagtattttctgatgctctctgaccctggttaacaggtctcagtagaactcattcattcctaacatttctgtgatgttactgttttgaagcttatccaaagcttgattggcttttgattattttagcattaaggcttttgcatgcaatttccctcaaatctttgaagtttatttctgtttatagctttccttaggaaaggcatgagtttactctttcaacttttttgctcttgcctcctatcttctttatggggagagagtatacatatttctttgaagcatgatgagtataaatatttctttgacatctttatgaaacctggaattgtctcttttcatttggaaagaaataaacttttcttgctcatcattctttatgcataaaactatagttttagttagtcctgatttatatgcagtgttcccctagaaagagatatttatttatttatttatagacagggtcttgctttggtgttcaggttggaatgcagtgctgcaatcatagctcactgcagcctcaaactcctgggctcagaggatcctcctacctgtctcccaggtagcaagtactacaggcatgcaccactatgactggctaatttttaaaaaaattttttttgtagagataggggtctcactgtattgcccaggctagatatttagtattttataatgagaaacagtgaggttagagaagacactattgtttcattttatgcatgtatgtcacccttggcaaatatcactaatctcgatgcacattttccttctaaacttgtatatagccttcttaacatggcacaccaaatagttactaccaattgattggtacttgcaatttaaatgagacctatttgcaccccctagtatggaaacagcagtctttggatgccaggagtcctaagctttcagtctctaatttgcagtgtgaaacatcaagctatttcaaaatttaatcttagttttcacagctatacaatgaagagattaaactggataatataatggattttctgattctgtttacatatgctccttcattatttcagggccaaacatcgttttaggttttgtaaattacgactaaactgtgtatttgtaactttattattactattttgttgttttcttgttcatttgtggttttgagattgtaaatacatctgccatttagctaattctcttttgtggccaagtactttttcttacttttaaaattaataaaggctcattgtagaaaatttgaaaattgtagaaaagcacaaaaggaaaataaaaattacccataatcaccgggtgcggtggctcacatctgtaatcccagcactttgggaggccaaggtgggtggatcagttgaggccaggagtttgagaccagcctggccaacatggtgaaaccccttctctactaaaaatacaaaaattagctaggcatggtggcacacgtgcctgtaatcccagcaactcgggaggctgaggcatgacaattgcatgaactcaggagacagaagttgcagtgagctgagatcatgccgctgcactccggcctgggaggtagagcgagactctgtctcaaaaaaaaaccaaaaaagtacccataatcctaccacccagaaggttaacatttggttatgattagaaatatttctgtttttaaaatcgttatactctttttcatagaatattattacatacatcactgaaaaataattttcctcaatatatacaatcatttatttttatcatatctctttagggtttcacttttaaatattatgacagacatccttttataagaatctttgaggctttcttgaacagattcctagatatggaattactaggtaaaggagagtgtacattgtaagttcctaacaaattacaggttcttgaaaaatatatctggaatggatgtttgaataaaatattgccaatttgatttctagaaagatggaccaatttacagattcatcaagagagaatgcctctcccatctcaagtttggcagcatggaatattacagtttgaaaacatcttttccaattttatggactaaaagtaacagaatttctttatcactactgtgattggatcttttttatgtttatggctgtgtgtgtgtgtgtgtgtgtgtgtgtgtgtgcgcgcgtgtgtgaatttcttgtcctctacattttccccttccttttgtggcgtacatgttaactgttaacagctgcagtgcctatgagctcattatcaaagtgttgctccataatttacaattatacctaactttgggggcaaaatcccaatttggaggtcaaaaagagaccaaagtctctgtacatctcacatgactttacttgcattaactttgccttcctaaattacagtctataattaagaagtgctagtctcctggccagctcttatggttatttttgaagctccttgggtgcttgcacccttccagagggctgttactttgccccctctctggaagctcatttgcttccacaggaagccttaagccaaagcacattggcttattcaatctggtgtctggatcttaaaacctggcttctcagtttatgatgctcaccagtaaaacactcatggctcttcttgccatgaagcgaaccaggcttgcttagcttagcttcatgtgtggccttcgtgaatcaaaataagaagaaggtagaactagtcccacccttaagtcaagaagaactggttagtcatgaagtgaagccacatgactttgctcttttctattatgtcttctaattgtttctgacaagaatccctggatttctctcacactcttctagcttgatgctattgggctccttttaccgaacaattgtgaaattagtaactaacctctgcttgctgatgagattgtttgacagccgtttgctacctggaaaccagaatggctggaaagagacctgtttatgcatttttcatgttaaatgctaggcaaagaggttataccctacatgtggactctaagctaaggaagctgacacgtggggagggaaaagggctgaaatccaatgcatacgcccctcttcaatcctgggagattgtatttgcccgtcagaggcacctttttctaatttgcccagaggtgctgaaaaggcggctgaggccctgctcaactgcctgaacaacttacagaagcacctctccttccaaccaggttaggatccaaaaagctgtatgtaaaacctcttgtttataaatccaaggtggcattaagcagccactgggagtatgatctgttagggacaggcttttgctccagtatttaggcttgttcttatcagtaaatctaaatagaaagttcctaagtaaagaagcttccgtatttaaatagctcaaaatacgacagccttatttttttaatagcggcattgtttctctttcccaaagcaaccataactgagacaggattagatgcaaaaaccacttgctgatacagtttagaattgcaaaattctaaattccaacagattcatattatacacaagtataaacagagtgtagccagttttcctcaaagagataacatgggttctccacagtatttttgacccaacaagccattattaaatttggagagaaatttttgcctgggaaccttggctcacacctgtaatccagcattttgggaggctgaggcaggaggatcacttgaggccaaaagttttgagaccagcctgggcagcatagcaatgctctgtccatacaacaagtttaaaaattagctgggtatggtggtgtgtgcctgtaggcccagctaatcagaaggctgaggcgggaggatcgcgtgaacccaggaggttgaagctgcaataagccatggttgtgccactgcattccagcctaggcaacagagcaagaccccatctctaaaacaaatgggagtagagttctaatggcatccaaaggtaaaggcccatattccctggtgttccccaaatcattgcaacaaaaaagcaaagccatttaccctctaagtaatgtcagtaaacaatgaaggaaaacctgaagccttcctgcttaagagccattctgaggcctggcatggtggctcacgcctgtaatctcaacactttgggaggccaagacgggcgaatcacctgaggtcaggagtttgagactagcctggccaacatggtgaaaccccatctctactaaacatgcgaaaattaggtccgggtgcggtggctcacacctgtaatcccagtactttgggaggccgaggcgggcagaccatctgaggtcagcagtttgagaccagcctggccaacatgatgaaaccctatctctactaaaaatacaaaaaattagccgagcgtggtggcaggcacctgcaatcccagctcgtcatgaggctgaggcagaagaatcgcttgaacctgggaggcggaggttgcagtgagccaagatcgcaccactgcactctagcctgggcaacaagagtgaagctctgtttccaaaaaaaaaaaaaaaaaattagctgggcatggtggcatatgcctgtaattccagctactcaggaggctgaggcggtagaatcatttgaacccaggaggtgaagtttgcagtgagccaagattgtgccactgcactccagcctgggcgacagagcgagactctgttaaaaaaaaaaacaaaaaacaagacattcttagcttcatttcaatatctccatcctaagccttagagaaaacttcagtcctcacctcaccacattctgttattagaaggcattaagaaggaggtgttctaagttcttctcaaccttattgaggatgaaggtgaagggttgtacccttacaatagggcatggtatacctccaatacacctcttttcttttgtctgcccatgtttgtgactatgatgtcctaaagcactttatgtgagacttagattttcttttttcatggtgtaagttaaatatgaagtaatcttgattaggccttttgttcacagaaccaatgaactgatgaaaaccttgatgatattcatgtgtctaatgttatcatcggaggggtttcagtgaaacagcttaactttaggttcagagaggtttcattctcacaccagatccagaagttactattataatacctgcttgcatgaacttgttcatggtactcactggtacaaatttatggcttcaagtgatagaatgctcagtaatattgccctcttggaagctgtgcccaagaaacttagtttcctaactgggctctgcagctgttgaaacttcatcacctttcacctgaatctctacaatgctttgcaaatgaggagctggtgagaaaaatatgcagctcgaagctggcaaagttttaagtgggtaaagcttgcagtgttaagatcatagccccaaattacttaagggcttctgctaacatgaaaataagactcttgactgctgagagattggatattcagatagatttttttatgaaggaaataaatatttcaacatgcaaacactacccaagcgggtagtgatgcttcaaaacagggtcagaggtcaggtttttttctgtttgtgttttttgggatggctccaagtttaaaggtattacacatcactacctaccccgagcctcacatggtaaagtaattactgctagctagcggaaaatatgtacattcatttttatttccaaagatcctgagatttctctctgcgctttttgtggtcctcattataaaaaatatatcatgaagaatgatggtttttctccatcctaacggtaaaagagtcaagctgaaaatgcatgtctgatactcaacttttttaacaaacttaattttggaggaataaataagcatagaatgtatttattctttagagaatagtagagttcatttttatagtttgcctttaaaacatgcaacagacccctagggtattggataatttttagaggagatgctgacctggtggtcagccattttgacggaactggggcccaggatatcttcaggcaagcataaagatgtgtggcatacattgttctgaaacttaaacactgactttctcagtggagtggaatttgggtgactgttggaattgctaaacaggacttagagtttcagaaacccttttctctctgccttcaagtagggaaaataattatttgctgagcaattaattcgaattcacaaacacacacacacacacacatcagatatggtaagctcagatctctgcagaagccggcaggtaatgtcaacgagtgaagcaggggttggtgtaatacattagggagttgtggggacaagaaagaactagaaagcacacccccggtctaagaggacaaccagcactctgctcccagccagctgctgccatgagagaatatgggcccactgttgtgtacggctcagggtttttgttttctgtttttccaaaagaagccagaaatccagatgtttgtatgaaaggtatttttataaaaattttgacaactaatataaaacactatttgaaaatgtatttgagggctagctttggcctacaagccactaggttgtaacttcagctttcaaaaattgcaaaaggtagagccagctgcttagtggccataccttctcattctccaagggaggtgtttggagcctggtgcattctaaacaatgactgttctgtggcttaaaaccctattgtgaagaacacagttactctgaaattgagggcagcttgtctcatttatatcatttctttttagtgacacagatccttcgttaaggccaacttttaagggagtcaagttgcagaaaagtttacagggcataaccaccctcaccttgcttttcttactgacttttaaccatcacaaagtaattactttccctcctctatccctcccttggaatgggtctttttttttttttttttttttttttttgactcactctctcgcccaggctggaatacaatgatgccatgatggctcactgcagactcgacctccccagctcaagtgatcctcccacctcagcctcctgagtagcagggtctacagcgcccaccacgatacctgactactttgtatttttttgcagagacagggtcttgccatgttgcctagcctggtctcaaactcctgggctcaagccatcctcctgccccaacctcccaaagtattgggattactggcgtgagctactgtgcccatccagaatgtgttactttttaaagtacattgtgaggcaggacagtattcacattgcctttcccagagcccctaaagcatcaactgaagatggtgtccctactgcagtcaaacagaaatgctgagtaatgactggtttaataatgatcagatagacgagaaaaggccttgactaagtcagtgatattgggatatgattattttaattattttaatattgattcttttggtgtcttttggattgtttagctgtcgctttttctcttggcttttgaggtttcaggacacggagtaaaatgatggaaatgtgtttgtttttcagggcagagaggagtgttggtaagtagagaaattacattgtgtcctcagctgccattgatgtccttccaaataggtgaagtttagtttaaaacctgccgttaatttctggcctctggcaagagtggtacaaggttacctgtttgttccagtatgtgtagggaggggctgggggttggggagagagaagggtggcaattagtcaatgacatttatgacccatttataaaatacaaatgaaataattggttacaaaatcatgacaagccttcacttgtcttttacaaacttgttctcaacacactgtgaaacttaatggacaccctttgtagaaagtgaggaacaacagccattctgaagagaccgattcaaagcgttcaacctgagactagctgtggtggcgaagattctctgagtatgtttctcattctcatctcagatacccgcattattatcgcagatccagaggcagggaatttgtagattcctcagccagggaattgccacagttttggtgtaggatgaccagacatgagaaagaaaaaaattttcccacaaatctttaaatgcatgggaccctttggggtctttgctgagattagagcactgtgtgtttataaataaaagaagaataaacaaaggcagcatgcactggcagtcccctccttcctgccctgttaaaatgctgtgtgaggtggcatcgagaaaatgaacgccaaggttgacaccaaatgtagggcccgagtgatttttctgtttttcaaatccgctgtcagttctccacctctgactcttagtctttttctccttccccacctctagagagaggacatttcctgagtaaaatgaaaatcaaagctaggagctaatcatatttttaaagtcagatatgttgggggtataactggaagctaatttttaaaagaatcctgccatatctttgataaggaagttctatggcttaaagagtgtaaccactagttttagcagagatgtttcctttagttttgaaacattcttcaacatttcaggttcatgatgaaaaatggctgactggatttaagtcctttattttctatactcctgagcaaaattctgaaaaactggctggtctagtttagagaagaacgctgatgtgggagtattttcaccatgcattcctgctctaaatcctttgcttctactgatagactattctactttcgaaataagttcacattgctctaacacttcataagttcaatctttttctcattctgtttaaaataaccaccatgaccaccaaacgcctgaaattcactgtagttaaaattatgactgaaatagacagggaaaacctgagagtgaacgttacccagcaaatctgggttaaacaggttcgagtttttccagagcacactgtttaggatttcagcttcctgttcaaccatctcggaaacagggtgtttctctgctcctttgtgaggactaaccatgtgtccccgccactttgcaccaaagctgaatatcatcccaaactctggatccttctgacgggcatttgtgtggtacacaggaaggggtgcattatgaatatgcaattactggcatgtaatgctgtcttctgctaaaaatacaaaaagggtactctgatctcagagttgggagctgatttctgatttcagcctagacaggtctgcttaaaactataatcaagctgattgtattgccctggaattctaatttccaatttagggttttgctatataatctctagtagagtgtgtctaatctttatgaaacccagagtctttgtataaactctatggattttcttccatgcgtctaggctgagctgagctgtgtctttaggctgagctgtagagacattaaattactgagtaaatgaaggtaacgttgttatgtcactctgtttctgaaagaccaactcaaattctgtctgctgtagctttgatccttttcatttaattctaagtacacttgttattatagtaactgttgtttgtatgttattttagctttttacttaagtagctatttagcaatttaaatgaaaatgtaattaggttacatctgttttacatgcatgtaataccacgcagatgtaaacttctattaaagccatattttctttttggcaagaaaaggcagaaacaaaatcgtgccagtcgctggaatacgtcttgctctaaaaaaattaaaaaaaaggatatacagagcactgtgccattatttatatggtggttagagtacatcacttctattttttgaaaattaaaaaaaatattaacaagtgaaaaacaagcattctattccatgttccctcttacagtttatctggatacggtgtttaaaatgacaatacagccaggcgcggtggctcacgcctgtaatcccagcactttgggaggccgagacaggtggatcacctgaggtcagaagttcaagatcagcctagccaatgtggaaaaaccccatctctactaaaactacaaaaaaattagctgggcatggtggcatgcgcctgtaatcccagctactcgggaggctgaggcaggaaaattgcttgaacccaggaggcggatgttacagtgaaccgagattgcgccactgcactcaagcctgggccacagagaaagactctgtctcaaaaaaaaaaaaaaagaaaagaaaagaaaaatgacagtatggcttccccccattctatgggtttgtgcacacagaaatacacccatcctcccatcataaacactggttcttccaactccacagatagtggaaagagtcaagaagcagccgagattctaacctagctctgctttatgactttggtaaagccattttactcttcagtattattattttttaaaaccaagagtaatatttgcccagtttgcctcatagacatgttgtgaggctcaagggagataatgaatatgtaggtactttgaaaagtataaaatgcaattgttagaaagtattattagtatattagtctgaaaacagcataagcagtaagccccccagatacccccacatttttgtgtgtacaatggggattgaacttagaaaattaattctcctgttttgggaaccattgcctcccttatagcctgttaataggatttataaaacatcatttcagacaaagtcatttatcttatttgctaatgagacacaaaatttggactgtctggaaccaggtaacattttaagagttgcccatttgtttcatacacgttcagcttttcagtgcagtcatttttaatggtggtttttatagcatcaataaaaatattttcatataattcttccttgtaaatatggttaaacttttagctttctactacttggtgacctgttaaataacttaatgtactttgaaattgattgttcagtgccaagacaataagaagccaggaggagccagctttattttttacgttggggccttaagttgggctatgaagaaaaaattctggcagggtttgccacatccaacttttaagggtttttttaatctgtaagagggaacatggactagaatgcttgtttctctttcctgtctgtcttaagtagtatcttagatggcaaggaaaggaaatattctacccatgtcataacatatctaccatttattgagcacctactatgtgccaagttgtattctaaatgcttcatgtattatctcatctgatccttaaggcagactcataggtaggtactactgttatctcctattttataggtgaagaaattgaagtctagagaggttaagaattttctcaaggtaagatagctagtaaatggtagagctaggggtttaaccttggccatctggcaaccaagacataggtttgaacccattatgcctcatcatacctcataatacctagtattataaggggttttgttgttttttctttgtattggttttgtcatctgaatcaaacgtctttgacctagaaagaatcttaaaatatgcttctgccgcctccctcttttatcccaattcagaaaaccattttttgggagacctaggtgccataaaaatgaaaagaaatgaggcatggtgctcatggtactcacagttcagttagtgaggggggttggtaagtaaaggggtatggctaagtagcccgccaaggaggatgacatgtgcactaagctgatacttggctgatgtgctctgagaggccagagcaggcagcagtcaaggtcaagcaaagcttcatttgacctgggcgtgaaagaatgtgcaggactgtggtaagcaaaggagacaggtggcatttcaagcttcaggaatagaatgaacagggagttggaggaaagaaaacacaaaatggcctgttacaatagttaaggcaagagatggggaaaccttcaacctggtcaccagcagacgacataaagcaggaaataaaatgacattgcaaaggcaaggtgatgggatttggcaattgattagcagttgggagggagagcactggaggcaggtactggggtctcgaacccagtaggatagtaggaatgttaatcataaaaggcaactccgatttgggaacactcattgtagttggggaggtagaatagggtagacggcaagaacttggactctatattcagatggtcctgggtggcaatctgtgctctcccacttactggtagagttactttcagcaagtcacttgtttagactctagtctcctcatctataaggcgggaataatattaacacagctgacacttgagcaacacaggtttacactgtgcaggtccacttatacgtggatctttcaaaataaaagctgcaccaagtatgcctgcctctcctgcctccccttccacctcttctgcctctgccacctccaagacagcaagacccacccctccactccctcctcctcctcctcctcctcttcagcctactcaaagtggagacaatgaggatgaagacctttaagatgatccacttccacttaatgaatagtaaatacattttctcttcttcgtgattttcttaacattttcttttctctagcttactttattgtaagaatacagtatagaatgtgtgtgtacatataaaaaatatatgctaattgactgtttatgtgaatcagtaaggctgccggtcaacagcaagctattaatagttaaatttgggaggagtcaaaatttatacataaattttagcctgcagggggtcgagtgccccaatccctacactgttcaaaggtcacgtatagtgacctcatagtgttattggagctcaggtagtacctgtagcatgcatagcacagtgccttatagcatacattcaataaataccacttagtagcctcttggctactactcactcatttgggtgagtaggattttatccccattttatagatgaggatgctaaaatttgagtaggtagagtagctttccagagtcctaaagccagtaaagcctggcaggggtgagtagagacccaggctcctgccttgtggtgtagtttctgacttcaattgtaggtcacttgctgccctcacaccagacagcggcaggccaagtcttctggtgctgttactttgaccttcctcccataaaggctggatgtagcagaggcaggcactgtctcttctcttaccttctgtggccatttactgagcatgtatggtgtgtctcacatgcttttacatgctttgcatacatttctttttccttttctttttattttattttattttattttatttttgagacagagtcttgctttgttgcccaggctggagtgcagttgtatgatctcggctcattgcaacatccacctccagggttcaagcaattctcctgcctccgcctccaaagtagctgacatttcaggtgcccgccaccacgcctggctaatttatgtatttttagtagagacagggtttcaccatgttggccaggctggtcccgaactccggacctcatgtgatccacccgcctcggcctcccaaagtgctgggattacagtgctttgcatacatttctaatgactgagtataggttttcattttctccctttgctttcttcctataaatcagacagtcatttttttctagagtccttttcagcaccccagagggagttgtatccttttgtgtgtgccctgtggaattttcatggcaacataagttgtatttcttcatgactcactgccataggaagaccacccaaaacataccctcttctgtaacccaaatctcagcgtgtgtccttattttccttgttttcagcatgtccaagtgaagccattaagtaggtaatatactgttagacacagatcgtggtgcttgggaaaacaacacccaagcctcgtgattaataagcactgttaattgttaagctgctcttgctggtgtctgacctcacggggtttgtgctgtgacagctctttcatgttgatgaggtaaatgagtctctgccatgatggccgggagaagccaggacagagtatcagatcgtgtttcaccaggaaaacaaggttgatttactgtgttacacgagggtgaagtggacccagcaccactgcaccccgtgctttgattcccttgtatgctaaatatgcaagcacaaaacagctttaacacaattttttacctagaaaggagcctggggctgcatccaagtacatttaacatgtgaaaattgagctgctttgaacttgtatgtttttgataactgcttggtatgcttcctggaggatcacctgtaggcttttctttccaaatcctaatccctttgattgagtgccaggacagatagctctcattgaataactccagtctcataattcttccttcattcagagttgaaagggaacagctccagattcaataggcacatcctcagatttagctgaagtcattcaaacactttaaaactgaaattgttttgttctgaagtagggttcagttgggctactgaatgtttacacaagccagttgctgccaggaactgtaggatggggaagaaaaccacacttctccccgcctccacccagcccccttgccttgcttctctctgcctctgtaaccaagaaggattacaaggacgactttgagcgttagaagtttcaaagcaacctggcaggattgtttgtaaacgtgggcataagaacgtgcttgactcttcttgttttctgtcctccatgagaccaggctgaacactcctcccctctcctcccaacccccttttggaggaaggaaaacaaccatgttctttttatctttacaaatgtgcctggtggggactaatctaaaccagttcaagatgcttttgcttaagcctgtttagaggaacggaaggtgctgcagaaatggaaatagagtggtatatgggcctctttgccaccccgctcctgagctcgctgcctcttttttgtttttgtgggtttcttggcacctacctagatttctgctgagatctctgtttcaggtcttttcagagatcatgtttcctaaaagatggttcctttctgctggacatcctgtctctgtcctatttggccagatagtacttcagttgggaaaagccatctttctcttcgtgcctggtgccctatttcagaaggaagcctgaaaagtcatttccatattctgtgtgtgattgcgtcctgcctagcttatcacagtggttgttccctctcggatgaacaattcctaccctcctctttgcccagcagatgaaggcaaggattgtaacccattattagagtattgaggacctgagttccccactcatgttgaacttgaggcaagactgggcggtttattcccctctggctactctcccacttgtaaaatgaggcgacatctctaatcattgacaccaaacaagaacatagcctaataataaaatgaatggtgttatatggtcatgaagaaggttcaagactggaatctactccataaggaaggacacaaaaagattcaacagtgatttagacaaatctcatctgaacacattttacagatgcctgttgaactaaaagttctgtctaggactgtagtaagatttgacccggcttagcctgggaattttgacccactgatggtagaagtttattaacagccctattcatttagatccttccctgtttctacttttctcgttctctccccggagggtttttatgacgttgtaatcatttataattttaaaatgtcttcaatcgtgcttaaaaacagcacttgattttaatgggtactgcttaaccatagaaagattgtgtctgtattactgtcggttcttacaacaatactttggaacgaaagtagaaagtttatgacacattttattatattcctaaatgtgaaagaggattctaatttaaaaataagtggccatactttttaattcttatttagcctctgtagctgttttaatatcccttttatggttgactggtcgatgttttaaaacaagttcttcagggactctgcccattagtctttggcaataaaatctgaactttactaaaataaaacatgaagccatggagtaattaagaggggaactttcagagatgaccgtgaatatgaaatacagtgatttgtattattaatggatttggggaaaaccagcccacctcttttaagctcaactatgtgtatttggggggttttatatttttaatttatttctttgtttctctcaaggcagtaggggttccatcgcaagctcttaagatctaccaatcctccttttgtagcctgctgcttctgaatatgagcctttcttttttcattttatttggaaaatggggtgatgtcacttaggaaagcatttttcccaaaagtggtttcaggaaccagaatctggtgaagtgttatttaaaagcgataacatagtaaagctctgctttgtgcttcaaataattgtaggatttacgggatatatccctaacctgttcagttttatggaaggacaaaatacagggattcattttatcatagtttcttaaaaactttgaaacccagttgacagtcatttctctagcattataataagctctttgtgtttataaacctagttcatagtaatttttggagtgctgcaatttggtagttatttaatttgcaaatgggattggcctctctaacctctaaaggaactagttccttttaatgctttaaaactttcattgactctcaattgccaactgcaggaaaaagttcaggttttaaaagtccttacatgcgtttcagcctcctctccctgtttcctttatgaacagccccctcccactccctttctttcaatggtaggtctgctgcagaacattctgcatctcttaaactttatatgcactgtatttttcagtctccattcctctgctcatattgtgttctctccatggattctttctttttattatttaattttttttaagggatagggtctcactctgttgccccaggctggagtacagtggcaccatcatagctcgctcgtagctcactgtggcctccaactcctgagctctagtgatcctcccacctcagcctcctaagtagctgggatacaggaacgcaccaccatgacaggccaatttttaaattattttttgtagagacagggtttcactgtattgcccaggctggtctcaaattcctagcctcaggcaatccttctgcctcagcctcccaaagcgctgggatgacaggtgtgagccaccaggcctggcctcagggatttcttctttaccatgtcatagtctccaaaattgtgcccttcctttctgtcaactcaagtgtttcctcctttttttttttctgagacaaggtctcgctctgttgtccggactgcagtacagtggtgcaatctctgctcacagcaatttccgtctcccaggttcaaacaattctcgtgcctcagcctcccgagtagctgggtttacaggtggacactaccactcccagctaatttttgtattttttggtagagacgggtttcaccatgttggccaggctggtctcaaactcctgacctcaagtgatccgcccgtctcggcctcctcttaagaggtattttttactctgtatccagagcttcctcatatacccatgcagcatgtggaaaacagcctgtactgctgtatgcagtggccctgttggaatccttctgcttcccagcgaattgcccacaccccagaccatggcactgtctccagatcttcagcattgcagttatcatgttaaacttagctatttgtgtatatgattgtctcgttcaccaaacagtgagcccgttgagggcgaagttgtcttaaatggctttgtgtccccaactgccaccagggagatgcatagtaactagccaatgaatgaatgttttcttcccttaaaaaataccaacagatgcctaacataagcaattaagtgagggaaagcttttttgccattttaaaagtcattcgtcagcccacacgataccactgaggaagcctcatgtgagagctaatgaacattaaacccagacaccatcgggagctcaccagaaacccatggctggctagtgagagacccggggctagaaacttgatattttggtttcacagccaggtaccctggcagccacaccagtgttatgctggcaggcatgctttgtctgctatctgtggcgtgaactttactaaaatgaaacatgatgccatggagcaaattaagaggaaagctttcagagatgaccatgtatatgaaacacagttcctactccgcctccttcaccccaatgagagaatccaaattttatttaactggtgcatagaggtctcttgatttgggggaagatgggtccctctgccagcctgagatggtaaatcacgcttgggttaagccagtcatcgaattcctgttcccctttgctggatgctcattttcccgggttcccttgcaagtcaggggctgtgtgacaagttctgacctgtgagacacaaggccaagtccactaggagaattctgggaaggattttcttcctggtaaaaagacagagcctcatgtttgccaaaagagcctgattctctgccctttcagaggcttcctgcctttgcacacagtgacaagacatgatgctggggctttagcagccaccacgaggtgacaggtaggaggacaaaagtgattacattgatgttggtgaagcaggatagaaagagcctgggtccacaatgaccaaccttgaaacctcccatttccagacttctggttcaataagaagcaccccgatggtttcatcttttgacggttggttttttgctgcttgaaacaggacacatcctaactgattcagttacttttagaaggaaaaataaaagtggagacagcatcctaagaggaaaggtggtgactggataaactatatggaagtcctgacaacatcatatttaagaaatttggtggctggcctctattcttctgttaggtgtaaggaagacccactgagtaacactggagcattcatcattcaagaaacattatattttaatcttggatattcctagcactatgcaggattctgaggatgcagaaataaaaggcagtttctatccttaaggaacttggagcctagtaagggagactagtgagtaaacaattacctgagagtatgaggatcactctcttttgataggggtattgtattagctcttatgctgctgatatgcctgagactgggtaatttataaaggaaagaggtttaattgactcacagttccacagggctgaggaggcctcaggaaactgacagtcatggcagaaggagaagcaaacacatccttcttcacatggtggcagcaaggagaagtgtcgagcaaaagggggaaaagccccttataaaaccattggatctcaggccgggcacgggggctcacacctgtaatcccagcactttgggaggccgaggcaggcagatcacctgaggtcaggagttcaagaccagcctggccaacatggtgaaaccccgtctgtactaaaaatacaaaaaaaatttagcctggcgtggtggcgggtgcctgtaatctcagctgttcagaaggctgaggcaagagaatcacttgaacccaggagacagaggttgcagtgagccgagattgtgccattgcactccaggcaatggagtggagcaagactctatctaaagaaaaaaaagaaagaaagaaggaaagaaagagagagagagagagagagaaaagagagagggagagaaagaaggaaggaaggagaaagaaagaaggaaggaaggagagagagagaaagaaagaaagaaagagaaaccatcagatctcgtgagaactcaatcactatcagcatgggggtaaccgcccccatgattcaattatctaccactgagtccctcccacaacacatggggatttggggaactacaattcaagatgagatttgggtggggacacagccaaaccgtatcaggtgtgtttggggtactatcggagatcagatcaggaccacaaaacctggataggctggggaacaggagaaatcaggaaatgtttcctggcagaaataatggctaagtcaaatcttgaagaagggataggattttgccagaccaagaaagacaaggaaagaaggggcggggcggggtgggagtgggggggtggtgcagtatacaaaacagaggggacgtgttataaggcagagaggtatgagagaaatagaacattcagaaactgtccttcttaatatttttgccatatttgatttggatctttttttttttaggaaaaagctgctgatggctacaaatgtgtctgttatgttattctctatacttgttatttcaaaaatattttataaaaatttgtgagtgaataaatgagaggggagaaaggaaggcaatgagtatgaatcatcattctgattttaagcataataaaagcaggaggtgacttccacagtcaaatacatttgggaaataatagaaaattaaatagtgttcattattgtgagaattcccagaacccttaatattcccatgttgattgttactgtccaagatggggccactgtctagcgcacttcctaggatagatttgtccataggcccctcttttatgtaaccatctgccgaactgaggccttggaaaggcttgatgtagaccgctctttcagaaaacttgaccgagaagggaagtacgcttctagggtagcatcagagcagaacatggggaaagggagacatttcacaagaagggagagtcaagatcatgtgtatttatttgccaagggcaaaaagcagtagtgaggaaaagcaaacaaaaaccagttgaagacacagcaacagaggagaatgattgacaaagtaagcaaggtgcttgaggttacaaaagggatcagctattaaaggacttctgctagtgtctacttgtcatcttcaagatggcacaatttttacagtaccatgtatctgtgttgcaggagaaggtaggcctctcaatcagagacttagcctataaaccagcatctacatagtgaatctaggtatccctcagtgttcttctatttataaggaacagaaaacccaacttaaattgacttacgtaaaaagagtttgttggttggtgtaattgaaaagtacatggttaactagcttcaggcatagcttgatccaggtattaactatgtcaccaagatccatctcactgctcataagccctctcagttggctctattcttatgttcctcatggctcctggaaactttagcctctttccttctggttgcaggatggttgtagctccatagacatcacatctgccctcacactgcaactcctatgaagaggaaacaccttatttctcaggagccccaccctcttactattagtctgattgaattatatgtccatccttgaaccaattcttatgaccaggaataaggcatagtccccatgtatgtaacttctttctcctgagttgtacaaattatcaaaggaaaaccaagaggattatatctcaagagtggattatgttaagaaagtaaccctttccctccaaaaaaggaaacttccataacagaacccttagatttttacccagtgtgattttaaactctaaatgctggaatgtttagggtcccaggtctgacagcatgaattagatccctccatgtggagcacccaagtaagtgaagggtgttgacagccatcatggggaatgctgatgcttactgaagaagccatgcaataaatcctctttagaaataaacaaaaagcagcttttgagaacccggcttttacccaagaccaaaacctgtcagccacaggcagaagtcattaggcaggatttatatgtgctggtatccaacactgagtcaaaaggagatccgtagaggggatttctctcttccggaaacccagcagaggaacggggaagactttccgggtaaagtttcagagaacctaatgcataaatccccttaacaaacactgggatttgggtttgtaactcatctctcccagcttaggtcctgtggagacaagctgtcatagggctgacacaaccaaatcaagaaaggaaagagtagaatttatagtgaaaatcaggaagctacttaaaatggtgggtttctcagaatgtggtactgcacattttttgcttggtagtccctgaacagttattaaagaccccatggaagcagatggatgctggccagtaggcattgtccccttttatatttataacttcactgaccttcattttacctctaatagagattgtaccattaattggctggattctcccaagctctgtggcaagtaagaatggaaaagtggattttctccgtactccattgcagaggatatcattaatttgctaggtttcgttcccacagggaaatgttaaaaaccagtacagttggttcttcgccactctggattgacagacattctttgtgtaggtgcctctggctttgagaaacgaggccagagtctatatgcagacagtgagcagtgatcttccgtttcctacttgttgcagtagacataaaatcagggcaaatggtgagttccagaggaaaggatccagcatgcagcctgctgaataagagaacaggaatgatctcgaatgatgataaatgtttatactctattagagctttggccatgggtttggccaccattcaattgcctctacagctgattttttatgtggcttttcttttctttctcctgtttggttgcaaacttattttgactgaggatttacttgtcacctcatgttgacatttcaagttattgcattgagaaaaacataggagaaagcaaacaagcaagtatattccaacggtcaacaggcacagaagtcatactcacatttcaaagaaaaacaggagagttgaaatagagaatggagaacagatgtatttatgaggggggaaatcttcttggcatttgagctcaagtcagattctggattctggatagttttctcagctaatggtgattcctaggactgctaagcgggggacattctggtctaaccgaagttgccatgtaattctgtggaatcatactaacattttgatttctctgattataagtgactgcagcaacaaagagagtaactctgttgtaagaactgtttccacagtgtctctagggacagttttgctttagtctgtaaattctccaaaggcaagctgagactatgtaaattaaagaaatagagccagtgacaaccaaccctgtggttttatttgattttccaaaacacatgtccatcggtatgtctcagacaacacgatatgattaaagcacggtaataatcacccatatattgcattttaattggtataatgtatgatgaatagtgaagttggaaccatggggcatactttcacatttaaggtatttctttgatttatcagaatttctaagaacataaaatagaagtcagaaagtctgttttctgagctgggacctgccattcatcagctgtgtgatcttgggtatgttactttatttctctgggccccattttccccagctataaaatgaggggtttaaactagatgagctctaaagagcttttcacttcggagtttggctattccaagaccttttctagtcttgtgaatttaattactgaattctgggatcttaagtctctttatcagttgagtctcctcctttgtggtcttacagcaaagatgactgttggccaaactttggatttctgagactgatttcagtgaattgcattatacatatttttaactagcttatattaaatgagagaaagtgcaaggaaggaattgcaaccacaatttaaatagttttttccgtgccattctattccgtgagcacctgccttggagtaggtgtgaaacgggagtcaggaagtctgtgcatgcctctcagagggtggtatcttcgtcttctgagtatgattccgtaccatgaatatgttggttgtggatttttcttttctgtacaacatgaggcccctaaacataaggaaactacttcctttggtgcttaacctaagaagcatctattctaatgatggaggaaaacctagctgtattacacatactgaaagtgatatagtgggttacaaagtgacaggtaaatatttgtgttccatttaagtggtttgtgagtataattttgatttttcctaactgttgctttctctaatgattttagaaccggataacccctcccctttcccctactctccaagcataggatagagctcatctataaaattcattggattttgtgtttttgctcttctagttggtctctgaaatggtcagaatggagttggaaatgggacagcctattagtccaatctacttctaaggctcctgaacagcctcacaagactccatgcatcccagcatcccttgggacctgggtgattagtttgtgatcaacagattgtactctcagaaaacgtgcaagccaccagcctctcgttcaaactgtttataggccccagaaggggcttcctttgggccagatgattagtcacattttgtttcaaacacccgaggaaaggtacagcagctttctacttgaatgcatgcttttaccacctaaaggcaattggttgggagaagatttgggagaagacattgacagtgtccagcagtccttttatctgttataaagctaaatgcatgtttatcaagttttcagcaaagatatatgttccactttagcctccttattcttattttccacttagaggtagagactgggtctcaccatgttgcccaggctggtcttcaactcctgggctcaggctcaagtgatcctccgacctcggcctcctgaagtgctgggattacaggcatgagccactgtgtctggccacaatacacacttgactgtcatttataaactcaaatgactcagctatcaagatgccaaattggattttagagagcctcctcctaggcacctgatactttcatgcttggcttattgtacgaggtaactccactttctgttcatctcaaaagtgttgggaagtgtttgcaggttaccttcctagcacctgcccaaccttctagagaagtggagaaacctgtgaggaaagcagcacaggcgttgccacttagggacagtttcatggaaagagatctctacttcttgatgtcacattaccctttagaattccagaatcacttcagatcttcaaagcttttaataagcagcgatggccttttacaattattttttaaagcagcaatacttaaaattttattaagtgctgtcgtagaaacttgtgtctacaaaagacagataaaaacaagtgttgatgaggatagagaaaaattggagccctcatacattactagtgaggatgtaaaatagtgcagccactctggaaaatagtgtagaagaccctttttaaaagttaaatatagaattaccctaaaaagcacaggcttttgttgactttccctgggggtcaggtgggctcaccttggtgcatcctcccctggggggctctggtgtgggaagccagctttcctaccattctgcatgcagccttgtactgggtccttggggaaagagaaagactgtgaaatagatgtttcccttttcccagaaataccaacccaagatccccagcagtgaccccttatggaattctgggaagaactaaagagataacagtattctttcctgccttttatcaactctggatggcaggagggactctggggcttgggactggctgccctcaggagttcatggcctagtactgatgccaaggggcagaaatttgtgagaaagaaggcctcctccaggagctgttggtatgagcccctaatgggatcatgatatcctacatatgcaactatgggaagaagaaaggatctagccaacatctgttattatattttaaaaagtaatttaatttgtttacattacttgtcattattgtcacccacttatatttgattattctttaagcacatatagaaagatgaggtttatgttgatttttctggtattacatttccctaggctacatctccatatagagctttccttttttaaaatctgttctttattttttatagagacagggtcttgctatgttgcccaagccagtctcaaacttctggcctcaagtgatcctccagcctcagcctccaaaagctctggaattacaggcaagagccactgtgcccaacctccccatatagaattttctatagcaatcttgtcctaggaaatatcatagaaatagtttaggttttaaaaagaagggctgtatgtcatctaaactcttatttaacctatggttgacagccttgctattaaaaaaagatcttaagttgttttacattttatagtctttttaaaaaaagatgatgagacatctctttagtggttgccatgtttaatattgttactttctaagaacaaatataatttttgtgagaacattatattactctgaaacagagaacagtactctctgtccttttagtccctcaatttttgataaggtaaaataagattatcttatatgactagtgtatactaccttatatttgtatgacactccatgtttttcaatgactttcttccagagtttttgttgaaacacaaaaggatttgtacccaaactgactttactttcaattctggataatagataattattattgcattacaacttttaaaaataattaagaaatcagcttagaaaatgcttgatgatttttacttagcatggtacgtctttagggaaaagaccgtattatgaatttagcaagcaagttgagcatggtgacatccgcctgtaatcccagctacttgagaggcggaggggggaggatcacttgggcctgggagttccagactacagtgagttatgaagggacccactgcactgcagcctgggcaacagagcaagaccctgcaaataaataaataaataaataaataaataaatgtcgtggtttttttttaatttagcaagtaaagtagcagaatatcctatgttggattagtcagtggaaaaaaatatctttcaaatcgcatttgatgtttgctcaccattattatgaactaagctactccatggaactagagcatagctgtcaagtaattatgaagcgcccatgctagggaccgcatgccatttaatgagtttacatcagtaaaaagagaggacagattcaaaaatgggacatgtcacacatacatgtgagaattttcccataggccaaagggcctctttcttggttttgatatcaggcaccaactctaataggatgaagctatctgtgtagcttgatgaagtagaaattcattggagtggccgggcacagtggctcacacctgtaatcccagtactttgggaggctgaggcgagcggatcatgaggtgaggagatcaagaccatcctggctagtacagtgaaaccccatctctactaaaaatacaaaaaattagccgggcatggtggcaggtgcctgtagtcgcagctacttgggaggctgaggcaggagaatggtgtgaacctgggaggcagagctcacagtgagccgagatcgcgccacggcactccagcctgggccacagagcgaggctccgtctaaaaaaaaaaaaaaaaaaaaagaaacaaattcattggagtaccttagcattatgggatatctctaggcagcgccaggtttcttgtcttcatagctaagatagatgttaaaggaaggggaacctttttctatcccatttttctagtggcctttataggacttggcttaatatttttattttattttatattattaaattaatatatttttattttataaaataaaaatattaagccaagtcctatgaaggccagcagattttattttatatatataaattttttaaaatatgaaataaatatataatacatatataaatatatttttaaaatatgtaatatacatatatgtatgtgtacacacagtgtgtgtacacttgttatattattacttatcctagtatattaatggctatataacatagctgtgtcccaaatacatgtaatacatattacttttcatctcatttaaacctcacgagagttctttggtgaagatatgattaccattttacagatgagaaaacctgagaagaatagaagttaagtagcatgccaagcttacccaactagctctcattcattcattcatgattcatgaagtatttatcaaacaactactatatactgtcattaaagatacaaaaaggatcaaacataatccttgccttcaaagaagccacagtctaaggttaacaagtggactggagcggaatttggttttatcatttcaaaggcaaaggaacccagattggagagttttctggcaactgccttaggactttttggccaagattaatgtaatatataaaggtaagcatcaatgtgttggtgggaagaagtatcctagaaatgttttttgttttttactgtatctaggactcttatgaactactaattcattattaagttatttgatgacacagattattgttcaagaatttcctcccagagcaattgataaatatcaaataatttttatgatgagcagttccagaaagggttaaagttagcttctctgggacatatgatgggaaagtagctgaacatgatttcaaagggattttttaggagaaaattccaattaacagagaagtaatttccctttctagcttactaagccctatttcagactaatgcagtttcaagatcatctcccttctccccttatttcaacagatattttgaatatgaaaatcttatgtcaaaacttagctgaagccttcatcaggcttttgaaaggctaagtaagaattctgtttctaggaataaaaagatttggatcagaaagattctttgctggctagagttccttttcggatggtagttcaagcagtctttaatcatatttttgttgattatttattagtttccctgggaaatcaaagactcagtaacgtaaaatgtgttttccttaagatattttatgaatcagaacccacagtaaagaaataatgggaaatacatttcctttgctgatatggactaattgagaattaaaatccctttctctagtcattatcccacatggaaatgctgaatgacccaactggcccaattgcaccaaccacagtttctgcctagacaaaactcttatgccactagtagataaagagagagctttctcagtaaatcaaaactgcagagaactagaactaatttaagtgaaaggataggctccaagcccgctgtttgggtaaacccacactgaaccaagtgagcgattgatgaaacttaatatatgtgtattccagtcatcagcctggagtatgtgtaatgcaagcccatggtgtttgtcactgtgagaaatggaaaggcagaccttcattctcaactgtgtggggctgctagcctgtggcagctttggtcaacatcgggcttgcttttgggtgagccagactttggctggtttcctgatggaggttaggggaattgtgaaatgtgtctccttacacagatcgtcctgatcaaatgaaataaaaaggtattttaaaaataatttgcttagtgaaatacaaaggaaataggatgcatttcatactattaaggccgatatggttttgggggatacgaggtgtacatacgtgaaaaatttgaaaacaattcagagtgaaaaagaatggtcgtataacctaatgtaaatgacgagttaatgggtgcggcacaccagcatggcacatgtatacatatgtaacaaacctgcacattgtgtacatgtaccctaaaacttaaagtataatttaaaaaataaaagaaaaaacaaaaaagaatggtcgtgtagtagagacagtggtgaagagcaggactctggagccaggtgttctgagttcagagcccactctgccacttactagatctgagacctggaggaagttatttgccctttccctgtttggctcttttgtaaaatggaaatataagagtacccacctcctaaggtgggcttatgaattaatagatataaaggtatgtaaaattattgctatcattagttactgttattaatagatcagaagtcacaagctccaatgcctgcagtgcccatgcataccaaaacagggatcactggcaacagagacatggccccagtggcgtggagataaaagaaagtggtagggacagtggcagacagccatcaccctactccccattgattgtgaccctaagggaatgctggtcctgtgtcgccagagcttctggtattgccaaagaagcttgaaatctggacttggtcaaaaaatctctcaacttgtaaaggtggttgctttattttaaattactctacaagccaaataaaacactgtctccaggctattggccaccagtgaatgacctctttggactaacaattaaactcagctatggaaattcatctgattactttattgtcacactgtgaaacagggattcattgtcattccagaaacagccattgagtccctgcttgtgtccacccctgtgctggtgcaaaggatgtgcccaagaatcaggcagacaatccaaagaagccacctgctcctttacaagttgttgacaattaagaaacacctagcacttaatagattctccataaatgtaggttccaactccttccattacctttgatacgtctagacctgatccagtgagtatttgagggccaatctcagtttctaagtaggaatagtgatattgttgaaaactaatgaacccaccgacaacatcacagaaatactcctatacttcttcaatgtgagtttcctgctttttgtgtcatttatcatccccttttatttgatgtctctactcaggacttaggactcgggctgtgatattgtgtatgttacctcacaattttttttctgttttttttttctttaagtgtataagcttcgtttatacttccaaaggatcttcaatggaactctacttctgtgagctaaaccagtgtcatactgcaatgaaaactgcaggtgataaacattgtctaaataaaatttccaaaaagtatttgaccaagaaataccttccccctgcattccccacttaatgcatcttaatatgccaagttactgatattgtttgacctatttggggaaatgctggcttgccaaattattgcccttgttaggaactacagtttcttgtaatttcttacccactccggcatccacacaggtatcttccaaagctcagactttattttcaagaggtctatctgagaccagtctgggtaaccaagtgagaccctgtctccacaaataataataataataataataataataataataataataataataataataataaattagctggatgtggtggcatgtgcctgtagtcccagctacttgggaggctgaggtaggaggtttgtttggtctcaggagttcgaggttgcagtgagctatgatcatgcctttgcactccagcctgagtgacagaaaaagaccctgtcccccccccaaaaaaaaagtctagcaacttgagtgtggcagtggccaacttgatggtaactaacaatgggattgcaaactctttgaggaaaggaactgtcatcctgaactcggcatagcaccaagcactgggttgttacatggtgggtgttaagcaaatgccatggaatgcaacagacccctttttctgctgctgtaaactgtggtgtttgaacctagtagtgaatggcccaaggaaaaaaatactgcaggaaatatagtaatagatgaatttggataaagggtatatgagtgttttggagtattattcttacaacttctctgcaagtttaaaatgataatctaaattttaaaaacttattttccgttcatcaaactactcttaaaatgtgtaaaactatacctgaatttaaaagcaacaaaactcatattgcaagtcttggcaaactgagagataggagcagaaaacaatggtggatgcctataaacggatcaagaaaagggagtgagaatttactggaaagaaggacaaatgagcatcgaattcagcaggtttgggtttttccagagatcagtgcctgatactggttcccagatgatatctcccaagagcccggttcccagggtgtgttccagcctctgtccgccaggcttcccaccaagtcttgtgccaatagtagttgccagcacattctgcctcacaagttgctggctccaccactactaccctatcccacctacgtccaagatacgcatctggcttttctgctttgaattcagcaagtcatctcctttcctgtcatgtaactccctctgtgactcggcctacccagccacactcctcagtgctttgtggcaaaactcaacctgaccccccttcagagaaagagaaataagtgtcggggttgaaggttcagctgtaaagtgatgtttcccatactcataaacttacatagcaatgaggaactggagtctatttttgactgttgtagtgacctttgtgcataccctaaaagacagaggaacattgagctaatgtagccatcccatgaagcctcagtagctctaataggtccttttagttgttgctagggtgccagttcttgcactttaatacaattcttggctgggcaccatggctcacgactgtaatcccagcactttgggaggccaaggcaggaggatcactggaggccaggagttcaagaccaccctgggcaacatagcaagacctcatctctgcaaggtaaaaaaattaactgagtgtggtggttcatgcctataatcccagctactcaggcgatgggaggatcccttaagcccaggagttggagactgcagttagccaagattgcgccactaccctccagcctgggtgacagagcaagactctgcctcaaaaaccgaccagccaaacaaacaaacaaaaaatgcaatttctcccatcctaactcttcatattagtaaatcttcaataaaatgtatatgggaaatcaatatggcaccctcaaacctagttgtaatagtcaggagaagaccattctagcctttaaaatcagtcctgttaaaaaaaaaatcagtcctattgacatcaacgtttttacctccagttcctctccacccttctctacctcctgatttcatgtaggcgagcaatttaggacaatgagagtcacaggattttaaataacttaattcctaggtgtgtttggtacggaaacaaagataaccctgttcaacagtgaatttgtgcccctgggtgaacggccaggtgttctttcaactgaactgtgagactaatttcttcctggcctctggaaaccagctgaagcagtgggccagctggtctatcttcaatcttgcataccaacatctttctctgattcacagatttcctttatccccagcacttcctctggtatgtgcatccccgaaagtaagtgatatctattattggatttgggcgttttaaaatcattagccttctggaggggaggggagaggaaggaggctggatggttacattagaatatttccagagggaacctcactttaatctcatccacctctgacttctgcaccccagataacccccatatttgggagggatgacatcacagtaactgacaatggaattatcaccattgctctttttaatatttaaatgatacacagactcagagaaaacaaaatgagtttacatatagtcataatatccataactagagatataaaacaaaaagctatggagattcttatctagtgaagaaatctcttttagaaagtttctgatgactttcagttgcaaagcatagctctttcacaatatatcaacccactttcaatgatttgagatttggagagggcccagccatagatttacctggtgagtcacagagtagaacttgatatgagaaagcaggaccctatatctatcagcctaatggttctcagaataccaggtcatatccatcatttcttttcccaaatagctgtaacaggcatacctcgttttactgggcttcactttcttgtgttttggagatggtatgtctttacaaactgaaagtttgtagaaacctgcattgagtaagtctaccagtgccattttttcaacaacatgtgctcacttcgtgtctctgtcacattttagtaattcttgcaatctttcaaaagtatttattaagataaaaaacaaaagaaacgatataaaaataaagagaaaaaggaagaaaatttgttattattatacctgtcatagtgacctgtgatccgtgatctttcatattactattgtaattgttttggggcacaatgaccctcatccatataagatggtgaacataataaatgttgtgtgtgttctgagtgatccaccaacctgccattccttcatctctctccctctcctcaggcttccctattccttgagacacaacagtattgaaattaattaataaagttatagcgtcctccaagtgttcaagtgaaaggaagagttgcacatctctcactgtaattcaaaagctagaaatgattaagcttagtgaggaaggcatatcaaaagcaaagacagtctgaaaaccaagacttttgtgccaaatagccaagttgtgaatgcagagagaaagatcctgcaccaaattaaaatgtgactccagtgaacacatgaatgataagaaagggaaaaacagccttgctgatacggagagagtttgagtggtctggatagaagatcaaaccagccacaacattccctaatgtttgtaagccaaagcctaatccagagcaaagccctaaatcttcaattctatgaaggctgagagaagtgagaaactgcagaagaaaagttgaaaggtagcagaggatggttcatgagatttaagaaaagaaactgtctccataacataagtgcaagatgaagcagcaagtgctgatacagaggctgcagcaagctatccagaagatctagctaaggtcattgatgaaatggttgcaccaaacagcagattttcaatgtagacaaccttctattggaagaagatgccatgtagcatttttatagctagaggagaagtcaatgcctgacctcaaagcttcacaggacaggcttactctctttttaggggctaatatagctggtaactttaagtcgaagctattgctcatttaccgttctgaaaatcctagggcacttaagaattatgctaaatctattctgcctgtgctctataaatggaacaacaaagcctgaatgatagcacatctgtttatagtatggtttactgaatattttaagcccattgttgagacctccttctcagaaaaaaaaaaaaagattcctttcaaaatatcagtgctcattgacaatgcatgtggtcacccaagagctctgatggagataaatgagattaatgttgttttcatgcctgctaacacaacacccattctacagcccatgggtcaaggagtaatttctgctgttaagccctattatttaagaaacacattttgtaaagctatagctggcattcctctgataaatctgggaaggataattgaaaaccttctgggaaggattcaccattctagacactgttaagaaaattcatgattcatgggaggaagtcaaaatatcagcattaacaggagtttgggagaagttgattccaaccctcacggatgactttgaggggcttaagacttcagtggaggaagttactgcagatgcggtggaaatagcaaaagaactagactcgtaaatggagcctgaagatgtgattgaattgcataatctcatgatcaaacttaacagataagtagttgcttcttatggatcagcaaagtgtttttttttttttttgagatagaatctactcttggtgaagatactgtgaacaatgttggaataataacaaaggatgttgaatcttacataaaccgagttgatgaagcagtagcaaggtttgagaggattgactccaattttgcaagaagtaaaattgtgagtaaaatgctatcaaacagcattgcatgctacagagaaatctgtcatgaaaggaagagtcaactgttgcagccaccttcattgtcttattttaagaaattgccacaaccagcccagccttcaacaaccaccaccccaatccatcagcagccatcactgttaaggcaaaacaattgtgacttgctaaaggctcagataattgttagcattttttagcaatcgagtatttttaagtatgtacatcgttttttacactatattgtagtctgctatgcatgcaatagcattatgtctaaaaaacataatttttatatgcactgggaagccaaaaaattcacgtgagctactttattgctatatttattgtggtggtctggaactgaacctgcaatattgtcaatgtgtgcctgtataagattctccatgcactaaaaaggacatttgaaagtcatgagtaagttgtagaggaactctggtgacttgaagcttgtttacttttagcagtgtgtacctgttgacacttctagtataatttatattctttctctcatgagtattttacaggaaatgcgttttcctttgctagtgatatatgcactttggttttcaggaagctgtggtgctttggttgaagctctctgtctgttttagagaaaagacttacaatgacctcctgatatagtttggatatttgtctgctccaaatctcatattgaaatttgatccccaattttagaggtaggatatagtgagaggtgtgtgggttatggaggcagatccctcatggacaacttggttctgtcctctgggtaatgagtgacttctcactctattagtttttgtgagagctgacttttgaaaagagcctggcaccttcctcccctctctctctcttgcttcctttctctctctccgtgtgatgcctgcttctctttgccttccaccatgagtggaagcttcctgaggccctcagcagaagctgatgctggtgtcctgtttcttgtacagcttgtagaactgtgagccaaataaacttctttttttataaattacccagcctcgggtgttccttcatagcaaggcagacagtctaggacaccccccaaatgtgagctgcaccataaggcaaactgggaaacctcctttagttttgcatatgtgagaattttgattgactgaaccaaggaatcaccctcctaactccactgcagaaggccattctcatgtcatttgcacacgtttagcttgcctgaagtgtgttctataaaatgcacccagattttcaggcatttaaaattattattattttaaatctcctactttctctctctctctctttttttttttttttttttttttgagatggggtcttgccctgtcatccagtctggagtgcagtagtgcaatcacagctcgcttcagcctccaactcctagccccaagcaatcctcctgcctcagcctctcaagtagctaggactataggtacacaccactgcacctggctaattaaattttttttttctttttagagacatggtctcactctaggtcttgcctaggctgttctcaaactcctggcctcaaaagatcctcctgcctcagcttcctaaagtgctgggattgcaggcatgagccaccatgcccagttgcatgttttaatggagagagatgtcctgggcatttgaactgcagattcccttaaactggacattgtcagctatttatgtattacaaaaacaattgtgtttcatgtaaagtattaaacatcaacattacgtcaccacaagggtgattacagcaaccttcactcctaagtgtgcgtcacctacacaaacagagttgtttgtctgcagcattgttttcatttggtaacaattgtaagagttgaagtagcaccttaaggagtaattttcagaggtgaagcaatcagttttcaaaagtgaactccttatagttaataactaaccaataaaaaaataaagctatctccatggcacaaatgcccatggcacaaatgcccatggcaaaaggaaataagacgagtcgttttaaaaggtagctttgaaaaacaaaaaaggatttaaaattcaaagactttgggaaaattcaacttaaccaataacatgagtaacgactattactatttcctgagtccttaccatatgccaaataccgttgtacattgtacctgcttcacataaattatttcatctcattctcacaacattctgtgaagcgcgggtactttattatctatccctgtttgccagataaggaagctgagacttcatacagtgacttacaagttcggacagcctccagcaaacacaggaaacaggattcgaacccatgcagtctgcctcagagccaaagcccttggccatttttctatcctgccttccacagatcatttctgcctacagcagaggtcagaaactgacaaccggctggccttacctagccttaggtaacagtaatggctattgaacacttactatgtgtcaggattattttacacacattcatgtgttccttcatttaatcttcaaagcaactccatgaggtaggtggcagttattatccccattttacagatgagaaaactgagaccaagaggaagtaacacttcccaaatgttagcagaactaacatccaaatccagactgtctcattccagaatcccctcctcttcaccattatgctaaaaatacagttgtctgccaacatgacaaacctggatgtttccccagaaaatgaaggcttctgacttgtcatgaaaaaaaaaaaaaaaaaaaaaaactggaagacttgtcctcttggaccgagcaacagtcacttgtaacaatgggcagctgcccattttagatgaggtatctcctacctagttgctaccacccctcatttaggctgctttgctctttgattgccggtctgaactttggggacattctattttgcagtctcagtctaaggtatccttaatactggatctgcctcacttaacaagctaaatgtctgtgtgttttatgttttttattgtagcacaagttgtttaatgttctctaaaaagcattccccacaaatagcagtaaatgcctctttcctattttcttccctgtcccttgccccgaaagtaaggcagctctgcagaactagtatttgtgcccaacgaagtgggaagatatgaggctgatagccttttctctctcttcttggttggtggcactctggtagtgcttggttagcgataatggagcatctcatggctttgttatgtgtcatagtaggctattgtgtgacatagagacacctggcttttgtacacgccagagcaaaattcaactacaacatccagaattgaagagaaggatattggcaggtacatgcctccttctcaaaccagagatttatatatttaaaaagggcttttctaagaactcaatcttgattatttgttccatgttgggccaaaccagtgcattattgggaagataatgagtggcattcacccaagggtaatcctttcagggattttgatgatgcagtaaatcatgagtgtaaagcctgagtggtttatgccattaaaacctcaagatagaattagacttgtaatcaccacttgcccatgttttgtcatttatgataattatagtagtaataatccatgtattgttgagaagtagcagtcagaagcatccatcaattttttatcgacaccaaatcaagttgatacttcatctttgctgcagaaatgtagattgaaccaattagtctaaagaaattgggcagtcattaacaatgaagcaagcagttaatctacagaacatttctggcccctctgatgccaacaattcctcttaattatgtggaatatcatgagcttctttgggactctgtcaacagtgccattgttggcttacattagaaggagcatctatgtccctgcttttatttaaaagaatgcagtgccttccagcccccaccttgcactcttaggcgcttctaggcaaatgtattctgaagcagaacacttgaatcaaagcacttcgcattttctttcttatttagaaataagaattttccccaatgggcttctttcggtgatggcacgttagctcaccatcccatatgtgttaactatttttgttcaccttacccaaatcatggaataatcatctccttttaaaaaaggaaagaaaagaaaagtcagagtttaaaagaaaaatccaactatttgtgaagaaatcctggtgctaatgagctttctgcatctgcctcaagtcttttccccaggctagcccagtctccctctctagacattttcaatcagcctcgcccgcaaattgtactaagcagctgaataatgcagggtagaaatttcaaatataaatattatttcctatttaggaaatttggaaaagaaagcaggaaaaaaataactcaccccctggtcccccaccatgacactacctctgtgaacattttggtagatattctttgggctctgacacgtacacacatgttgacttttatcatcatcatcatcatcatcattattctagtactctctttttcactttgctaaagtttgaatcatcttttgtaatggatgcgtaatactctaccaaatatagagtatgtatttgtccatgttttgaattatttccctaggagagcttacccaaggtaaaatacttggtcaaaatttataagcctcttcatagctcttggtacatactgacaaactctctccaaaaggatggtaccaatttttaaaatctcaccagtaatatatgcagatactggtttgatgttattgagatttaaattcagttgtgttggcatggttatagcttagatagatagatgatagatagatagatagatagatagatacatacatacatacatacatacatacatacatacatacattcattcatgtgtttgtgtgtgtgtatgtgtgtgttactcctccttaatggacaaatggtgatatggattggctgtgtccccacccaaatctcatcttgaattatagttcccataatccccacgtgtgatgggagagacccagtgggaggtaattgaatcatgggggtggttcccccatgctagtctcgtgatagtgagtaaattctcatgagatctgatggttttataaggggcttccccctttactgggttctcattcttctgcttcctgctgtcatgtgaagaagaatgtgtttgcttccccttctgccatgattgtaagtttcctgaggcctcccaagtcctgtggaactgagtcaattaaacctctttcctttataatttacccagttttggccgttctctatagcactgtgagaatggactaatacaatgggcacagtatcaaattgtaccctgactcaaattactgtaaacaatgccagttgttatctcacatcacaggaagttcggaaataggacagctgtaggtgtgatatgatcataggcccaatgatgcgattggagacttgagttcttttcttcagtttctgccatcatcaccaccctcatgctggcctcctttgggcttcaaatgcctacagtagctccaggcaccacatccagatgtagaaacaacagagatagaaggaaatcaattcttcttgtgtctccttcttaagagtgaggagatccttcctagaagctcccaactgaaacccctaaaccaagactggcaagggaaatggaagcaccattatcgactgattaactaagatttactcccaatctggcaatggagtcaacttcctttgagtgctgaatacctgaataaaatagattctgttaacaaggaagaaggtgggaatggttgttgaggcaccaacagtgcctcccataggcatcatgatttttttatgcctctgccatactcatagaaccatatacatttctttagtaacagttgatgcatttaatgggcatatgcaaaagttgttggcatatctaccaagtactgggctttgtccaatgtggaaggtcctcccaggtagtgatcatcctccacaattcctttacattttcctaaaaacctatctcagtgttgggcccttcaggtagaaaccaggaacacctcggtttctagattcctttggcatataggtttcctatgggaaagaaataggagagctggctttcctctttgagaatcttctgtttggtggagatttgacatccaggataccattgttaggacttccactgagatgaaagtttacagcctgatgaaacaagtctcactttccactttgaattactcaggctctgtgcatctctttccactgcacagcgtagcattttgaacacttcactactcattagcacctccagtgagagatcagaaaagaaggtggctgggaggggaggattgaagaatgcagattagtcaaattgttttttgttttatctagttagagaaacagctgaaattactgcctcaaaaaaatttggaaaattatctggcttatagtttatttctatagttattttcccactaattgtaaaaattaggagtattacattttagagtaaaataataaataaacaataacaaaaaatggctacaacagaagaaaacatgttcctggattgaagaaaccaacctagaaattatactgtatgcctcagaaatttaatactattttgtctttcctgtatgcagttggattatagagtacagatattgtctctttattaatgcatgatttataaatattatttgacactagggatatcaaagtgattgtggatcaaagctgcccatcccttcaccctggtagatgagaacacaaaatatatccatttcctatacaccatgaagacattgcttccagtaggttttcttgctggagacaaaaagaaaaacagaagcacctactgtacttgtgcactttctgttttacagtttcataaggatttttacaacataagtacatgctctatgatattacatacctttccaccacttatataatcaagtgcaattatactgactgcttgaatagatgatgggaaaaatgacttgaatcaaaaattacacaacagaacgctgtttcagaaaggcttttggagtgtacgtgccacagaccccaaaaagagatggatcaagatgattataatagccttgaattttcctaggttggttgagtgtggtggctcatgcctgtaatcccagcactttgaaaggctgaggcaggcggattacttgaggtcaggagttcgagtccagcctggccaacatggcgaaacttcatctctactaacaatacaaaaattagctgggcatggtggcacatgcctgtaatcccagctacttgggaggctgagcaggagaatcccttgaatctgggagacagaggttgcagtgagtcaagatggcaccactgtactccagcttgggcaacagagtgagactttgtctcaaaaaaagaaaaaaaaagaattttcctaggttatggcaccaagaataacttgtaccattttggaagattcatcttttttcccacataacacaatgtagcatgtagtatatgtgacacataccatagctacctgtgcaggagcttggtgagttctggttttgtctttcttcccctcaatttctatcccttcttttctttgtgcttcttccactctcctctttctattcttctaccatcctcatcttttcatttagaggcttggagaagagcttaaaacaataggtgatggggagaaatgtagtttcttcatgcaacataatttccccctgcagtaatccatggatcaacacatttgagggcagctggtttagaagaggcccttacaattgtcttaacttactcctcagagggtaggctgggtgtatagcctacatggctatacatggccatgtaggccatgtaggccattagattacatggcctttacaaggaatttttgggtggttttattgtttgtttgtttgtttgtttgtttttgagacagagtctccctctgtcacccaggcaggagtgcagtgtcgcaatctcggctcactgcaacctccgcctcctgggttcaagcaattctcctgcctcagcctcctgagtagctgggactacaggagcacactatcacacccagccaatttttgtatttttagtggagacaggatttccccatgttggtcaggctggtctcgaactcctgacctcatgatccgcctgccttggcctcccaaagtgccaagattacaggtgtgagccaccgcgcctggcttgggtggtgtgattcttatgtaggagaaaaaagaggaacataaatgcagaacacaattatgcaaaattaggagcctttaaaatgaaatatgatattgtaggtagtttcttcaaaacaacatactagttttttatacttgtttattcatcactgaaaacaaaacatatggaaaaggcaatttttctcccagccaaccccttttcctcggatattttttcaagaaaaattttacagcagatgttttcaaatagatttctatttatttgtgggctaccattatatcagtaggatttctctagaacctttccatcacttcacctgagttttctttatcggaagaaaaaaacaaaaaaacaaaaagaaatgtctgatcacctgccctaagtctacagttgagagcagttttggggactagtaagtcatgttctcttaaggacagcgtctcctaggtgagcggctcgtagtccatatggagcaaattagacagtgaaagaatggtgctgctactgtttctgattggttacggtagtattaaaaaagaacaacaaccgacttgcccagctctgaagaagaaagatggataaaatgctctttgaacacactagtcttttttttttaatgtctgtacagaagggttgcatttatatttggctttccagacctgtctcttgaccttctaattactttatttgaaacagcagtgagggtataataaacctggaggttgtctctcctttgctttatcataaattaaagctgctggtttgttgaggtgaaagtggaggctgaatgttcattactgctcaagtgacggcttgtcaatagcagtgctttttagtttgttctagtcagcacttgctgtgcattttgttggaccactgggaaataaatacaacaagattatacatttggaataccacaagagttcacaaaaaaaaccacaaatgataaattatacacttggtagaaagtgacatgctatcttgtgctattaacaaccaaagataattgcaacgaattgtaattgcagtttgcaacttacagtacagtgtgtccaacatcaatcttaatagtgaacaaagcaatttatattaaaacttaattcacttggtaactttccgctgtatacacgggagctaacagatgtagcttttcagaaagttcaaaggcatttgaaacgtggagagaaatgctaatgcagtaagccttggagaaatattgcattactacttgtaatgaaaacaaatgtatgtcattatctcctagtttgtgtttatttaataaaatatgcagtttgcacattggtgaattcagtgtttctgaatggatatggaataatgttctgttcagaatcaaaggccaaacaggactagcaattacgcatcttctgtaaatagtctgctgtagcatgcaccttgatgcttgagtgggttttgtatgaggtgtaacagcaaaccggggtaactttattcatgactttccttagattggatgtctttgaagcaagaaagggagatctcctggaattacttaagagaacaagcatatttgttttgtgagcttgactgatggccggtagagcagttgagtgaaatctctaaactgattagggctttcgttcaaataatcttctaccgttttcattaatttattccttaatgctattttgctgctcttctaccaaggataataatctcacactcgctgacctccatgagtggatgacctggagctcataactaatcttatttactcttctgaccagcccaacttcatttaccttgactggataaagagccttccgttgctaagcctccgttccttcgtagcattctcgttaatctacagtgaagggggaacgatgggctttcccaatcaagatcccaaagcatgctggggcactgggaacttcgtgcgatttctcttcctttcttgaaaacatgtttccactttattgttccccctttttgatttgaaaataatagagaaaaatgggggagtgggacttcaccatggtcccactctcctaatacagctatttttaccttgaaagttaatttccagccattgaccataggaatgtgtgggttaatttaggtattgttgttgagtacatgaaattttgtatcatgcttttttatttaatgctacattgtttcctgtgttgcttcataattttataattatgcattttaaagactgataatgcgttgtttatatactattttgggtttaattgttccccagtattgaagttaggttacttctacttagttatgctattaggaataatgctgcaataaaaatctctgttttcttcaattagatggtttctcttgaatataatattacaaatggaattattaagtaaaaggtataagtgtttgtatggcttttactatacattaccaaaaaaatgtctaggctgtttttctgtttgtttgttttttgttttttgagacagtctcactctgtcaccaggctggagtgcagaggcactatctcggctcactgcaacctctgcctcccaggttcaagagattctcctgcctcaacctcccaagtagctgggattacaggtgcacaccaccacgcccagctaatttttttttttgtatttttagtagagacggggtctcaccatattggccaggctggtctcgaactcctgaccttgtgatctgcctgcctcagcctcccaaagtgctgggattacaggtgtgagtcaccgcgcccggccttggctggttttatgttagtttgtattgccaccagcgatagagaagtatataattttatcacagtagctttgagaattatcctgactcttccacttacaaactacatggcattgggcaaattacttaaccattctccctcggttttcccatctgaataaagggaataatagcaatgcttaactcataggttattataggtattatattagtttatatatttaaatatcagggagtagtgtctgccacaaaggaaacactccataaaggtaagctgttattattcccaaaatttaatttttcacccagtttaatattaccttctatttaagctgcagtttttagagtaaatgttttaatagtccattgaagctaactagtcaatagattttataatcagtaacttctgtatttaatgaaaaatttaaatcacttaggcaataagccattaagaagaacttctcagtaagaaatgttcagtctgtaaggtagaggcttttagaaattccatctcttaatttataataaaacagcttttattccagaatcatctaaatgggtcttgaatccttaatgaaagtctgaaggagtttagtctggatctcatacctgctcctccattaggggaggccagagccccttgatgacagtcccactaagactgcacactataaggggaagaaatttcccagacgaaattggagcactgttaatactagaagatagagaaatggaggctggacagctaaaaatcacaaaggtacaccaaacttcttaaagaccttattactacagtattctcaacactagtgattgggaaaacaactaaatgattgtagacaccttgaagtatttgggtcacccagtaaccactgcctatgacatttatcctagagataaatgttacttatttttggccaggtgtggtggctcacacctataatcccagcactttgggaggccaagggaggagggtcacttgaggtcaggagttcaagaccagcctggccaacatggtgaaatcttgtctctactgaaaacacaaaaattagctaggcttggtgacgcgtgcttgtaatctcagctacttgggaggctgaggtgggaggattacttcaactgggaggcaggggttgcagtgagtgaccgtgccactgcattccaacctgggtgatagaatgagactccatctcaaaaaaaaaggtggctgggcgcggtggctcgcgcctgtaatcccagcactttgggaggccaagacaggcggatcacctgaggtcagaagtttgacaccagcctggccaccatggtgaaaccctgtctctactaaaaatacaaaaattatccgggcatgggggcgggtgcctgtaatcccacctactctggaggctgaggcaggagaattgcttgaacccgggagatggtggttgcagtgagctgagatcacgccactgcactcaacctgggcaacagagcaaggctctggctcaaagaaaaaaaaattacttatttttattagtcagcacaacattgagaactcatataattaggcattttgctggagaaatggctcatgtttggctgcaaatatcaaagaccagaaaaacggtaacttaaacaatatcaggatttattttccttcatctgaaagaagttcacaaagaacagggttattctggtggctccacaacatcaccaatgttcatggcccctttggtcttgaggttctgctatactttgacttggcttctggcttcaggtttccctcacggtcacaaaagaactgctgtggctcctaatggctcacctacattacaggtaggaagaaggaagaaagggagggaagggtataatgtgcctggcagctgagccaaaccccaacccctttttaaggaacttccccagaagccttgcccaacaatctctacctagactccattacctaaaacctaatcacttagtttcatctataggtaagggaaaactgagaagtgcttttcagctgggtacattgctgctctcaacaaaatcaggcctgtgtgagagagtagaaagggaagaatggatgttaggaaggcaacctgcagtttctggcacaactcccttgtgtgaaggagacagtcttcagctctgtgaactctcctggcagcccttgatgttggccagtattatagacgagaagccaggagagtcataatgaagcacttcctggggcagagaaaaaagtaagtggagtgaatgatgaaaactttaggtcattaaataaagttccaacattttcttcttgcccaaaacattcacaacaaactctgtggagtaggaattgaaggaaaatgtgccatgccatttttctttagcctttttgcaatgcaacgcacaatcaatacaaatctttgcagtaatcatatattgattttcctagaatataactccatttaaagcacttttatccccaagagtagaaacattggaggctatcaaaggaggaagtagatttccttgaccccatctgcagtgcacaattgattaacaggatagttatgagagtgtgagagagagacagagagagagaagagagaagtcaccgaaaggttaataccagctaaagagaaacatgattataggacattaggctttttgtaaaatcataaggtcaggataagataatgataccatctaaaattacacaagattttgagtacttagtatcctctgactgccccagcaacccaacccaaaccccaacaagcatagctgaatttttggggttggcaaagccatgaatggaatgataggtttaggttcaggccccatgagctggcttgataagggaatgagtaatactgattcgatttatcctgagtcatagctgtgtactaaactaaaactttagcatacatcacatcgaatgtttctttgcttcagacaaagcgaaaagaaaaaaggacattaggaaccctcatttttattccttttcttaggaaagttaaacacttcctttcttctactttccctcttccctatcactttactccctaaagatttaaaaaaaaaaatctgctttctgaaaatcccatgagtttaggtctgctgggtatttctatgcacagatgtcttcatcccagagacaagaagagtaattggatggtaagttgcaaaaagcatgcaagttctgctctgcctctggcctgagtaactgggatgtagccaaaatggagaatggtaccccctgaagcaatcgtgagttaatgtctcttacatactccttgctgaaaaggcagagagtgtactcttgtttatagtgtattgttctcactgtatttctctccctaagtccctcttgtttttttgtatcaagactgagttctcacaaacaagctctttattaaattaaatggttcatgtagcctcattatccttctcaatgtgcaatacttgatagtttattttactagcaacttctggagtttgtgtttttttttgttttggggggctttttttaaattttggcttcgggcaaagcaactagtacacattgttagataaagtatcttatctgtcagcagcacccttgtgaattaatcataattcaataggattactaatcaagatttgagatgaatgttttgatagagctatcagatttgtctaatctgtcattagttgacagtcgctgcaggcagagtgaaaacttggcaatagtagacctgtttctgatccctttggcttggcccaccagttgggtagcttcactgattatagcagtggacccaggcattgcaactaattaagttctgtttctcactctccaggatcctccctcctcctctcaccgttttcagaatatgttgggtggagttcagctctcatgaacctgcccatgtaatgaacagatttggtaacaaggtgttccttttggtcattttcacttgataacaaagatgtgccaagccaagtgacaaatctcaagggtgatatggtgtcacttgcaaaaagtggtcaaagaaaaaagagaaacttaatctgttgttaaacgatactaccgattacaactctttccatgtcactaaaatctgtgtcccattttaccaagttgtacattcttggaagtaatttatagcatatcttgcacatttattcagtttgattagataaatgaaagctagtgatgtagattggtattttattgtatacactatatacagtatttaaaattatattaaattttgaaataataataaattatactctgcatattatgtagtactcattaatacaaagatgggatcattttatagaggagtcctttaccaatttttcttcctctctctacattgttattagtataaagatatttcttcattatagaaaacttggaaaattctagaaaagtctaaaaaattttaatttatcataatcttgtcatctcagaatgatcaatattaacattgtatcatcctattaaaattaaataacagcacaaataccttaattagtaattgcttgacagtattgtcaataaaatatgattctacctggcatggtgtcctggaatctgtaggcaacacaaaggaatccagaaagatcgtactttctctcaaggcttcactttctacatgaaaaccatatgggaaaactcatttaggctgttagtgtatcccatatgttagaagtgacaactttttaatttcacaagcatgtcacaggcctcactaaatgaatgctagccacactgagagatttgtagcttggatgatttagacaagggatagttgagagttacctaattagactccaggtgtaattatgtaaggcgttccaggcagcagtgtgctgtgtgttaattaactttcatgctgaacatgcagtagcccctgaacaaagaacagttcatggaggaagaaaagcttccttactttgccctagctttagttattctcctactaaagttaacctctcacactcccccttttttctagttgagagatgggccataaacacaagccactttgcaaagtgttcattagtccctgtaactctcttcctaccgtcttccatttccttaaaacattctttggaaagatcttttaaaaaataagaggtgtatgtatttatttatgtacaactctgttactggttttaaaaatccaagtgacttctaatcctgatttttttgctgcccattaaactccacaagtatctttctgtggtgacggggagaatgatatttactgaactacaagattagctaatatcccatcaataactgagtgccacagacttcctcagttcatcccattcctgtctctaggtagcaacagtgagaaaagcacttattaaagaatattttttcttctactaaattagtccatgacttcatttgtgctggtctctgtttgtcaactgctgccaaaaatttttaactcatgcagtaaagtaagcttcgtaaatctatataattcaactcaacacttgcatgagaaaatatttcaggtaaccagttaagccctgtgtatggatggtaactgattgattgtccagtcctctcccagttctcaagtgagaaaatcccatttcgaggttctctcttcctcctaatcctgtcaccttgacatctgcaggctttagttttctactaataacgtctagaatgacacacaggaccaccttgttcatatggaagataaataatagttctagaattctgtctacaatagcatgaaattaacgtagattaaggatttgcctgaaacgttaagaacagataggattcaacatttttttcttctagtacctcttaccaattatgagaaagaaactacttactaaaacagtcttgatttttattgtctgttggaagaaaggtaaaataaggacttcgttgtataaaaagcattatctggcagcccttatagctatatgggaaatgcctcaaagagatgcatcctagtgaagatgaggaacatttggacaatttgagtgttctctttcagttggataattttcagttggatatctagcaaaacttagtcctcatttttttttgtttgtttttcctctgatatgcaatgtagactacatcaggcctttatagtcaaaaccagaccaaccagttttgaccaagcacttcctctcttcaaggctatgtttagtgcatcaggaatcgaaagacatctaagacataaaccctatccccagagagtatactatctgttagggaagattagacattaaaaacatgaaaagtaaaactctaataaaggatttaaagaacagttcaagataacagtaggaaagatatgccacatgacaatacatgattgtcaaatgcatttacagattccctttagaacaaaaactgttcttgaatccttctaatagaaggggttcgtagagaccattatgaagccttaaaatattaagaaactgaagtattattccataagaatgcctttcaatttagaaatttcaatgcaaaggagaaatctggtttatgtaactggtaaagtcattattttaggttatcactgaattgaaagtgtaaaatgtgaaaattcttatataaccagtagatctctgagaaagtgccagtggacaaccccacagagccaggagaggtaatcaaatcatttcttttagcaagttccaaatatgatgaggttgttttaagctacatacataagatcttagggaaaaaatggattttttagttgtctaaatgacactgcaatttgttacagcccaacggatacttcttgcttgctgcacagaaaagccaatgcactgaaacagtggtgttgcggcagaaaaacagtttaataatctcaggaccagctaagtgaggagatgggagatatttctcatatttgccttcccaagaatttggaagctagggttattaaggaaatttggtgggcttggggctagggaatggatactgctgattgggtggagatgaaatagcacgggcgtcaaaactgtctttgtgcctgagtcagtttctgggtggggcttacagagctggtgagtcagttccttggtgtgggtcacagatctgggtggcatcgttggctcatcagaatgcaaagtctgaaaaatacctcaaacaccagtcttaggttttatgatactgatgttttctatgaagcaatgggagaagttacaaatctgtgaccatgagctatgtgactcctaagctgtaagcaattatagaaaagcaaagcaaagcaaagcaagttatgaaacaataactggttatgatttaactatgcccataccttagcaaaccttaagtccttatcacaattctaaccttgtgggcttttactaatttttttaaggtggttttataagacatgggcagacagatggaaagaggtcattccagttaggtagaattccatatgagagtgggaataaggtagtgtacagtaggtttagtgtgttaagctatctggctgaaacagaaaattcaggaaacttagaccaatatatgggaggcatcaaaagatggctccattctgggaagccttcaaaggtttccgaggctaacagtgacatgatgctggtgatattacaggcagattagtctagtgggcagtgtctacaatggatttgagttgttcttgcttgaggcaaagggatgtacctagagaaaagcattgttcctgaaatgaggtgatgtaagcatgcatctgacagagcagttataatagaaaagacgtgaatttcagaggacttctaagttgacagaactttgtaatcaattggtttggaggatgaagaagaggaacgagccaagagtgattctctgatatcaaacccagaaacaagtggacatttggaggctccaaaaccaatttgagtatgggaagaggttttaaagatacagccatgtaaattagctattgggaagacctaaagtgcacaacattcttctggctgtgaaaattatgaaattattccccaaaggactacttagatcattatgtctgctcagtcatctgaaatatattgatatccaaagtacacatccagtaattaaaaggaaaaagaatccaaacagtttgttgattttgatattttgttatgggttagtaattgccttgactatcttcttgcagagcttgtagttaaaggcttgcttatttcttcatcaagtaacagctgaatttcttctttcttcctattgatatagtttagatacttgtccccctaaatctcatgctgaagtatggtccccattgttggaggtagggtttggtgggaggtgtttgggtcctggggatggatccctcatggcttggtgctgtccatgatctcatggacagtgagtggggtctcacaaaatctggttgtttaaaagtgtggcatctccctcccctccactcgatctctcttgtgcctgctctggccatgtgacataaccgctcctgcttcaccttctgccatgagcaaaagctctctgaggcctccccagaagccaagcatattccagtatcaagcctcctgtccagcctgcagaaccatgagtcaattaaacctcttttctttataaattacccagtctcaagtattcctttatagcaatgcaagaatgttctcacacacctatttaggttaaaaggttttcttatcatcttggttttcagaaatggacaaattgccaagggcctgtcaattctggactgacattttttcacctgcttgaagagatactgttttctcttaagaactagtgattttcttcagttgtgtgactgacttacataatactagcagaattggccacttagtgtccaacagagaaatgaagttgagactgtggggctgggaagtctctggggcaatagcttcaggtttgaaaagtgaggagaaatgaagcaaaaaaataaaaacactgtaccttttgtcaaaccctttgcttagatcaaggaatctagatttggccaaaaggttgaatttaatgcatacagttgtgtggtataaatttgtctttgtaaaggtcagacttgtccagacacagtggttcatgcctgtaatctcagcactttgggaggctgacacaggaggacccttgaggccagaagttcaagaccagcctgggcaatataacgagaccctgcctctacaaaaaagagacaacttaacagggtgtggtggttcatgcctgtaataccagctatatgggaggctgaggtaggagtattgcttaagcccaaaagttcaaggctgcagggaactatgatcatgccatgtactccaggctgggccaccgagcaagacccagtctcttaaaataaataaataaagctcagattcatcccattccagggaatagggaaagttccacattgatcagaactgagtcctgtaagctccaaacaatatgactcgcctttaaagtccttctgacgatacctttccaagtgtctgacttatgatgtgttccttgttgtatagacttgtacgtacctgggctatgtaagtatcacttctgagggtacaggtaggagggttgctgcgagggcccactgtcacttcgggaaagtgtagcagtacttgccaaatttaaaagccattgaaacaactgaaaataaaaattaaaggtggttatttcccccattactgaaaggtatatgtgaaatcttgcatttacttttttttaaatagactttaaacattgattttcctttctctgggaaggcagatgtttgtgtaaccaggaaagaaagctgctctcaacagcagttttctaataaaaggcctacttgcttttccattttaaaaccagtgtttaagagctttatgattctaaaatgaaaagaattcccttgctatacaaggaaaaggaagagtgatggaatatttttgcaagaaaaacgtaccttaatttgccaccttacaagtagcctgttggcatgagtacattggaatgaggaagcttttattaggaaataatcatttccagttctgttatagtcattatcccaaaagtttcccaaattctgtgtacagtagtgtgtcctggaacctgtttagtcacacgtggggaatgaactgagcttttgagaccaataggatggtgtgaacataagaccaggtaatagagctgttctcctagtagttttagggtcttaaaaggggtcattaatgctttcaagtcacaaaacaatctttaaagttctggaactatactttcctacaatcatatttcacatttgcacataagttagcttgaatgaatgtttaataaaaagctggctacattcacaatgttgcgcaaaaataaaataaaaaattaaagctggtctctgtaactacttatatgaggttctcagcccccactgacagtgtgtgttttagggaaggaagcacattgagtcactagcaaaacataattgggaaagtgcatcccttccaaactaatgatgtatggtcactactctaaataaataggggttgggattatccattttgataacctgttttgtgtgctgtaactgttcagtttagaaaatacagagttgattccaaatttttcctgctggtttgaaagaattcatacatctttcaaagtgtgactgatattcagcaaggaagtgccttactagttgaacaggatctgatttgtcattcttgtttttgctgtaaagcaaaatctacttttagttaaatcagtaatttacaggtatataaactaaagcatcaagaaaacagcaaagaagttttttccaagatcattcacatccagaaatgaaatgaaacccctacgaggctccttcttcattttgatggggccattgtggttctggcccctcagtttggttgagggcaacatgcggagtatctcagctgaacacagatccttcatttgatgtcctgtctaaacgtgacttcacaaagatcttttagtcagacactggatagcagaactcctcccctgggagaaaaggtctttaaggtattttgaggggaggagaagggttaagaggtctaatccataactctaaatccccatgcttggaggaactcattgacattgtcggttttaagggctcctttggagccattatggtgtgtcacgctgagacccactggagaacacttaattgtagatcattgtcccagtgtgtttcaaggccttttcagggttttgacaaagcagcctcctccgccacttacgggaaaccttgggaaagtttcgatactgacaaacccaagaatattcttcaggtttgtgcttttaaattaaataactagaattatcagaggtttttctgtcttcctttcacccgcttcctcttgaaatgaaacctcaactggacatagaccccctggctgctggatatgtgttggctacatttctttccttttctaatttctttggttttgaggtcgggattttgtttttgttggtggcagaggtggtataatgagcaaacacagttatcacatgcagagcctgtaagctttgatttcaaaatgtaatcgaaatcacatcatttcatgtggaaccaatttctccttgcctccttcccctgaggagtgaaggaaatatctctggtatatcgttaaatacctgatagattagaccttcagataggttggtggattaaggcaaagcacaaaaaaagctcatgttttcaactgtctatcctattttaaggttcctattggccctcagtattctgaatttaccacattagtcctaatctaatatttagccccataatgttttaaacattttgaccagactcagttcccagcttccatgttgcctatctctgttaacatctctgcatgcatacgagggtgttcattacggctggattgagggaaaaccaccaaaaaaccaattcccatttcttgggcctgggaatccggggccctaacagtgagctcagaatgaattgagagaatccctctgggtcataaagatagactgcagggtcaaaactcaaaaccttgaggttctttttgcttaaaattccaaactcaatcaaaaatgagttcatttctaaaaatgctgcaatgccttctcatggtttttccacactgtaaaacagaagttaaactctagggtcagaaatagttaacaaagagagcctttgtgctaagcaggagtctgtggattgagttctggctcagccagtatatttctgtgtcatttggctttttataagctcattgcctcagtttctcttccataaatggaggcaataatattattgcatttctatcttctaaaattaccaagaggtatagatgtgtagtaatacagaggacacttatgaagactgttaactgtgagtcctttttgctatgtgagatataccagtaaaataagggacatgattgttttggtaggcctctgtacggatacaggatagctcattgaacccgatctcaggaattatagattagaaagttgtcagtctttgatttctgcatctccccgtgtgtccacttgctcccctctttcagcaaaccaactgccactgtatctttgggccacgtgaccaaaaagatggttaccaatgggttttgagttttcatgtctcaggtccaacaacctgggtagagacagaatctctttaggatctcaattccagattcccagggagagaattctgattgtttcacccacttctggaactaacagctgtggctagggagttcaggccaccccgagcgagcatggctgcctggaacctgctacttaaatcatatgcatattggggaggtcagttcccaaaaatggagaatgtggcacacatccaatgtatttccactggaccactcctttaaagagtaagttgaagtacccagagttctttgtattcctcagaagaaagttgctttaaggaataaacataaaactttaaagcaggaagggatttaaagttcacccaactctaccctccttgtcacgttgatgaaactaaggcaaatgaaagagattagttttccagaggtcctaaagctacttaatagcatccagtgctcatgcttttagttaagagcatctagtgtatcttttattcagttttcttctgccatctcacagttgtgcgtatttcagatgtcattttttcctattgcctagacgtgtttcaattataagagatttatatttatagtctctcatttaataggtggtttaaattttatagactcttctactttagaaaaacatagatagtatttacaaagacaacatagaaacatggagaaatgcatatgatataccattacatggaaaaagcaaatgaatgcttatatatagtcattatgttaaaaaatatgtaaaaattacgtatgcatatatcaactaggcttgttagaatagtagtattacgtgtaactttaaattttccttaacaccatcattaaattattttagcagttaattttagaaaacatatttaatacaaatacaccctacactacttctcatcttagagctacctgaacctgtatacctaatgttcttgtgcaggaaggtgaactttctctaatgtaagccatatatattttgggcacagctggaacctttattccggcagtgaacacattgaaaatggagtcctcatagctgtggctaaagctgcattaaattatgatcttagtagagacttggccccagacaggatgacccactagaggcaataatcagaggataagatgttttcaagcatgagtagagtcagactctaggagctgggaagaaccttacctcctgtaacctgacccttgtgggcttcagaactggcagtggaagcatagaacgtttccagtgtttagaggtggaacttggctaaagtacagagagaggactctcagtgaagttccttctgctgccatagcagctgcattgtgattatgcccaacctggaaagtgcctcccccaccttcccaggagcctcactgtctacctctgatggccaaagctggggagaaaatcagtgtctcagataccatctgctatggtttggatgtgtgtcccctccaaattgcatgttgaaatgtgacccccattgttggagggaggcctagtggaggctgtttgggtcatctgggtggatccctcatgaatggcttcacactgtccttgcagtaatgagtgagttctcactctattagttcatgagagagcttgttgtttaaagagcctggcacctctcccctctctctcttgttccctctttcgccatgggacatgcctgtaccctcttcgccttctgccataagtaaaagcttcctgcggcctcatcagaagccaagtagatgctggtgccatgtttgtacagcctgtagaaccataagccaaattaacctcttttctttgtaaactatccagtctcaggtattcctttataacaacacaaaataaactaatacatcatctgactttgaatctgccctcatgtaaatacatctgttcacatgtaaagcaagacagggacacaagagcagccagcagggcttgtaggggcaggagcaacccgagaggtgggcggcctcctgttaacactgctttctttttctccttgaaaaaggcaaactgggttttcaaggagaatgagaatttcagggaagggatcagagagagtgggcactacatgtgccacatctgtcagatgtcttcaaaccattaactcccagaccccaggaagctgctgctctttctagcattttctagagcatctagcagagcactaagtggtagtggcttaatgatataatgttttgtgaactttgatgaggagggagattttctcaagagcaacttcagaggtgcctatacttctctgtttcagagtggatatagaggggtggaagaaggaggccaagatactttgctttctgcaagaagctatagagatcaagaaggaaacatagggatggaggtaggatttctacctatgaagagttatcaagcatttaagtcctatagggcccatgtggcccattcattcattgaccagtttattcatccactgatgtttttcattcaacagactactactaagcatcttcgactatgctaagtcctgagcagacagtgaagaactagaaagacatggccccgccctcatgaagattacaagttaggcctattctccacacttgttctaactcaatctgctacatataccttgagtacccagtatgcgttaggtactaaaaggagctacaaagatgaaccagacacagtcttcaagaacttcagggatcagggaaggtttatcctgattgtaatccctccagaggttttgatcatttctctaatcacttattaggcctcttgcttcctgtaggaatttgttctctatattagattgaaatctgcctgttctaatttcaacttcctttcttctggccctggctagtcctcagtgtacagaattgccattggtacctgctggtcaaggccaagtgttgtgagccaaggtttctaaccttggctgcagttacacttaactgctcctctccgaagctggatttagcagagatttgatggaagccctgcaaacctcgattcaaatcaaagttcaaacctagtgactggttgagtgaactgctttaataataacagtgcaaaaattgaatttaaaataatccttttagggatgcaagatgcagtggtttagccttttattaatattcttttctttccactaataaagattttaagtcaacatctccttaaatttgattaattccattaggatcactccaaaaaaaggtttatcagtggctttgaaatccaaatgggatgaagaaaaaatcatttatatggcaaaatctcagttacactaactagattaaagaccttctgctgaattaaagaaaaaatcaacacacagattatttgaaacaaatgtaaatatgcaacttttaagcacatagagaaatctaccctaaagttgatgttttttcaagttctcttggagcttacattccagtgggagaaacccgtgttaaacaaatacatagaagacaatttcagattgtgagctaggaaatcagggtagaggaatgggtaatattagagagatcagggaggcttctctgagaggtgacatttgagctgagatctgaaagaccaagccacagtcacatgaagacatggagttagcgttacatgcaaagcaaacggttaagtgcaaagtccctgaggctggaatgggcttaatgtcgtggagaaacaggaagagagtggaggagtgatgcgagatgagaatagtcagagaggaaggtagggccataggaagaagttttgatttttattccaagcacagagaatactttagaaagctaaacactgacttttaaaagccatcaacaaaggaaaaatatgcctaaggtgtgtgttttatatgggaccgaagaagaaaataccgaggcttctccccattttattcttccacattgagtgtacagctattagtaaaatgaaatattatttgcaaaaatgctttgaaaatgttaaagcactattctccttaaatttaagaatattgtcctggaaagatttaaaatgactaagggtactattactttatcacagaagaatcatgctgtgttagtccattctcacaatgctgtaaagatgctatctgagactgagtaatttacaaaggaaagaggtttaactgagtcacagttcctcatggtggggacgcctcaggaaacttacatcatggtggaaggcgaagggaaagcaagacggcaggagagggagcacagggggaaaccaccacttttaaaccatcagatctcgtgagaactccctcattatcacgagaacagcatgggggaaaccgcctccatgatccaatcacctcccaccactcccctcccttgacacctggggattacaattccagatgagatttgggtggagacacagagccaaaccatatcacatgttaaactttaagcaaactctccctagtagacccacctagcgattcaaagaaatacatggctatgaggattccgttgccattttccttatctcatataggtctaaggaaggaagatttccactgtttagaccggaagaccctgaggacagtatcctttctggctgccctgctgtcatatgagtccatagggggcaaaggtgaggctttcctgggcttgtgattcccaggatgtctccacttctagggccacattagctaaatggtaattatgaaaatatccagggcaagaagctaataaataagaactgacaggcattgcatagtaaagaattgttgtgcacgctggctcttctgcaagacacacgatggaggttgagagtgtctaacaatcctcctgaaacgtgctgcccgatgtgctgatgatacaaaaggaaacctgctcgaatagaagagcacgggagaagatttatgtcctgcggatggctgttcctattgtcgtggatccctgggatgtttctgagagctttcttgtgaccttcggtttctaaatgtagaacctggctgtgatctctgggaaagagaaaggaatatgtcctaggtttgtccaatggtatcaggaataaagaagctaagatttggaggagccaagatggccgaataggaacagctccggtctacagctcccagcgtgagtgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgccttacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccaggaagcttgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttacaaggaaaactaacaaccagaaaggacatctacaccgaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacagaacaaagctggatggagaatgattttgaagagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagacaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccagtctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatataaattgactaaattctgcaattaaaagacacagactggcaagttggataaagagtcaagacccatcagtgtgctgtattcaggaaacccatctcacgtgtagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaaatcagctctgcaccaagcagacctaatagacatctacagaactctccaccccaaatcaacagaatatacatttttttcagcaccacaccacacctattccaaaattgaccacatagttggaagtaaagctctcctcagcaaacgtaaaagaacagaaattataacaaactatctctcagaccacagtgcaatcaaactagaactcaggattaagaatctcactcaaagccgctcaactacatggaaactgaacaacctgctcctgaatgactaccgggtacataacgaaatgaaggcagaaataaagatgttctttgaaaccaacgagaacaaagacaccacataacagaatctctgggacgcattcaaagcagtgtgtagagggaaatttatagcaccaaatgcctacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggaagtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaagcaggagaaggaaataaagggtattcagttaggaaaagaggaagtcaaattgtccgtgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaaccgacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacttaaaaccataaaaaccctagaagaaaacctaggcattaccattcaggacataggcgtaggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtggggctgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggagaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaattaaaaaaaaaaaaaaaagaatttccctaagtcaacaagacaaggtctaataaacttcaggtctaacaaagacttctgctgtttaatgtaaaaaaaaataaaaaataaaaaataaaaaaataaaaatacttgaaaaaaaaaaaaaaaaagaagctaagatttgagttgcttgggtggagtaggtacaagttggtgattaccattcaggttggctgccatctgggtaggtctcccttcatggaaggccccagcagggaagctgtaatcatgtgctcagtgaaggcaaaagtcgttttgatatctttttagtaaatcattccaccaacgctgtgcaagccataaatgtggcacagattaattgagcaaaaaaagtgacttgcatacagttggcacttctgttcttattaggatcagaaagaacaattgggtgaagatcacttcaggaaaaagaaaaaagcatatgttacttattgttttgggtgaatgtttttatggaaacagggatgccacgtcattaataactctggcatgccatcccaattctggtcggcctgatagattaaacatgagccctctctcattattccagcagccgtagagcattgactttgcctccagcctgataagtattccatgcacattcaagcctccgagttgacatcttcttctaaaattgtttggctgtaataaatataaaactttcaccactgatgtaaagcattgctggttggcatcatttcctacccccttttaattattcctgacactgtggagaaacatctaatataaatctgtaatgtgcactgatgacaaactacacggttgaaggaccatgtaatttctccacaattaattaaagtgcatggagattttttttttctctttcattctttctttctttttttccccccagcagccagatgccactgactagctcagataacactgctgtcaactgtaaaaaattaagatccaaaccgtaagaaaggtacttagataaagaaaccagatgccaggttatttgtgatactaccacatacgtcttgatggaagccaccattgttcaacatctgtagttccacagccttaattacgcacttaactcagcaagcctgtcagcagtttatttctacaagtaccgtcacttttgtaaatcttcccttaaaaattgaatgctgccaatcagcacagggaagagagacagagaccctggaagaccttgtgcaaaaagagatggctgcccgtttatgccggtagcacatgctggtgtttatgggcatgtgtgtgtggtcacccagagaggaaaaaatgctctgctaccatttcaggctgatctaccacctggaattgatcaaaagcaaattaattttcattttcaattaggaatacaattaaattcaaagtggtgagggggggaaatggccatgtttacatatagctcctgctggtgggagggcttgaggaaataccagatgaaatgaaatacttgtctttgtatctttgcatttaactcattcaagtgttaaggtggtggctggggctgctgctgctgggactgcagtttacctcccctggagctgcccctccttcccttcaggcagaatgtaggcaaagggaagagggagggcagtcagaaggtggccactctgagatgcccattcatgggctcttttcccaggatttggccgtggatccaagatatgggtgttttcatgtagagcctgaatgaggaagcagtagtttggctttgcattctgctggctctcagcgtcaaagcattacctggcaaacggatccacgtctggccatcatgagagatattgagtgattgtgtgaaaacaatctggctgttgaatgcctcatgtcacaggatcccggcccttttcacttgacttttctctacattcaactgctgccttttgttggagtaactgagtgggggcctgtggggcagacaggattcctcctggctgcctggggaacagttgacccagtgtgttcatcaccaagggtggtaatttggggagctttgaccctgattttaaggaaagtcaattatttgtcaattatgagtcccagaaatcctgatatgggactcagatgttaaaggcccggctctctggtttcgggagagatcacagtggatctgagaatatgaagcggtcatattctcccagagcagtgcatgttgcttgccataagccttctgtcatgctgatgagattcttctaactatccatcttggagatcagcttctttgaaaaagcagagtgggtgataaatatttggtcatatgaataacaatgaagtagcttcagataatagcttacatctttataaaatcctctgggtgatggatgaagaggaagagaaggttctgggtcatggaaacagctgctttgggtgaaagattatccaaagcagggtggtgaccaggaatccttgctgctccagtccatactttacctcctacccacacccccaaccacctttcttgtcctaaagcaagggtttacgtttcctccctgcatggtatttgtgctttaaaagaagattttattacttctgctacagtggaatttctctttttactagacagttggcatgaccgcagcctaaaaccgcaatggagttgttaacacactgggatcagtttttccccctttaaagctattcttttcttttctttatttttttaaagaggaaaaaaatgctccaacaaatcaacagaactattaactttctgatttatttgctagagagagcaaaaaaagtcaatgtgaactgacagaaacgccagaacagacagtatgaaaacattctatgtgaaagtttccaactgaaatcgcaccacaagcagttggttatctggagatagacatcttcaatttcctgattgcataatagaaatgggatttctttttcctctacaaaaagcgttatccataatgttgacataaagttttctgtgccttgagttccaaagagtactcttctcaagaacagcccagcatcttctcaactgctaacggttactgccatttctcctccttcaagggaaagggtaaatgttgctaacatgatgaaggccagaagaagaaatcttcaagagcctgggagattaactctgcccagctggccggtgtcatggcatctagtaaacaggccgatcctccactataaggagaaatagccttgagaaaaattaatctggttatgggttggcaacccaatagctgcctagccagtgcacgtttctccctttgcaagtatctcagggttagaagtgtctaaggatttgagactgtgattctgggaggttcaggacagttgtcctggctgggcctgagccaggctttgccgtggatctgcccacctcaagaactggcacaggtgataggtagtcttcaaatctacatggcatcccaatacagttggtgacaatgcactgtattttcctcccccctcagtttctgaggacccatttctgagatggaaagttcttggccctggcctgtagcttacatcactttggtatttttaaatgcccatgatctcaaaagcagtcctcatattaaaatcaccctttatatcaatacttcattttatgtaacatagtgttttaaaattatatttaaaaggcagcttcttttgtcttatgtgcccttggctaggaaacaaaggaagtctcttttaagaggtgttttacattttatgactactgagagagaacatagttctttaataggtagatatctaagagagtttcacattataggttttcagagattagaagttctggaacaaggttgtttgataacatctctgaagggcaaaggagcaaacggaaacctcagaggactggatgccaaaacagaacactctctagacttgtgggcaacaggagcttttctgagatcgtattattctcaccgataatagcatcctgccttgactgagggtgagggtgtgcaagatggatcattcgtgtcttatacttcatggttatgggcatgtaatatgttcttcattgagccaggcaattgacagagacgccagtgcatttaagacttgagtctactggaaatgagacttgctctcttgccagaaatggatgcttttctgtgtccaccactatcagacatcttgacttttttttaatcctgactcttaaaacaataatatcaaacaactcgagggggaaaaagttaaatatttccatatgaagagctgattaaatttgtatggttttcttttcagtaaaaattgatatgtgatgaaacacagtgcagctggatggctggtttgggttgatgctgtcacatcctctgatctcgctacccagctgtaagggccagcacccggtgagctgccatgctgctcagaatgcccattcccaggcactaaacaccaatcactgattacctggctgaagtctttcctcttaagtctcatcgttcttctgtgtgccttccttttcaagggcaggctgagtccatgtggagcattatggttgataggcatgtgatgcccatctaaaatacggataataagaggaaagggcttctcaattattggtgtggatatgagaacttgactttttttttttgagacagggtctcgctctgttgcccacgttggagtgcagtggcactacctctgtctcctgggttcaagagattctcctgcctcagcctcctgagtagctgggactacagatgcatgccaccacacccagctaatttttgtatttttttagtagagacagggtttcaccctgttggccaggctggtctcgaactcttgacctcaggagatccacccacctcagcctcccaaagtgctgggattacaggtgtgagccactgcacccggccaagaacgtgacttttgattttcccagtatttggagtgggtgggctgcttctgctgttgccattggtggccaaaggtaacaacagtatattttgctgtagcagattttacagagatgaaaccatcttgccacttctattcttaataactgtgtccatctttcctctctgcagagatgaaattgccaaagagtcagaagctcctccaggcttagccagctttcacctttgctcatcatacatctatggggctcctcttaactcacagatgggctagcgcctgttttcagcctttatcctgatccttcgtatctccatgcccgctccatgtctctctctccaatgtctcttatctctgtcttgcttaactgggaccagttcttccccctccctctttcagtttccaaagatcatctcctgccagatcttggcctaaagttaacttgattctctggcctcgcttacagaagccgaactgctctaaaccacctttggtggcagtgactccttcctgaatgaggtcaggcactcgaaaaattgataggcgacactcactctggggcttctcacatatattcctcagtcgggaatggtaaaggtccccccattcagggacttcaattttgtgacagagaaaaagacaaatttgactgtcaacatttgttgggctccaaggaagttacacgtgtaactgagctatttcagatctctatttgtcaagcccagtgttcactgtgggtttccttacatccctcccctgcccaaacccctgccttcgagaaacagtctacaaaaaaagcatttaccctctgaggattgctttgtaattaaaattttacaaatgccaaataaacaagggcatttttgaaatgtaaatttgtcatttttcgtaagcaacttaaatcaactccacctgccttgagactggtttctccttcagcacaaagccacgtgctcctaggttctcttttggctcctgcagctccgattccccgtgcacttagatcctggtgtcggttttttttttccttgaacactttctgcagtttagttatttgttgtaattatcaagttcatttttctctaatagatgtgattaagtatatttagcactgtgtaatgagttttctgcctggttgcatcttagctaataaggaattccttagcggcaactctgacagctgctacgagtcccaggtctgcgctgccacaagagactccttccatgaactgctagcattagagaaattaactccattacactaaccataaaattgaggctgaaatttgattactaatagatcctcaattcaactagaaactgtagaaacggggtggtgccagtggggaggaaggtgaacgcgtgtgaaatgccagcatccacattttcatcagtgtgtgtgttcaccacacttccaatttatttcctgggcaggaaggagagaatagagccaagctgatggaattaaaactgcgtgattcagccggtataagactggaaatctttgttactgccatgatggtaataccttgttattagtgcctctgtcttcgctgagctgagaaacctcccggtgtgtttttggccatcaaaactacttgccattgtcaccggtagtccagatttgtaaggctaaagtgctgaggacaattagtaattggtgactggctgctatgatgtatagttgcttagcaacggtgcctgaattaagtctctggaagtggcatacaggaagagacaagacaggaagatgaaataggtaccatttcaatgtgtaggtgagtcagtaatgaaaaaggagtgaaagatatttgtaatcatagagacggctgagtggaaaattggggctaaaggaaagaaaaggcggaacttagttcctctcttgcgaagtaaaataagagtaaatggcagttgaatcaccccattgatacaagagctcattctctttctttgacactatactgtgaacccaatgctagctgaactcagggtgcattatttacccaaaaggcagcatgaaaattcatggaaggaagagatggagaatgaagttgcactggcttgaagtctttagaacaagattaatttagcttccgttagttcataccagcgaactaggattaagtgggcgacagggcccaggtttgattcagccctgcttgcaatactgggtggaactggtgctctgatatactgatgttcagtcttgctctgtttggagtagagaagtatcttgaagaggccacgaacagcatattcatttcattagacttggctgttttgagactctgagcagactaagatatcaccctgaactacatgatttagtgagctggtttagcctctggaaggccagatgagcaaaagaaagtggaaaagcagtacaagaccttgatccagatactgagccttgttaagggactgccttatctatggcaacgagctatgtctagaggtctgcaaaggtgcaggggctgttttgcaattagtgttgaaacactgagataaagaaaggatatataggaattaaaaagagataacgtaaacactaacaaagagtcttaatcccctcggctgagtgttttgcatgtttacctctgatcagaattcttaataattttgagtgtgttccaactcaataaaaattccctaggaagaaacaagtcgattcttggattaaaaaacaaaacagaaacagaaaaatgtatgcccatgtctattattttaaaaataaaaattaaggaaattaaatgacacaggaaggttttgtttgggtttagtttggttcagcctactcatgggcacaattcagtcccccattatctactgattagcaggatatctttagggctcagaaagcaggttttctgtctctaccgatggcttgttttctggctgaagaatgaaggtgttttgatacaaagttattattgttcaattgagaaagtctttgccctcctggcctgaagttccccactggagagaggaagctgataacaatctctggttctttcctagtacctataaagggctcatcctcacttacaatagagcactgtattttcaggacaatgtataattatttgggaagaagccaaaatgatgactagtgcgtaacaatagcatgcatgatatcacaatctgtctaatggctgatggttccagtttaaatatcttaagctaagggtgctccgtgctctcacattcattcccacagtcccaccactgctgtcccttaggtaagtaacactcaaactctagttgtttaatactcaactttcctgtaactgtaaactctgtgagggcgggggtcatataccttgcttcccactgaccatttattcccagcacccagcacagggtttgtggcccagagggcacccaataaacgttggttgaattaaattgttagaatttccaagatggcccccagtgagccccacttcctgatattcacagccttgtgtaatgccctccctgtcagtgtgggctgacgcttctgatgaattgagtaagggggaataaactaggttacaaaaggcagtgtggccacttatgatctctttctgtctggactactcacgctgggagaagccagttctacattgtgagcaaccctatggagaagcccttaagttgctgaagcctccagccaacagccatgtcgctgattttggaaggcgattttggaagcttatctcccagaccaaatcaagcctcaggtgactgcagccccagctgaaacattgattgcattcttatgagaaaccctaaaaccagagccatcagctcccaaattcctgacccacagaaactgtgaaataataatgtttgttgttttaacctgttcatttttggaggtaatttgttacccggcattaggtaatgaatatactggccaattaccacatgtatcgattcatttatttattcattcagtaggcattgaatgacaactttgccagggactgtgctagatgctagggataccaagacaaataaagcaaggtccctgccttcaaagaactcacagtctaggagagtgagatggacacggagtcagagaacactgaaggttggtttatgagcagcaggcatacaaaggaggaagctggagtggaaggagccgtaaaattgacaaagtggtctctaatataaccctccccagacacacatacaaatacaacactttcttcctaactttcacttagcttagctgtagacagttccagcaaaccttgtttagcactgctccgtgctacattgactccttatggagctggctgaccactgtggaagagagagcactatcctacattctcagcccttggctgtgggcatcccatgatcaacgtgactcagtttgagtgactcttgccagtctgtcagttttctttcctcttccctggtctctctgtcattaacaccctattacctatggatgtcttcattagaagcaaatgttgttttttgttttttgttttgacacggtctcattctgtcgcccaggctggagtgcagtggcacgatctcggctcactgcaacctctgccacccaggttcaagttattctcccacctcagcatcccgagtagctgggactatgggcacgggccaccacgcctggctaattttttttttttctgtatttttggtagagatggggtttcaccatgttgcccagctgggcaaatggttattttttaaatgaccaaaaaaaatgagattattttaatgctttgtatgctcgcccgatatataaatgcaagtttcactgtggcttgagtctgaacatggttggtagatgtgagtcataccctgggcccagctgcgtccaccaacagaatacttctaaggagcaccaggaagataaagacatcagcccaaaacgctctaatatgttgctggtgagcagtaaatcacagtggtaagaacacatctccatggggaccctgctatcatggcccttctcatggctgattctttagaagactcattcccacggcctcttcctgtgggtgacacagtgccctggacatgggtggtactgtgtggttgacatagggcctgaaggtgggtgacagatgttatggaggagaatttattttattttattttttgaggggggagacagagtctcgctctgtcgtcaagactggagttcagtgacacaatctcagcccactgaaacctccgccgcctccagggttcaggtgattctcctgcctcagcctcccaagtagctgggactactggcacacaccaccacgtgtcagtagtcccagctaattttttgtatttttaatagagatggggttttgccatgttggccaggctagtctcgaactcctgacttcaggtgattcacccacctcagcctcccaaagtgctgggattacaggcgtgagccaccacgcctggccggaggagaaactccagcgcagtaaagaaacagccctgctggtactgggtcctttaccctccagagtggggctcaggaagaaggaacaggaccaggtaccaaaagccccagtaatcccgtcaagaggtgcccaggtttagagatgacttcaaggaggaggaaagcctacacactctttttccatctgctgcaggccacagtggcaaagcaataaaatgctgataccatcctcctgcaggtataactgatttaagtggggaaaggcagacaatctgtgagagacaccaaagattacttggcttttccccccacctcctgtgcatgaaccggagaatgatggaacaattggttgtgtttggggcctttatttgcttttttccctcctctctttaaaaaataaataaataaataaaaaatctgcctttgtctgctgctactgtgtctatttttgttgtggtggtggttgttttaaataggagaacttgtgaaatgagactgcataaaagatggacttgttttatatatgggatattgcctgtccttcagatctatgtgtctcgcttatggaatgaaccaaagtaggagagataaactaatattttgtatcagctcagccagacaatacagatgataaagatgtttcatcttcttatgcatgcagaaaatatgaaaaatcgtagtttacacacatttgctcaattcaagtgtaaaattgggcccctcgattgccctgggccacagtggctgtgttaaggaagctcgatttaccttgcagccgagtgaaaaatgatcagaatattagactcatctagcccacattaaggagccattgcatttcccgacaattgtatgctatctcaatatgaaaacagagcaatttcaactcatatcaggttatgatcggcaattacagttgcataattcacctagtcatctctttgcagggcctttattttccctcttggtgacattcctgagaaagtgcctgataaaaatgtcatatatcatcccagctttagaactcgtgagggggtaatctgctatgccttgctgagcccatattcatcactggatttttgacttggaggggtcatggcactcataatttcctgtttgatattgtcctcaccagctctgacaaggggctgtaaaagctcggttgtaggcagtggttaagcgctgctccagtggggcccatcaccagcaataagagtgcattactgtggctcatgctggagttggccgtttcgaagataattagatttgatgtcaacatttctttatcacctgcatccttttgtgcatctgtgtgtcaagttgttctttccggatttattagcaccctcagagctactctctatctgtcagcttgtgtgctgtttgtgttgacagttgtaaagttaattactagtactaatgagcatcgggcttttggtggacatggcgttttggacatttaaaactataattagtttttttttgttttttgttttttgttttctgtgtgtggtgcttcagtacaaaataaaacgtgttttaaaaaaatacgtcccttccattgcattttgacattctgtgtgcagtcaacttatcttttattcaaaggctccaaaaactcagttctgtttctttttaaaacagacttccttttcattgtaactccatgaataatttcttttgttccttacttctcttccaacttgataacgtgaccatttcatatgccttgagaattaaggatagtgatggtggaatgatcaaaaaatgtgctgggtaaatgttcatctctgcccaatcggtggactacaaattttccacttttaactctcctcttttcaaatcgtactctgggttcaaccgaaagactcagtgaatgaagaagattggataaaatgaaaagtgtaataaatcgttctctgagtggctggccccaaaataatagtgatagctcatattggtgtaatgttaactctctgccaagaatcatggtaatctctatatacagattacctcatttaatccttgcaacaaacctaagaggtcaatactattatctccattttacagacggggaaactaaggtttagaaaggtgaagggtctaacaactaggaagtagtgctgggatttgaatccaatcagtgtagctcagagcctgtgctcttaaacactattctatagacacaaagtatgctttcaaggaaaattagcagactcctggggcatgtattctagaacaacaaaaaacaatcacttactaaatcagatcggctcatttgtatttcactcccagccatactgggacgctagtttcagtgtaatggcaattatctatggcatgtactttatggaggtattttgtttggtctattgcggcagcaaagcaccactcccttgctgctattcatatttactttctattcatcattatctgccattttgctaaataactatccttcccagacataaatcatctataaaaaatactctggctcagagaaaatttcgccctggccctgcaatgatgagataaccattttcatctcttgttgaagcattgagatttattggctttcgatgggcaacagaccaggcatcactctctgctaaacagactcccacttgcatttattcttattgcatttagtgattcaaaatggagctctcggaatcccttgagggtccattcccagcctgggtggggtgttattactttatattagataagggaaggacacacaaagaaacatgcggtgattcggatgattttttatttccgtttagcagtgatgacagaatgtcatagtgaaatgacttcaaaagtcatttttccccactgccctggttctgcagccttgtcccttgagggctcttccattgtacagtgttattaattctgctaactttcagacttcattgctgacaacaggcctcttggctttcgcagcctattacattaaatttcccatcaaaccatgtcagcctctgaggtcacagatttcaagagaagctttagatattttgccatctgacttcatgggcaggtgttttctaaattgcttttaggtttgtttttccagtgtcagaaatcagattgaacctgtttaaaaaaactcagacagtgagtgctcatcaggataagaacaaagcggagtttgaggcacgcctgaactggcatgtgtgtttgtgtgtgtgtgtgtgtgtgtgtgtgtacagccgcacgcatgcacttgtgtttcagttgaccttccaaaggcagagcaaagccttccgactcaacttcatccccggccccacctggtgagtacagtgtcttgttgactatctatttttctaatacttaactgaagccccaaaatatagtgtgactgccctggtgaacagagatatgctctactgaccttgactttggagggctctgtgaaactgttgagtagcattagaaggtcactttgggcaggccagtgaaatgacagaggacctggtctagggctagaatgccttaacatggactcctcaagcaagttcctggcggcaataaaatttcagtgtgtcccttgatgcctttattttggtgtgctgttgtgggatcaaaataaaggaaaagcagaaaccttccttccaagtaacatggccacaggcatcacgttgctgtcaaaattacattctgaaggaagcctgcacaggaacgtgcaactggggctccatttaaaaacagaaaagaaatgagatgttatttttgaagcagtcaactcgtggaaatgattacaagtcatttggcaaacccaaagtccccttgaaattcttatttattattagttccggttaatatttctgctctgaaaatgacaacattcaaatcttggcttgccgtgatagttcagattgacaggcttggccgttaacacctttttggtcttctgaactgggtattgtagtgtgcttggcaggggggtgcggcaggaaagtgacagaccttggaagctgaagaggagggaggacccacacgctggcttcctcagtgatgggtatctaagcacttcagtgcctcacctaagagcaggtgacaagagcttggtggcttgcaggaagcactgcagttaactctagccccgccccctttttttctttataatttgtagagacctcggaagctgctgttatctgaacccatcattagccagctctacctgcaggaggagatgctgaaccaggctaggaccagagaaagatgagtgaggcgaggtagtgtcactctgtttcctcctgctagcagccataaggagagagaatcatttgtggcactctggggacagttttgtcaccctgacagtaatgctgttatgcgctggcttgacacacaggatgaatccataaagacagataagtaactgtgaaagtggctggggatcaggctgagtgccaccactcacctgcagtgacaaatagatagtcatgaaggattggaaatcctgcccaacacagagatctgtcagcagagagatggactgcaaccccagtgacacaggcagctggagcaaagtgtgtgtgtgcacacatgcgcccccgaggggtgtgcggggaggttaacttcagagccttgtttccgagagggtgtgtgtggtggtgcaggtgggatgagaagatttcgacacttttcctttatgaagtagaactgtggatgttgtgtctttttgttggtaagttcaggcacatttggtttagaaggctgtgcttactttccgttttccccggaatttttctgataccaataggggtccccatctgcaaatcaaatgaatccaagttatgagagcaaaatactactgctgaactgctgatgttggtggcaccaggcaagggacaagcggaagcaggggggcccttatttatcttttatgctggaaaggcttgttcttcctggctggaaatctgcttttcgtcaatgaaagaaattccaagggaattgtttgaaaaaacaagcacaaggctggaactgctgtttcccacttgggcttgagatccgaacagcgctacgttttacagttttgaaatctgttactgttattatgcagaatagatcatctttgttgtaattatccttgagatcacaaatgccgtatggtgttctattgtctttctgggaagttatgaaatagatttgaggcgaaaagtaaacataagcgataagagtcaaacctcattgggtcactgtcagccatttggacagaagccctaaatggcccagaggcacagccatttagaactcttttcttttttttttttttttcagtagaatattttgacccccagaggtatgcgtagctatatcggggatccaaaggtttcacacaggatgagtcctgtgtctacatgcagcgtagcaggagctgggaatggaagcaaaccaatattccagcatctgcttctagaacagtgatcaggatcgctatcgttaataagatgggtgtatgtgggacccaagactcatctgtcaagcccttcttctgactgcttttaaggtaatatttttaaaaaacaagaaattacaataagcttttttttttcaaatgagtcttcttgtcctattcctttattattttgccacctacctttgtcatcggtggaattgtacttcatctatttcagctttacttatcctgctagttttacttctaggagcttaacgtagggtactggtaattctagaactggttcctgaaaaatggtacatgtagctttaaactattatcaccactgttgctgctgctattactattactacttctacttgagtgctatatatttaaacatttattctttctatgtaggcaagcccttgcaaccagatatttctttccaaagccctggggtctatttgttagctttaagattctttattttagtttatcattttgtgagactaagaatattttaaagcagttcagctgtaatgaaaacattttctttttgaccctgggttctgagtttgacatgttttgaccctatcattctaaccatgatttaaattctgaatttccagaagccttattaaagatgtcaatttgtgcaccagaatggtaaatgttcctgtgaactttgactcctaaaggaaactctattttaaaagaataaaagattttcctgataaatatgttcctcattttgggctaatactttcagtctgaactggggaatggggcagggagagaccattgcctgaccctacttgctccctcattctgtaatccaaagctattttacaacccacagcattcgatttttattttgccaagaacacgttggtaatgggatgtaaatctcccggtgcacacctgattaaacaggcctgtatacgtgaattaaaaaagagggtgagccccttgccatcacggggtgacagggaagcacgccagataaccggagctcagttggctgaagggagctcggtggctgtttttattaacttgagagctaaggtcatgcggcttcttggggccttggtgaggaaatgtaagtgagaggtctttccctggctgcagatctcctcattctgatgtgcaaggatgctcctggaagtggtctggcccccacccgcctgactctggtcacaatggccactgtcaggcaccaaggcacgtaccactgaggctggggacagctgagtgttagcataacattttattttattttattttattttattttattttattttattttattttattttatttattaatgtactgatttttgacctggggtcttgctccatcatccagtctggagtgcagtggtgcaatcatagctcactgcagcctcaaactcctaggcttgagccttcttctgcctccgccttcccagtagctgggactagggactacaggcgcacaccatcacacttagctaatttttaaactttttttaggaatggggtcttactgtgttgcccaggctggtctcgaactcctggactcaagcgttccactcaccttggcctcccaaagagctgtgattgcaggtgtgcaccaccgcatccggcccacagttactcattctgctgacctctgttgctgctctcctgagtatattccggctttgtagtcaggacatcagatactagcatttgtcaataaaaagtgtcaaatgatgtgaacttcctcagtcttaccaccaaaccctacttttcagcgagagtgcttgcagagagaaatttcttctagagggtttggcttgccttgtcactttctggttctccctgtcttcaccagatcaaactattcgcagagaaaaccgggccacctcttggacctttctgggaatggaaaaattattttggtgataagatgtttccagcccactgttagggatcatggcactgtgcccatcaacacttggtattaccccagcctccttggagtcctcgtccccatctccctctgacctgagtaactttgaggaactttagtatatttggaacccgtatgccagcagcactgttggaagctatcaggaggacacctggtaactaactaacttactagctaacttactaacttatacagctcaactaacttatacagcagagctgtttagactagccacttttgcacacagtacttctcttgatcctcctaacccagtgagatgaatgaggtagatattattggtcccgccttgccttggggacactagcatctgaggagttaccactactagtgagtgttgggaccgggattccccatagcatttttgctgtcccaggagactttcatatgcattgttttcctgggtccttacggtagtccatgcagtaggtgagacaggtgatgaagttttggtctgcaaatggggatgctgaaactcagagaggctgactggctttcttggggacatggcagctgacaagtgacacaactggaaacgtatcccagcccttccaacttttagaccgacaccctttcattacacgaggactaactccacaattatgaaaatctcaaaaacaaagctactctgaagtctctatatagctttgcccttcatatgattccaaattcccatgccagtgaagctgcagttccggggaaaatcccgtgaaaggaaagtcttctttggctagctattcagaccaggccagggagggcttagcagtgtgccctacacccagcgcatgtgctcaccagcccattggtattgaaggtgctaacagtctggactcagatcctggcactgcccaccatttgctgactcatgtcccaggcatttgcaaagtgtatgggctgtcatacagaaatagagtggatgtttggaagaagagtatcaggtgtagctcaggaccagtaggaaaggtgtccctgccagtggggacagagagcaaaagcaacgggacaaacattgaaggcacaatactgcactgtagaggcctcccatctctgcagccccagcttggatcacaagggaagttactgcacagccaagtatgctgcatttgcaaaggtcaggctttaattacatgcacagttaaatggaaatactgtagagaggtcacactcatatttctttggctttcattaatgttattgctctgtcactttccctctccttaggtttgtaaatgaaagttcctttagtacatttaaaagcattatttatttttaattgtcttacctctggagggagaggttacttctttttggggtgtttttggttgttgttgttttttttttgttttctttttttgaatagacttaaaaaaaaaaactttgcctatgcatttctggttaatttatttcaaaccttttgctttttatagtcttatctactaatacttttgattaaaacacaagcaaaaaccagccaacatgaacaggttgaatgccacatctgtgcagaagatagcagctcacttatttatggctcagagaaatggagcctaaattaagctagctattgctggagagtggataagcggccattatgaattatccttaattatagcgatttcctaaactaataaacctgctaaatctttattgcaaaggttagtttacgcagtgcatataaaatccgcatgtgctccgcatcagccaccagctgtctgacagtgtgttgctattgcagtgagtgttcacataaattttatgttggttatattaacagtccgtccatatcactacccacagatgccagtagacataaaaattgctctctagtgagcctaaatatccctagaagctagttgtgtctaatgttccatgtagtatttgaacgtgaaagcaccagattggagggttatttacagatgaatatttcaatccacttagttcatataggcctacttagccttctttgctggtttatttgtatgctaaataattcaccaaaggttcttgtttactttctatagtagtttctatgaaatgcaaacaagggagccaagttgaggtgttcaaaaggctaagcagctctgtgtttaaatgcaggtcagagcagcaaatgcagtcttactgacgggctgtcactcagttttacacattcctctctcctctgtctttttttttttcttcctcctccagatataactggggcttgctgctttcataggaatttttggttggactatcttctaaatttgtctttttcaatacctgcctgtgtgctaccttcagcttgcacaattaaccacccaatgccagcagcaaagaacacatccctggctttgagaagcttccccacggtcctctgggctaacaagaacaggtcaatcctcagctcttgaaatgtccttgttgtcttcctttttttcctttctcattttcttatttttcttttctttttctttcatttctctcccatggttttttctagtgcatttccagatctcaagatttgaaaggacagcaaataggacttttttccttgagagccctgagctcgcccagcctctgtcaacctgaaagccagaagggcaaagtctagctctaaaaaatgcagccttgagaagcccttagaatatatgttcacccaggggtgagaaggatcattgttttctggcaaggtaacagttacctggccctattgttcacatgtccccatggctgaggttatgaatgaaaaatacctatctgcccccacattttgcaaaggtttacgatcctaaacatttgcccccaaagagatgggaaaatagcctcctccattttcagccaggcactgccaagatcatgggcgagttcaatagcagtgctaactttttatttaataatattgattttatcatttttactacttacaatggggattggtcggctgatagttatttgacctccctttgtgcatggctgtggagtgcttcgttaaggctattgacatatatctctcttccccactcttcttccagcagcccatctcggcaaataatattgagatgcggtaactgttccctgatattgatttcagattgtgttcatcacacccttctcggggccaggcagagagcagcagccccagttctgcaaatccttgatggctgcaggctgaagtatcgtttccatctttcaagcaagaatatcaaccatatatatttccaaaacattacccaagaaaacgaaagcattttttgatcatgattatttttttacacatacataattaaactgatcgctccagttttatgttgggctttttctgcacttttctttttaaggaatgctagaagatccatgggtccctgagctggtagaaggaactctgattacatttttaagcttcagggattcaggatttggcacactcggccagacccagggcctcgttgaccttcagttctcagccagctggggccgtctgcaccacctgggcctaaaaagttccatgtttggcccctgtggagtcagttgagatggcagggtatttaaaagaaccagaggtttaacattcagggagagcctacctaatctagtgattacaatcagacgtaggaaggacatgatgcagagtttaggtttgcatatttatttaaaacaccaaacaccaagcaaatactaataatattggaaattatacgttccatggggaaaaacaaaaaggcaatagagaatctataccaagagtgattatatctgagcagtagaattgcaggttatttatattttttctctttgggcatttctatgttttcttaattttcttttgtaattagaaaaaaagaagcctattcataagtattatttttttttaatggaaagattagttggattggagctccagaagatccctgtccaccaaagtgaatgcattagccagggttgaaattgactcactggccatgctaatctctgccccaagggaagtgggacagacatcactcctatcattgtgcacctgccagttttcattttgtaaatccagtgggggttgtgctagcccttgccgctgaagcagacatacaaaatggttaggaagaagggccatggagtcagataagcctgggtttgattattggttctttctcttgccagctatgactttgagcaggttacttaactttctctatgccttggttttttcatctggaaagtggatttttgacaacccatctcatttaacaggttatctcattaaatgagatagtgtatagtaagctcttaacctagtgcctggcatctagtaagcaatcaatacgtgttaattatcattactggcatcgggcatctgtagagcaatttcctcttcaaactagactcataatgagaattagcctaaacacagtctgcagaatggtcatttttttctccttaagcacaaatgagactcagttgagatctgccccagtgtctaatacatataagattttctaggacatcctgattttatatagcattctttgattaaaggcaattcattttaaaatgtatatctaaatggaaattttttgaagattttaaaataaataaatatatgtatgtatcaggagaaaaccttagaggtctttattcacgattctgaacatatgatcaccatactgatagctctttgacatagaaggtgctcctccccacaccttctatccaaagcaagtattattccagaaaaatactggaaacctatcaggaatctttagaatatcgtccatttttttagagtcagttttgctattctcatgcgtttcttacttatagggtcaaaaacactttctaataccacggatggcatggaattcttccctgcaggcagccatcttcaagactgaaagcagaatttaaaaagcagctaaattagagactttacacagttgctggatcctgcttaatgagagacagcgaacattttgcaggctactgaacttctgaaatgtgacaatccaagcaaatgaaatcatggtacctttcattgtagtttaattggactcaaactcggcaagaggggctgctgaaagctgtattcaaagagacagacaggaattgtacaacaactaattcagcccacacaacacatcttacaactgtccaagctccacacttgctctcaagactgactcttttggtcaagagagagatagacctgcagtgaacaaaagcacagattgtaaggcaggccaaatactggcattgggaatggcatagctgtcaccccaagttatgcatttgaaatagctcagtctcatggcagccagtacaggccaatttattttaaagaggaaaagagaagtgaaacaaacttaggccctctcttctgcctgttagggtgtcaagatatcagtgtcaaggagtccagttaacagaagggtgaggatgagttgagcataaacactaacaagagaagaacttagcacaggcctcctgttgagtggagctaaatggcagtcccagttgagtaacccaaaaagcagagaattaccgtagctgtcaggagtgggaccaaaatcctgtcaggcagcggtaaaggggatgggaacggtttgagggaaaggcgagttttgtgggggagtgaggtcaagaagtagactgttttagggcatgcatgtctgaacttaggaggcccttggactgtttaggagggtgtcttggcttccttgttttgttcttgtatcatttgagctctgtggcctgaaactgattatatcatctcagccccttctggtgtaaccatcccgcctgaccacttgagtccacgtttactgttattatggctgtaggtttagccagtaaggctaaaagagtggacaaattgggtgcctgcatgtaacaggccatcctggacattgatttttgaaggttcattagataaatgctgacatcacagattgatgtctctttaaaccagtacctagtgcaggaccgtctggggaatcaaaaatattgatgtaaacatgtttgagtagaaggcccactggagaattccactgcctaaatgggatccatcaatttaggctttctttaattattctaattctatgcatcacatcaataggggagtttgtctgcagaaccggtttttatagggggtgccgcccctacgttaggggcaaaggaaggccggacaaggtatccacatctatttttcattgttgttttgagttgctgtttagtaattaaaatttttgatcatagactaattttcccataccatgtggccgtgcgattgacaagggactgattaatgggctgaccccagggccaggaggctgctgggctcttctcttgtggaaggcatgccggcaaaataaagttgatggttttgtttgtgtttaacccttcaccttggcactatcaatagattgaagacatcatttgtatctgcaagtgtttctttaattaagacctcctaaaaatctttcctattgattcattccattatcctattgattaactgcagtggatcatgtacttggtcttcagtggaaggcaacagcctcagccgtctgtcatgactacagatgcagaccacaggcagccagcagccagcgcccagggctggcaggagtgtctcgcgttctaatgaggcatcagcggtggctcactgaacaccacagagaaagccagttgtctcctgctgaaggggtggccaagcataaagcattccttccagttatttatactgcagccacttagctaacagtatgtacggggctactggcagtcttgagctgggggaggggaaggattctgctgtgcatctgaatttgaaaatcttgagctttgaaataaaagcagactctgaaatctaggtgcaaggcatggttcaaaggctgactgttcgtgttcctttccccaggctgtagttttgtgccccgccccatcctcacactgtcccccatcctatcagcctcctcactaggatggctaactaggaagtaccacagggggcttccgttttggaaggagcttccctctgactcggtcagaaagaagggctggcccttgtttttaccatctgccactggacatacatctaaatcatcccctgctattaaaaaatgaagaaacctgtggctggactagttcttaaacttcatgttttgcaatattccttaacattgacagttacaaagaattattctggttggagtttaaagagagaaggaccttattaggctgtagttgggtattctgggatatgcgaaatcaagtgagttaaaacactaggcacatagtaggttctcaatcaataaaccaataattgttgatccaccaaaaattcacctttcttcctctcctacgtgtcctgttgcgtccctattcaagcattctctgcctccccatccatcaagtagactcaagaaaatggccttctcaagggatgggacacctttcttcccaaatggaatccaacaggaaagagaaaatatagaagtgagggtaccaggcaggaggcagattaagttcagagaatctgatgtctctcttctctgactctttagtaggcaaattaattaagttttacttttggagtgaaaaattctaagactttgaaacatctctcctcagcaagtttataatggtcttcatcttcaggatcaggcttggcgtgggttttcaggaacgtgtgtggccctgagttaaagtcagtggcttttttaaaatagtccccgagaaaggaaggcagaaagtcccacctcccccatgtgtattttgggattaggaaagctagtggttactgggaggagctctctctcttctctctctctctctcccctttttttttttgaggagggaggtagagactgtctcaatgtgttgttctcaaactcctagcctcaagctctcctcccacctcagcctcccaaagtgttgggattacaagcatgtgcattgcacccagcccaggaactcttctttctaatatgagtatttatagaatactcatgtacagaattttcattctatagatttaaagaataaaaatttatagaatactcatttatagactcccatctatagaatattaaaatcaaaattgagtgcaaattcagggccgatttgtgtttcttctatcagcagttgttaacaaccaattgtttgcaccaaacccaagggcttgatttcccttggcactaaatgttatgttttgggtgtcttatagtctgtcctgtgagttaacattgtacaataaactgttttatcaggacttgctgatcatcctgcctgctagttctaccctcgaaaactgttttttttaatgcttatttcaatacttctgtgaaatttgacgttatgaagatatccccaaactcttctccaaaaaaaaaagcagaaatttacttatatctaaggttacttttcctaagccaagtgattcagaaacttttaggaaataattttgaggctaaatatttctgggtttgcttttttaattaacatgttttaaattagcatgtaatctgtcttcattaaagacatgttttgaaaattcagagaagtataaaacagaaaggaaaagtctcctgtaagcctaccaccttgggtaccactaggaatatttgagcctgttgcctcccagtctgtttttaatgcatatatacttgtatatatactttttaaagcaatattaggatcataatattttataacttttgcctcttttcacttactatatcataagcaggttttcttatctttaaatattccttgggaacatgattattaagggaaactagaattcccttgtatggatatgccataatttatttaacttttctcctatcattagacatttaggttgtttcctatttttttccctatcatataaaatgctgggatgaatatccttgtctaaaaattttgtgtgaatctttatcacctaaggatagattcctagaaattgaattaccgagccaaggattcacacatttttaaggctctaccacatactgcaaaatgttcttccaaaaagtgcaacaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatctttttgatttaatttgcattcttttgataatgaatgaggtagcagtattttcttatatttaaaggctatttctatttcttcgtttgtgaaatacttgttcatgtcgtttgcccattttgggggaatgcttggctttttctaattgattcaaatatttttttctttttaattaagaattgtggccctttttcatagaagatcagattagattgttagagatcattagattggatttttcatgtagacatgaagttatacttggaatatctgttggtaatggcaatattattaacgtactttttacttttaaaaatggtttgttcgcctctgataaaaaagatatatgaaaaagaatctgacagtgtcaatccagctctcgttaactatcccaggacgctaccagcattttattacagttgtcaagaaaaaagaaaaccaacaattttattgttttgattattgagatccagccacagatcaactgagcaattaaaatctctaaataacgttctctgaattgtcaaacaaaggattagttcccggtggaaaggacttttctaaaagatgatagttttctctgtaatgtctgtgccagtaaatggttgcactaattggagtatacagaaatattttactagtttaacaatgcatgacatcctaataagattgtgatgacaagcttttctttttatgaaaggtgatgtcaccgcatgcttctaatatacatggactcatgtgtctttttgtgacatgctataaatgaaatttttcgatgaaattaatctgttttactaaatctttactgtatgtgaaattatttctttaagcagggcaacagagtcttgatgcttgtttttatttatagttcttagaataatatattttaaggaatcttagagttgagtagaaaggatcacaattaaatgcatattaaaatgcttgtcccaaatcccatgaatctgtcactagaatatgcgaggccggattccccatcttcccctagctcaggtggctagccgagtgcaggcttgggacggttaatgacaatcctccaagacaagcaggacttaacatcaatatccctcttcctgataatctgtatactctagaggtggtgagctctggcagggttttgatgattttatgatggcttgtgtatatttatagtgtgtttaaaatactctttttagttatcatttgagtgacacaacttaatctttcgatctttacctgcacctcctggtgatgtgtgtttgttaggtaactaaaaagaggaaattaagcaaagccagagctttatgccagcagtaggactgaggagtcaatagatgattaacctgcctttctcctcttcatgagaataaaggagtcactttttcagagcagcaccctagaaacatataatagctatgcagaaatgggcaacatttgagttccacaaagcaagtatacagggaaaagaatagcaggaaatcatttgaatgctgttctttaaacacactgatctatacccccgttgaaactgtctgtgacagtcagtgtcttttgcgttttatatacacatatgtgtttgtatgtatatgcatatatatgtgtatacatatatgccatatatgtatatattatgtacatataaattatgtgggtgtaagcagcatacgtgattggatgctgatattttgttagattttagggacttaaataaacaggatataatcataatcttagtctatcaaagccacaccttaaatgcatccctgtatcatttcatttgaaaaggcatgaaaggccagggtaattagtccttactgcagatgagtaaaggcatctgtgttaataatggatgcttaggattttgaattaaatattgaacctctggcttgcttttcccaaacgatgaggcataaccaccactctttttgaaagctcttattttttatattatgggtcaaaattttaagcaaaagctgaggaaaacaacttcagttaatcggcctatgtgattatttgacatatgtgattaactgactgaggtaaggagcgtcattattatatcataatcatcattatatataaaggaactccaggctaagactgccctcaaagaaatcttaaaaatcatggattgatttgcagatttagtgggatatgaaaagctgatgttgtgcctgaataagataagcattctttattagattgtagtggagaaagccctcacgtggccatgtgattttattgacagctcagaaccaaagaccataaattctgtcaggcaatatactgtcctaggaaatggacatcacagatgccaaagcggcctttgggggcccagtaaacgctgtgtggagtcaagtgaagaattaagccccagaccaagcccagtacctgcatggttatattttttagctggtattggtgaggcttggctgtcgtttgtaacacatccgtgcccctggagcagcttttctctgacatcacctgtgagtcacagtaaaggcccagtagtcatcctgaagccgcctcccccaccaagctactaacatcaaaatgatgtttctcatatgattgccaccttaagacacgggcagcggtaggacaatgtgaagtttgtgcccaaagttcagccagacaggaaaggaagcttcctgagtcccctcagtcaggcaggcaagtgttcatgttcagagaaatcatcaaatgcagagaggaaagaatggtgagctgaaacaatcagatggcaggggggcaggtcagggtggggagctgagtcagaaggaagaggtaggcaaggcctggaggccagaatggcaggcagtcggatcaagaatccagattagtggatttgggaagagaagatcagagactcagaaggggtcaggaacccggaccagagtgacttaaccataaaaagtagaaatctggttaagaggtgggcccttaagagagtgacataccaaggatggggcagtgggggcagtccattttagctccccggccccacccccatccatgctggtgacaagggggtgcactgtctgtcgaaaaacttccaaacaataataaaactaagagtcagtctgctttttattatcccctttcaccatcagttgtgatcaatgtaaaaatccttcctaacaaaatcttccgttggtctaaattctaaacagtgttcaaagttacatctaaagtttacatatacaaatacacatatatgtatatgtaaacttatatacaaatacacatatatgtatatgtaaacttataaacttagtaaaggatatgttactaaaatgtgctaatttgaagtgtgtgtgtgtaaatatatatattatttagtaaaatagtatataattatatataatattctaaatatatattagtaaaataataaatataatatttataatatacataaattataaatatatatttgcacacacacacttcaaattagcacattttagtaacatatcccttactaaatactgtgttcttcatggatgcagagttctcagttacacagtcagctgctgacacacacacagtcagctacacatgctcgtttctggagtcaattcattaccatttggattgttttgagtgcacttcagatagagtttgtgtctccagtgactgtagtgccacatctttctgcatctgaacagtagattcaaaatcaatagtgattaagatgaagaaacaacatttggggtatttcagctctttcctaccatgtgagcacttgaagtttttctttttgtttaaactctaaaacagaaaggccaggtatggtggttcacgcctggtgggtcacttgaggccagaagtttgagaccagcctcagcaacatggcaaaaccctgtctctactaaaaatacaaaaaataaaatttaaaaatttaaaaaaatctaaaacagagaaacagtttataaactactcagtgtaatattttcatttggtaaatgaacatgttcttctctacataaaatatttagctgaatttcaataatgtttttaagttgaaatttatttttcaatagttaagaaaattgttttttaacaattaatttgattgttaaaactaaataataaattttagaaaacattattactgactattatgtgacagttattgggaataatttgttataaaagacagataggtaaaaaataatctgcttcaactgtcagatatgctaggtacgcccttagagatggggtagtatttatgaagatctagtgagttcagtgcctgctgacataatcagtggtaataaggtaatacaagcacaggatggccaaaccaagaatgaagcttgattctgagctttatgaactggcatcgtcctacgttttctgggtctgaactggcctcaaagtgaagccagggctgaagccacagaagaaaatacataagtaaattttactagagttagggaatagaaacaaacgacgaacagacttactgttgatggcagccactagaagaaaaacacatagatgctacccaagtaattgctgcgggattgggaaacgcatgagactatggtaaagcagctccaaggccctgaactaaaactgcaggaagtgcaatagagaggcaacccacggggtgaggggccacactaaatgggcaggctctattatagcccaatagaccgaataggacctggtgataaataggaacgaagcaggccgcacagagagagcctggacgagtttcaaactggaacgtgtatgtcctatctaaggaggcagtcgcgactcggctctggccagttaccgtcatggcagagtattggcccagataagcagatcttcccatttttcaagcagagtcaaaaatctggactttttattaagatctctatttatttttctcttctttttaggaactaattcacattttttaaatattgcaagagtcattactatttaggccaaaataaatacctgtagatttaatgtagcccctgagccaccattttgtctcctctgagccagagccttaacctgttccagttgaatctgttggtcgctctccataccagtcataagatagttttcatgctttaggctattaggtttaataatcataagaagagtaggccaggcatggtggctcacgtctgtaatcccagcactttgggaggctgaaacaggaggattgcttgaggccaggcattcaagaccagcctggttaacaaagcaagaccctgtctctaaaaaaagcaaagaaaagtagaagcattcctgaatattacagacagtaacagaatggctatcacaacagtcacagcttgcagacaccaagctcctcagaaaatattctactaataataatagttgtcattgggctagtcactgagtgccaggcattgtgctatacattttgcattcacgatctcgttgagtccttacagtagctctatgaaatggatacttgtgtctgcatttacagataaagaaacttagcaaagttttataattttcccacgttcagttgtacagtcaggacttcaatcaaagcctctcttgaactgagcctaaattgccgatggtgaggggactctgttagctaaactgaggaaccacaggcagggtggccttgaatttcaggctgaaggacccatcacccaagagtcttggcagcttcctcagcaaagatgaatgggcttgttaggtggtttttgttacctgatcagtaattgtttcaacactagagtttgtcgttactgttgtcctgttatgaagaattctctttaacaaaactcatgggaaaagggactgactcatgtgcagtttggcctgaagcatttgcgtcagtattctgctcctggaagagtatactttgacttatgcattgcttgcttaatagaccacaaaagtcaacatccctctggaagaacagctcgtgcttggaggcgtcacaagctccaaaagatcctgttaaggcaggatgtagtgtgaaacccacaagcgaagcaaaaccccgtgtcccctaattataatgttaatatttaagaaagcttcagaggctgcctctgtgctttatgcctaaaaaggagttgggattttttttcccccttttgcttttcagacctggaatcgcatcaatattttttttcaacaaaagaatgtgtctcttgtccccaggtatggcaagggtacaaagaagccaacttgtagaggggagagagaagaggtaactgacagagtcagagcacgttggaaagtgatacgagaacaggggcttatggttacagccctaccccctttccaaagaaggcgattagatattatttcagatagtttctcactgtgtcctaatttcattttccagcaaccctgtggcaggtccccagtttttcttggacttatgtgattagctaaactagccatgcaggtattggcattacactcacagatatgaaatccagcctgacacccaatcaggacacattcttgagtggctgtgtggccccagagtctcccactgtcttccacttatgcacagtgtatctaaatagacactggccatgttcagtccaccctaaacccttgtgtcaatagccaaagaggaatcagatttgaagccaaaataacaagcactatatataaattactaaacgcccccaaacactatggcattgtttggagatagggcatgtgtaggaatagtaggaggcacctaatcagaaattcaaaatgaacagcctcaccgaacagatgggcagagtctatggactttccttccttcaggagaggatgggccattatttaaatttatatacagtggaagccactagaaccccattctgatgattaaatctggatgatcataatatccagatgcattaaacaatgaccttctcaaatcataacggaacagagatgtcacgtggctctggccaaggacgtaagtgagttcgttcaacaggcattttagttctggtgccaggtcattggggacagagcagagatacagcctgattttcctcagcatctaccgccccgtcagacagggggcaataattcttctcccttagttaaactctgccccacaccctgtttatctgaaaaattactccagtcagattctcctacttaaatattcatgaagatgttatgaggactatatgatgtcaagtaaagggacatggcttttgtgaaattctatttaaactgttgaaatgagggtggtgtcactctctccaaactttccagttccctccaataaacctgtagaaagcagaccaccagatgtttcaaacagtttggatcccaattccacttgattcttgctccagaagctgagaacttaggagcaacttcctgtggaaaccaacattcccaccaataccaaagttttataatatgtagaaaacatgacctctaagaaatgcatgtcaagtgcagcctggggcttggggtgtccagtccagaaatctgcctttggttaaggtattagaagattagggagttactcaaattgtccttaacattgttttcatatgtgttatgggccacgcatgctccatgacttttataacttatgtactctcatagacctacaggagagtccttcttccacctcagggtttgctgatagcctagatggtagaattgcagtaaggttaaacagatgtagggcctcatattgcttctcatacaattttaagaatccttaaagtcagttttcatggtaagcaaactttaatttaaaaactttgagataggagggatcattcttcattcagttcatccaggttcaaggactccttttggttgcaactgacccgccatgctgcttcagaagaaaccctttaaaaacaaacttcctgagaagagaaaagggttacaatttaggagctttttaagaattacctttgggtttttccaagctctcctcttgagtagaaaacaggacatgtcacagatatatattttcttaattgtaaaaagtaaatactctaaaatgtatttttttcattgtgattatgttacagtggtttctatgtaccatagattagatttttattaagggttttattaaataactggtgtttcaccaacatctaattaaatcttctatctaaattgaacagaaaattatggggggaaaagaaagcatttgtagcagactttattacagataagactattatttgttcatcttaagaatttgagatcaaatttacaagcagcatcctcatcgaatttcttttctgggctgctgagccctggccccttgaaagcagcccattatctcctcacctccccccattttattatagtgtcctggttgttggcaacacgcccgctgtttaaggttactttcattaattaaccgaaagttaatttctttgcaagcaaaatctctgatctcattatgttgtctttaaagccgaaagcttcaggttttctggtctcctttgatgacacaataaaaagcatgctctttatcttaagggaaactgtctccagggtttcatttaatagtccttgaaatagttacagcacagccaggcagactacaataatatgccagttttagaaaaccttggctttgtcatggttagagagcccagtgactgatgtgagctacggtggatccatttccgaagaagttctgcactttgcctcgagtcccatttttacacacgacaccgccctccctaccgccattatggagcctatttgagaacagaccaacaccaacaccagcatccttccaaagtgcaccactgcccagccattttactctctgggattttggaaagtttgcgggggctggcattttgtctgtttgcctttactaagctatcttttgttcctctggtggaagcaaggcaacattgggtggtaccaagagtttggggtagtgcttttggagcctggcaggcctggatttgaatcccagcctttccatgtacaggttaagcatccctaatccaaaatctgaaatccgaaatgctccaaaatccaaaactttttgagcaccagcatgatgctgaaaggaaatgcccattggagcatttcagattttggattttgaattagtgatgctcagccagtgagtataatgcaaatattcccaaatctgaaaaagtctgaagtctgaaactcttcttgtcccaagcatttcagagaagggatattcaacctgtactggctctctgtccttgaacgtgttatttaacccttctgagcttcagtttcctcattagtaaactttaaatgattatgtaaagagaattaaatgagataaaacaaagtagcaggtacttgacaaatgttactccccttcctttgacagtcctgttctagtcttttccaaggacaaatgtgtttctagagatggagttcatcctgatatttgggggctggcctacgtacagattgctataccagaaggagcagtttgggggagacagtcagattccacagagcatgttttggtgtggattggatgagttaggttctgtattgccccacatgaccttttacagacatggggacttaaacagtgtattttctttgtctctctgcgttagcttcatcttcagtgatgaaatcttgttgcttcctgaagcattaaattcagtgagttgagagtggccaaaatgtcttttcagagccaccaggtgtaggtcacacagaggggacagaactcttcaggtggctcaagtctcaggagcaatctagatacagggagaagccatttgtatcccactgagtcctgtgatgctgcacacacacagctgagatttacagaggccgggcggggagggctgctgagagggggtaatggcatgacctgccatgctgcttcagatgcctgggagactgggtctgtgccatttgcatatgtcctctgtacccattcctgatgaaggatgcaattgactcaactcaagcaggtcaaaatcacttaggcagaaaatcccaggccttgggaagaaaagtcatgtgcctcttgggcccttggcagaagtcaaaggtccaaggtaatgtattggcaaagatcctgtctgctttggtgccttacttactgctccctaatgcttttaggtggaaatattgtcaacgctattgattagttgatctgataatccagcaggctccctgatgtgttaaatttcctacttttggaggactataagtatgggcagagtgtatacttctgtaggaaagaactctcagtggaccttgctaagacactgcttctacagcgagattgctacaggcatgacaattccaattattcttttggctgtgacatttaacccttcccaagacaaattttctatagttatccattttttccagccttcctttagattttggaaaaacactttgtcttctgcattgggcctgtagggtctcttgatttattagcatggtttacctgtacgtttttagatttttattttttagtttattatgagtacattccattatctagatctttccctccttcacatgccctccatggccaaaatcatatttgcctttctccttgtcttttaccatctttaaacattccatcagccatgtccctcatttttaaagtatatagcaacttcatgaaggatatataattcataatgtgtagatatcaaaagaaaaggtgaccttaggccaaggcagtggaattttctgtaagtaaggagcatagagatgatatataaacatagtgatgacaaataagcattgaagtttgtttgcagattgtttgtttagagcttggtctggaatagcaagaaacctacataccctccgactcgtctcgctgtagttgttggttattcaccgcaccctctctctggcttcagtctccaagcccttcagccttgttgaaagggtctagaggtacccttgcacatccaaaggccacttggacaaatgatgccttcagcttttggggtccacagtgccatttcttctacatcccagcttactatgcttgacttcagttatattccccagtaccaagaacgcaggaggactactttaatcccctttgcaaaataacaacaacaataaggcctccaggcagagcacattgagcctaattcagattttttttaaagtggaaaacaaatcataaatacctgagaaatcaggttcataatggaagccccacgaaaccccttaacctgggcaaaatcctataacacaattatataaaatttcacacctgactgaagctgttattggaacaaaaataaccatttttctgctcgtgctaaatgaaccacaagacccatgtatccagccacagaaaaacacaagattgcccattccatctgcatataatcagcatacttgctggcaagggcactgcaggatcaaaagagttaataattggatcctgcccacagcaaccacacaattaaggacaagattagcagagatgaggaatttatggtgaaaatgcaatgatagtctgaaaaacaaaatgatttcaccgagcagttgttctgttgccataatcctaatgatcaactctattacaccaataataggagaaaaactaattgcagtgaggacaggacaaatctttttaaatctgcattgtcttcccaactaagtcccaacccatttgtattaacctttgctgacagagtcacatgatggacataatttcttataatttaccagctatggatctaacctttcttcatcaaatattcataaaggcaggattctcaatgattttctgtctctcttcaatttagagcttgttgtcttctttcttacagtaatttggacacaattgaagtcaaatggaattaaagttaaatgcctttagcaactgaggtgcctaaaagcaaacacttaggggaggggtcgtgaactgaacggggagagcttgtattcccaagaccctccacgtcccaaaggagttcagtgggctgccggcccccataaggaaaaagcaaactcagccagagaatgagatgccattgctttctcttggacttgcttgggcctcttgtgctgggtgctctgtagctgagttaaaactgagagcccaaggccttcccctgtcttcaaggcttgccaggaacttaggctgccatgaccaggccctgtttgagcatgtgtgcccagcagggtgcaaggaacatgccaggggctagaatagtggacaagaaaagttggttggtacagttacttagaaaacaagcgtgaacacctaaaaccattcctgaaagcgtttttggtttctagaaaaacatctgtttccactttgcatctttgttgctttgacacttttcttaacagggatgtagataggaaaaagtcttctaaagcttagatgtttaaaataagtatagtaaatggtcctttactcttcccgtcgcaaggcttcagttttactgggatggcagaagtttggggaaggtgagatagacaatcaaaagaactccctttttctactccaatcctcagacagccctacctttactacaatggcaaggaatgttgtaaattctccctcaagatgcaaaggaggccaagcacagtggctcacacctgtaatcccggcattttgggaggccagagaggaaagatcactgaaccaacaagttcgagaccagcctggaaaacatagcaagaccccatctctacaaaaaatttaaaaattagctggatgtggtggcatgctcctgtagtcctagctactcaggaggctgaggcaggaggattgcttgagccctggagttcacagtgagctatgatcacgccactgcactccagcctgggaaaccgagtgagaccctatctctaaaaagacaaagaaatttacaaaaacaagatgcaaagaaattgtttcacctagttgacttcaaagtactgtattgaccaagccaagaatttacttcttgctaagttcccagaattttattagaaaggaaatgagaattgaaggcagttgtaatctttaacagctgattcatgtctgcagctaaggtatttagttctagtcaccaccatttttagcatctttatcaatttttaactgtacaagtaatgcacaatacattcactttgtaaaaattaaaactttatagataagggtaaagtcttttgaccactgcttccaaacatagaccttcttgcccttccaaatattcttctatgcatttacagacatacatgtatccaacgacaaacatatgttttccttatttgttttacataagtggttattatgccatacaaatcaatacccacattgcgtttttactcaataatatgccttatgtttagaaatctttccatgttagaacatatcaatctattctttcagagaagtccatatactgtaatttagtatcattccttcagtgatggattttgcttccaggttttcagattataagcaattctgcaaaatgtcattatctggttggaactaagttcatataattgtcttaatggcatgcttaactagcttttgcaagtacagttttcttcagtatgtttctactgacctgatcattcaaaacactcttttaatgttttctaccaagccacacctccttcttgatggtaaggacaaaaacaactatgagatatttcgtattttgaatgccccacaaataaacagatattccaaatacggcagtgaattaaatgttttcaatagggggaaaatgagaatctcctgtcagaaatgcccaaggaaaggttgttatgaaaggaaaacatcattatggcaagtttcttgttacacaaattcggttatacagatcagaccatgtcccttgaactaccactgcacactgggaaaattcattcattcatagtagcgtccttccacacagtattcagttttccatttaccttgtttgctaacacccacgttataaagagttgtcactgattacataaaggatggtttgccaatcaggatatgcatacatggcctcgataaccatccttcagtccaatataaatctcttacaaatccaataggagatggcaggaagttcttttgaagaatgagaaaatttttccaggaaggtttgagggcgaattccgtgagaagtttttcaccagggatctcaggtactgtcattcctctggacaggaattgagtaggtgctgagatactcaccagttaattgcctttgggttagtggaagaagtaagtcacctagccagatcttatgcatttgcacaagtagagaatggaaacttccaatctgagtgagtttaattaaagattctagaatatttttaaaacagttcacactaattacttttagtttagggaataactcaaagttgggttaattgtgttgtcagttagtgaaaaccaacaactgacttgagaatggcagagatagggaaacagtccttccagagtgtaagagatactggatatctcatattccttcagctccaatttgtgctgttaattggctcagtctttcattctatactgagcactcatatctgcatcttataaaaagggaagttgggagacacggttaagagttaatggaaaaaacagataaattggacttcatcagaattacaaactcttatgcatcaagaatgctaccaaggtgaaaaaaatagcgtatagaatggaagaaaatattgcaaatcatataatctgataaaagtttaatgtccagagtatgtaaagagtgcctaaaactcaataacaggaagacaatctaatttttaaaatgagcgaaggatttcattagacatttctccaaagaagatatataaatggcaaataaatacatgaaaagatccttaacatcattagtcaatagagaaatgcaaatcgaaacctcaaggagagattacttcacacctactgggatggcaattaaaaaaaaaaaaagaaaagaaaataacaaggcaagcatgtggagaaatggggctcctccattattggtgggagcgcaaaatggtgcagcacctttcaaaaacagtttgatgggtcctcaaaaaaattacacatagaattaccatgtgacccagcaattccactcctagatgtatacacaaaagaattgaaagcagggactcaaacagatactgtgcatcagtgttcattgtagcattattcacagtgttctaaaggtggaaacaacccacatatccatcaacagaggaatggataaacaaaatgtgttatatgcatacagtggaatattattcagccattctaaggaatgaaattgaaacacgggccacagtatgaatgaaccttgaaaatattatgctacgtgaaataagccaaacacaaaggacaaatattgtatgatttaacttacatagaatatctagaataggcagatccatggagacaaagtagatgataggttaccaggggctgggagaagggaaatggggagtttgttgcctaacacgtacagcatttctgtttggtgtaatggcaaagttttagaaatagatagtggtgatggttgcacaacattgtaagtgtaaatgtgataattccactgaaccgtatacttaaaaatgattcaaatggcatatttttgttatatatattttgtcataaaaaaagttaatggaaccatatacagaattaaagcatgtcatcgacagttacaaaggcatccaatgaaagatctcataatatggaaaacgctatttcagttatgcattgcaatgtaacaaatcaccccgaaatgtagtgagttaaaacaaccacagtttattattcctcatctaagactccggccttctggggttgactagggctcagctggacaggtggttcttctgctgggttcactgagggtcttacccgtgactatagtcagggagcagctgggaccaaaaagctggttctgctgtgactctgagatttctgggcctctctttctccttgtagtctcagggcctctttctctccaagtggcctttccatgtgggctctccagcagggcagccatgctccttacatggcggctcaagacacctaagaatacaaaagcagaaactgccaggcttttttaaggaaatggcccagagtcacctgtgccgtgatctgttgttgaaagcaagtcacagaaagggccagtccaggttgaatgcaggagtgagtgctggaggtgtggtccgttggaggccatgtttggaggctagttaccacaaacaccatggacatatgcatggaacaagtgagagcaaaatcctcatgaaacattataggaaaccaacagataatatctaaaattaatcgatcaagaaatggtatgccggtacagtggctcacacctgtaatcccaggactttgggaggccaagacagaaggattgcttgaggccaggattcaagaccagcctgagcaacacagtgggactctgtctctacaaaaataaaataagccggaaatggtggtgaacacctgtagtcctagcaactcaggaggctgagttgggaggatcacttgagcttaggagttcaaggctgcagtgagctgtgatcacaccactgtgcactccagcctggtgacagagagagaccctgtgtcttaaaaagcaaacaaagaaatcagggtacatgcatattagttagagatacagaaggtaactaccatatgaaacaaatctgcgggttggatggatggagtggaacagtcttgctttttcgttgtgaacccttctacgtcattggatgtaaacctgtgagtgggccatgtttccatcatattataggggagtgatttggagcatgggctctggaaccagactgcctgggttcacatcttggctacctcactcacaatctttgtgaccttgggcaaattacataaccactcagtgcctcactgtttgcatctgtaaggtagggataataatcatagcaacctgatggggttactgggattattacatgagtaaagcacttacagtgccatctggcacatagtagatgctcagaaaatgttggcaattaacaattacaacattagaaaaaagaaaaagggctgggcactatagcttatgcctgtaatcccagcactttgggaagccaaggtgggaggatcccttgaggccaggagtttgggaccagcctgggcagcatagtgagacactgtctctacaaaaagtaataaaaaaacaattatctgggcatgatggcacatgcctgttgtcccagctacttggggggctgagttgggatgatcacttgagcctgagaggtcaagtctgcagtgcaccatgattgtgccactggactccagcttgggcaacagagtaagaccctgtctcaaaacaaaacaaaacattaagaggaaaagggaaaatttgcaggcaggcccatagtgaactaaggatctcaagacctggattctagtctcctgactttgacacaaatgggttgagcagtctattaaacttgcctttaaactgaggggggtaggagagaagataagaacctcccaagaacagagtctctaccaaatctgaagtctaaaagagcaagtcatggctgtccaaaattaccttgctgaaaaatgagaattccttctctttgaggaaagatctctagattctttacagttgaacctgttccttcatcctcacactgtacccaccatggagaaataattcacagacccactcgctgcctccccaaaagacctttctcctgggaaagaactttataaatcactttaagttagcaaccgtaattcccagacgcttacatgagacccactgaaaaaggacgttaacttggaaccagttaaattgcttctagtctttatttgctggcctcctgtacatctctctcttgcagaaggctattcacgtgatcaaccctaggtgagactgtaaggaagtttacctctgcttctcacccagggactgcagaggtcatgggattctcccttcttcacaccaggaagcagcaaggaagcagcatgctctatccaagaggtggcttaaactattatcctccttagaggtagttgcattgtaaaaatacctttccctcctttccccatacatttgaacaaaataaattaatggtagacttcctggcattagttgaaagccagagcaagagtgttcctggagggacaggaacactgtcctgggacccatccattcatgccacacaggcaggccacttgctgatggcacttacgcatccaaccctggccccggaacttactggcggatgcctttgggcactaggacctttgcgagtcagtctcctgctagaaagaacagtttaaattaggaatagcaagttctccaagtctcacagtctcgcccgagctaacctatcagctagcgcggcagaaaacgcataatggagcctccgtaaagtattctgtgccaactcccaggtggtctcagctgcagaactgttcttccaaaaagtgtaaattctaacttagcagtctgctgagaagcccagctccctggcaggccgggcacggggcaggaggtcacagcagctaatcaagtccttgctgtgttctcctgactcaccgccgagctctggcccagtcccagctgaccccactcctgtaatgctcagtgaggagccgaacttctccattaatcggcctgtttgcaggagctggaaaggtgacttgtaacaggcctcttgttcccagactcctctataatgacattctgcacaagcagatgtcgtcctttgattccttatgaccttctgaattttggcaaatgagaaagcatctgggatccgcagtgagggcctaagggtgtcttttctacaaagagctactgtcgtcctccaccccaccctgcctttgcccccatctctaccaggcacgtggcaaggacatggccttgcttattttccctgttggaaaaagccttcttcccagagccagggggctttgagatgaggtggcccagactgtcccatgcttgagcatttaccagacgtgactttgggtccctgtggctgtctcagtttgacagatgagaaaatgctgttgctaagggcccttcccaaggtcaccccacaagcaaacattggtgctgggagaatgagatcacccccagacagtgaaggaatgacagacccacgctttcaaagccccgaaatgtgacactccaccagcccgttgaccagagactacaagacagtaagtaataaatagataatggcctgtctctcctcttgctttctccttaaagatgcccaggtgggaaacttgtggttgtgatgattaattaataagtccgcccagttaacctgaagtttgcaggccatactgcaagcctaaggcggtctctttggcaactcatccttcttttccgaggctccagtgggctttattcagtggcggcattgctagcagcaccgcaaaaacttcagtcggaggacttcagaatttggcctgctctctattgaactacgatgttttaaaactcctttctaaccaagtcatttcagaagcaaaccttgcactgactcagaaggcctgttcagtcttccgtggctctcagcatataggattaccctccttcctcagcctgaattcacggcaccaaaaagaaaaagaacagcataaattggatgtgtgttgagttctgaagatacacatcaggtggacttgggaatccagggaggctttggcgtgattccttcttttctattccagcgcaaaggcgaacaatacatcaaagccttgaaggataaggtttacagccttccctccctcccagccccagagctggagtggcctaggacgccaccgaagaggcgtaagatattttgcttcatcaaacgaatactgtgtgtaggtagagcatagaagtttagtctcatgagatgactccattcctaagggaatctagaggctttctgcggagcaccgtgacatagatcatatcatcctcctgcttaaaaccctccggcggttccccatctcacttagagtaaaatccagtctccacagtggcttccaagagctcagacttcactgaccccatcctctccatcccctctctttgcccccttcctccagccacagttgcccccttgctgtcccctgggcatgcctaactcttttttctttcttttttggcagagacagagtctcgctatgttaccaaaggtggtttcaaactcctaagctcaagcaatcctcccactgcagcctcccaagtagctgaaactgtagacttatgccactgtgcctggctaatttatttattttttgtagagacagagtctcactctgttgcccaggctggtctagaactcctgaccttaagggagccttctgccttggcctcccaaagtgttgggattacaggcgtgagccactgcgcccagccctaatgcctaactcattctcacttacaatacccttccccaggacaagcgtccatcacaaccaccccagcctagtctcttccctcagcctctctattcactcttttttttttttcatttctctgcttgatttgctccagaacacttatctctagcagaaattatcttgatatttatttgcttacattgtgtggcaggcagagaatgttagcttttcatcctgtctcactttttgcttcttccttgaagtcttggttttgacagggaaagggagcaacgtccagctaaaatctcacacttcccagtgactaagttctaatcagtgagatccagatggagggggttacttgtcctcctttcaaagaggaggtaaggggatattatagccctctgtcttttctgctgccccccgcctgggactcagatatggtggttggagtgtcctggccccaaaggtgacttcgcagatggcagccatgtgctaaggatgacagagcagaaaggtggatggaacagcctgggttgcagacgtccatggtctgcttctgtgtgatggtccttagacttctttaatgtgaaataaaaataagctcccatctactttgaccactgttatttccagtcccccttgctagcagctgaatacagtttataaccgatacatgtgtttattacctgactttcctgctagcatgtaagcgccacaaaacctgggacttggtgtagttctctactggatctctagatcctggcacctagtaaatatttgttgaatgaatggatactaaaagcacaaaagtcacagaagtccttctgcccatatcctggctttatcagtggacacttagcaagcatcttcttgatcactgacccagcggcatagatatttatgtgggacaaagcaatgttagtttccaaatgttagctgtagaaagagtgtcattcatttcctaggtgtacaaaatgcagacttgctttggatttaaggccaggacactatgacatctttggagttcaggggcttgttaacatgacaatcctgatgctgcagtggcctggacttcttccctttctacaaaacagctgcaccaacatataattgtgctcctgtcataaaacatccataggcaaatggagcagtttattatctgtaaccttggaatgaagcggcagcttaaagactccataggttctttggcgagagtgaaatagcgcccaggaagtactggagtcaatgacacatatcgctcagaggattagaacttgcctgcaaaaatagcttttgaatcagagtttaagagtgagtggcagtaatcccaattttaccaagttcagtttagttgaaaagtgttggactagtgagtgacctaagtttcagccccaattaatatgacttgttatttatgtggttgtgtgacctggaacaatgctttcacttaagggcactaatccctttcataagggtaccaccctcatgacctaattacctcccaaaggccgaccttcagatactgtcacattagaggctaggagtttaagatatgacttttaggaggacacagacatttagtccgtaacagatgattgtcactgcttcaagtggtgtcagctgtgttgtcctagggctggaggccccaagatggactcatctgttaaggccttggcactagctgtggcctcattttcaaactgggattacacctttctttgctgccctagtagtgaggatcacatgggataatgcatatggacgtaagccatactgtttatatatataactacagtttttttagagatgggaagacctttagggattgtctaactcaagccctcattgtacagatctaagtaatgatggccagaaagtcacagttttgcccaagatcctagggtaaagtagtggcagaactgggtctttaactctcagaccagtgctctccctactataccatctggcttgttaggttgttagcttgctctttttttgttttttttttgttgttgttgttgtgttgtttttggtgacagggtctggctctgttgcccaggctggagtgcagtggtgtgattactgctcactgcaacctcgaccttctgggctcaagtgatcctcctgcctcagcctcccaagtagctggtactacagggtactattacttttacatgcccagctattacttcttcttatcactgttattaacttgctgtgtagcagggaaatcagctccctgttaaggagatacaattcagatgcaagatgctttcaatcccttgtgcactccacagtatttattgctgctaccatgtgtcaaactctgctctaggctttgaggatatagcagtgagcaaaacagacagaaatccctgccttcagagagcttagctcatgtgcgtgtgcacacacagacacacacacgcacacacaaatggcatcaagtgctacagagaaaaataggacagtgaaggaagatggggagtgctagagttgggggacagggaggggagatgtttgctgtcctgagtaaggcggtcaaggaaggtctccctgattggattaaggagtgacctgaaggggtaaggggaggaagccatgtggatattttaggggaggagtgttcaagggagaaggagcagcaggttctaatatgctgagactgctcttggccccttcagggtgagcaaataagccggtctgactggagcacagtgaacaatgggatgagtgcaaggagagggcagagaatcggggtcaggaaagggtccatcatggagggccctgtggaccactgtaagaattttgactttgactcagcttttaaatcagtttaattcatcagaagactgatatgatctttataaattagcatttttcttttgacccaccattttctccctaatcctgaatttgaactgtgtcacacagttggtattagatgctactgagttccctaccctaagtgacctgttagtgaatgtttctaaagaagagaaatccagaaagacccaggaacctcatgttccaaataaggttaaaatgaacttgtgaggtgtttcttggcatccaaaaaccaattaagcaggttacacggaagtagttctaaaaacagcagttcagtggcaggagactgacaggtgagcagatggaggaatcatcaactcaaatttatttcatagcctacaactcaaatgagcattccaaagtcagaacagctggccttttattctgtaagccattgtcccttgctttgcttatctctcaggagtatgagtggattatactcactggcagtctgtctgtcggtctttgactttgcaggggaaaatcctttgtagaaaaacaggctgtttgtgtaaatcagatttttctgtaatgtctgccgcttcctgcagattgtgaagtttctagatatggcattggccttttagcttttattttcataactgtattcgttacttacatgactgctattatttactcagaatcaagttgattctgagtgaatggaattgaaccacatagtcaaaaagcacagtcttccaatttgcaagaagaaatgttttttagaatgttgtagtgcgtttaaaaatcacagccaccttggatttctaatcagaagttattctggaatctttctgaagtttgagactgtcccatgcaaacgttacttaaatttcaagcaacagggaagtcatgagatttggaaagggttatcttttctcaatcatggtcctttgtggagttctgtggtgacagaggacagcggagagaccgtattctgtggctgaaaggagggcttgatactacccggtggggattttgttccagtaattgcatcaaattggacctgctgccatgtcgtaggtatagcatgaatatcattcattaagtcatgcacctatatgccttccctcccaatggctgagtcactagcagaatatattttcttccaaagtgtttgttttcattgttgccctttaaaaataatgagttcattctattcccttgcaaggaaagttactctagactgctttgaaattgtatatcttttgttgagcacatttctgcagtggttccatagcattgtgtgctggggaacccaacccggcctctcttaaagcgtccaaccaagcggcctccgacttgatacatataatcgtccagctcatttgacctttatattgttacctttgggcaggtagaagtcatgcaagtttcgggtgaccctatcatgtgaccagagatcaaaggtcagcagctcctaaatgttcggctgtcaagatagcccattcatcactatcattatgtaactgacaagcccacaaatgaactgggggataaaattattctcagccctctacctcctgggtttacacctcagtggtgggccaagcagtctcacgtattaagtggttccaagggcctgccacagtccctgaagtagggggaggacttcaggagacctatttcatgtgccagaccctgggaagtcaccagctgcctgcctggggagccaagttgccgctctacaggactctacagcggcctgagtctggtttcctctgaaatggagctgaattgaatgttagttctttctggacccaaagacacgtatgtctcccccaccgcaacccacctttagcatctttgtggtcctttgtggcaggttaacacagtgcagtgttttcaccaactggcctgatcttaagagtcacctatgaaaatgaagattcccaggacattcacctggaaagtctgacttaggaccaggtgccattaggaaactcagtttctaacaagggcccaaatgattctcgtgatgtctgtattttggaagaatgcaaagagatttcgaatcagacaattttggcttcaaatcctgaccctatcccttgtttggctgtgaaatcatggatgggttagttaatcttctgggcctcattttcaattttgaggacaaacattttaatagaagatgtatagaatcctagcactcatctttattattgtggggtttttgtttgtttgtttgtttgagacagggtcttgctctgccacctaggctggagtgcagtggcacaatcacggctcactgtaccttcagcttcccaggctcaagtgatcctcccacctcagcctcccaactagctaggactgcagctgcccgccatcatggctgactagtctttttaaatttttcgtacagatggggtttcactatgttgcccaggctggtcttgaactcctgagcttactatctgcctgcctcagcttcccaaagtgctgggataacagacgtgagccactgtgccaagccttattggctcttttaaatgtttttattagtattcttattatccctttggtgtgagaggagatgtcatcgaaagagcattggcatgaggtacaatgtctttataatctctcccatgtcaacaaaagtctctgataaacctacaggggcggttttgagagggacaggagaaaggcagtgctgtgaggatcacacatgctcatcacatggcttgggaggtgccctggtggatcccgcacactgtagcagtaaaggggaaaaggcagggcactcctctggacccctgaagaaagcgtggagatgcctttgagctatttcatgaccataagtggccctgacttccaaaccagcaaggggctcttgcatcccttatctcctcatcttctgacctcctggaggtacgatctgagcacttttaccctcaccccatagagcctttaccataggccagaggaactgggtttttttctttctttttttttttccacttttattttaggtttaggggtatgtgtggaggtttgttacataggtaaacatgtgtcacggaagtttgaggtacagattatttcatcacccggttattaagcccagtacccaatagctatcttttctgctctccccctcctcgcacactccctgctcaagtagactccagtgtctcttgtttccttctttgtgttcataggttcttatcatttaactcccacttaaaagtgagaacatgcaggatttgttccagggttagtttgctaaggataatagcctccagctccatccacgttcccatagaagatacgatcttgttttttgttatggctgcattgtattccatggtgtatatgtggatcttgttgttttttatggctttattgtattccagggtgtgtatattttctttatttaatctttcattgataggcattcaggttgattccatgtctttgctattgtgaatagtgctgcggtgaacatttgcatgcatgtgtctttatggcagaatgatttatattcctctgagtgtatacccagtaatgggattgctgggctgaatattagttctgcttttagctctttcgggaattgctatactgctttccacaatggctggactaaatgacactgccaccaacagtgtataagtgttcccttttctccccaacctcgccagcatctgttatttttttacttttaataatagccattctgactggtgtgagatgatatctcattgtggttttgatttgcatttctctaataatcagggctattgagctttctttcatatgctagttggctgcatgtatgcttttttttgaaaagtgcctgttcgtgttctttgcccactttttaatggggttgtttttctctggtacatttgtttaagttctttatagatgctggatattagacctttgtcagatgcataatttgcaaacattttctcccattctgcaggtcatctgtttactctgttgatagtttcttttgctgtgcagaagctcttaagtttaattagatcctacttatcaacttttgcttttgaaaccctggaagacaaactaggcaatagcatcctggacataggaatggacagaaatttcatgaaaaagacaccaaaagcaatcataacaagagcaggggagctcttaaccatgatttacagtgagacactctggttccatagccaggatgatgggaaacctttaccaaaacaaatctcttcttggaatcccaagttggaactctgaatgttctatctcatgaaaaataacaatcagctgggcattgttttgcgtgcctgtaatcccagctatgtaagaggctgagaaaggaggatcacttgagtccaggaattctagaccagtctgggcaacctagagtgaccccatctcaaaacaaaacaaaaagccctgatgttcatggctatttcactttatagtattattaatattatatttcagacaaactgtaggtcatgtaggtgctgagggaaagaattgggaactgtgaaaaccattgtttatatagaagctgtcttttgagttccaaacaaatgtggagaacgtaagacattgacagcagctgggtaccgcctgcactgtctccttctccaaggcagcaggatggcatagacccacaggaaggactctctaattatgctaattggccaagatccaggcagcagagttatctatgctaaatggaagaaagatttcttgtctgtgcatggtggcttatgcttgtaatcttgaccctttgagaggccaaggcaggaggatcacttgagcccaggagtttgagaccaacctgtgcaacaaagggagatgctatctctacaaaaaacaaaaacaaaaatagccagatgtggtgatgcctgcctgtactcccacctacttgggaggctgaggatcactggagcccaggagttggaggcttcagtgagctatgactgtgccactgtgctccagcctgggtgatggagtgagaccctgtgtcgaaaaaagaaagaaagaaagagttcttgaaaaatggatggtatttatgtggctgaatggcgttatgttggtattcaaaagcacttcaggtatatttggcagtcaaagggtttttaaagcacctgaacagcctatcttatataggacttctcacctcttcccagaagcgtgaggcccaaaagtagatgtatatacaactggaagttaagccaaacccggcttctcaagtggtcatggttgaagaacactaactactaaaaaggtgtattgacccgggggaaaaaaagctgacccctagggagaagtctggcttttcctcactctctgatgtgtgttgactttactgatctggaaacattaacgtggggaacagaggcaagaggttaaaagcctttcaaagaaaaagtgaacgtgtcttttgtcaaaactcatttaggaattggtttggtttagtggttctacaataggtaaactgagttatttgacatgctgacttgataaagccacctttgtccgagtagaccgttatgatagctgtaagtatgactgggtgactatttacttgtaaagttgtccacagtgtcatgatagcagtgacaaaagtccaaaaagacacattacaaattcattgacttgttcttttcagaggatttagagtgtcaagggaaagattattataaactagactgcaaatttttttcaccactcgctataacagattatttggagcaaaatatggtgagactatgaaaaacagtgcaatggagtgtcctcttccatgaggttagattttaaatgtagcgcttaaggtaggcatcatggaggtgagaattatacatggaaatcccttcaatttgtacatcaggtactggcagggatttagataccatgttaatatgaaaaatacttatctttacaccctggaatcactctgtatggcaagacatttgccacacaaatacacattagagtgaaatgaaccctcaagatactgaattgaacagaggacattagggtcccatattggtctcacgctccctttaaagcaaaaggccattgagaggattgttgccctatgacatcattatttcctgctgatctggcaggtgggttttgcaggttcatgtggacttgatgtaacaccaatgttttctacctgaggcctctttttttttttttttttgggatggagtttcactctgtcacctaggctggagtgcagcggttcgatctcggctcgctgcaatctctgcctcccgggttcaagtgattctcctgcctcagccttctcagtagctgggattataggcgtgcaccaccacacctggataatttttatatttttagtagagacagggtttcaccacattggtcaggctggtctcgaactcctgacctcgtgatctgcccacctcagcctcccaaagtgctgggattacaggtgtgaaccaccttgcctggctcctgaggcctcttaagccttggtattggcttatgctattgcacattaggagaatgcattatcatgtagctgatgccctcaaacagactcctactcagcatttggccaagtgactgtcaactccttaaattcaacttccagaaaaaacactgacttaaagaagaggagacttttaaacactgggtattttctgatgaagctgtccatttaaactgctctagtctttagaagtgtgatgtctttcgtttttatttgcgagcgttacaagcccttctggccagcgttgcatgatcactagattgatcagcgaggttttaaaaataggacttgtatcacataagaagagggatactgaggcataattatacatttatatggtagtttacatattttagagtgcttttatatgtgttatttgattttatcttcacataacccggtaaagcagagaagcattaacttcattgtaatagttgaggaaactaagagattgagatatttttctcaaggtcacccagggaatatattaataattagagatagtttatgccctcagaagctgaacatgtatcttttatttctatagactgtagatacttatgctgtaagggcctcacagtcaaaagaatgaaaagaagaaaactaggttttgtcagtcatctgacataataatagtccttctagaaactggaggtaaaaacaacatttgcttctttcctctgaaatgatttggaatgtcctgcatatttaaatttgacaagaatagctgactagtcaatggacaggatccattttagtccaaatggaaatccatgaaaaagatggaacggagtgaaaagggcagccagccagatgtccaggggtctgacccgccctggctcacttgcacaccgttccatcaaaccttgagtaaggcagccctcactcaaactggggatccaaatacctacccctgccatctctcctagattattaggaaagtaagaagcagtgctgtggattgacattattcgggacatttaaacattgtacaaaatgtaattgttattttaattaggagttgttctcctctttcccactgaagaattccctcttaggagttcatttctgttatctcttcagtggcccatgcttggtaatatttctccatcaagttctagtctgtgtgtgtgtgtgtgtgtgtgtgtgtgtgtgtgtgtgtgtgtatgttacatttgcttattctgatgaatctttcagcagaaaccatttctcctgaaatctttatcatttcatcaagagtaatggaaatgttacctgtcctttatttgttgcaaaatttagggacaaggaagaagaccgtgtatgttttcttaaaatcaatggccagcacattactgtaaaacctattgattaaaaacacaaagtataatgttagtcatttagtctgtgaagtgatgcaataagggaagaaatttatcctttgacttttgcattaaccttttattgactgcttgcatacccataattaacacacactttagctaaagtggttaattttagcatggtgaccagtgttcactaatgtagctgcaatcccgatcttctaaatgtaagtgcagccctgggggaaatcagcgggcagtgacgcccttcatgagttacaccttggtcaggaggacctctagacaatctgctagcagccagccaatgtgacacctttcggctgcttcctgttacgtcactaggtcattcagggagaaccactcctaagtagctgagagttttaggaggtggtttatagagtgctttgagtcaaaataatgtgaatttaggaaggagagagagaaaaagtatatatataatatatatactttatatacacatataatatgtaatatagtatatattgtatataattatatgtatttattatataattattttatatattatataatattagatataattattctatatatttattatataattataataatagttatatcatataattatataataaatatataaatttataaattacatataatagttatatcattatatattatataataaatatataaaattatataattgttacaattgtatgtaatagttatataattatatattaaatatataaaatatataattgtataataataaatacatataattgtatattttaataaatatataattacatattatatatacttattatatataatttatgtatatcattatatataataattatatataataatataataaatatattattgtatataaatatataatacacgatatataatatattaaaagtatatgtacctactatattatgtatatactttatctctcttcctcctaaatttgtattataaattcacattacatattatatattatacataatatataataaagtatatagtataaaatacgtatatataaaatatttgtatttattatatttaaaatatttatatataaaataataggtatacatataaagcatatgtttacaatattttatgtgtatatacatattattttcctttgctctccttgaactgcttcatgaaaggggcagtattttctgaacagatccaagtttatttgctaacccaagaaacattttaaaaaatgggatttttccttaggataggattagagaggacaggattgaaaggggaaactgtaactttctaattgtttagctgggttcagtaggacttgggaatgacactgagaagggaatcttgttaactttctttagcaacattatccagccctagtcctgaaaattggcttattttcatgcaaaggccagtgtggatggaccagcattctcttgttttctgggcagaaatttgtcccaaatagaaatactatttgaaacaaaaccaaatgtcagtgttttcatgggttcatacccaggtattctctgcacacactacgctgtatcaaccacaacatctcagtttggagagactatctgcattcacttggctaaggcaatggatgttataaaaggcaggaaataactgacagcaaggaagcatggccggcatatcagctaggattctttacagaaaaacctaactcagacaataaagtctcatgaaactgaaacatctaagtgaagcatgactcagatactcaaacagcatcgtacaggacccaccccttgctggacggcagcaaaatgttgatggcagttccacatcacacatcctaattgttcataggccaggagaggagaaagtcttttcctttagctcccataccagtcctctgatttattctcttgattttgccccatattgggtcatgtgcctcctcttaaaccactccctgtggctaggacagcgtgatgtactgacgtagcttaagccaatcaaggctctcccctggctgtagaggtggagctagtcccacccacatcaagtcatgaagcatggggaagggacaggtaccccacaggaaaattagaatcctgttggtggaacggtgggagtaaatacaggacaacaaatttccatcacagtcagtattcctcacacatttcgtaagacaatttggggcccctttattttgcaagagactatgtagagtattgtgtgctaagaaacaatccaactttatttcctgtaaatacaaaatcagtctggaacaaccaccatttggaaggccagacgacaatgccttttatcaatcctaggtcttcaggaataactgctgatcccttctgaatctgaacattttagcctgacactggaaagttgtagcagcttgaatacataagcctcagggtcttggaatgtcaaaatgtgataggatccagccttaggtgcaatttgattcaagccagacagagctgctcctgtatccccagagcttcccctagaaggagtctgtctagaggctacgcacccagttagtatgaaggaaggagactgcccaagtataacaggcaactctctcattggcatttctcatctgccactggtacctggagtagaagtaacgatagtggtaatattattttataggtattgggcgcttgctatgtgccaggaaatgttctaaacactgcgtataattcatgtaatcttcacatcaaccccataagtaagatactattattaccgtcaccacttgacagataagaaactgaggctcagcgaggtaacaaaacctgcccaagacgtcatgcccctggagagcagcaattccggcaatcaagagaacacactctttaccaccatgctgcagtctccctgcttcccatctttggaaattaagatccaagaaggaagaatgagtgacctgagcaaaagaaatgaaaccctaaagggggacagatgtgccttccagtaattcccaaccttctctttatcagttccatagtctggcatgattctaaatcacaaaatatcatttgagttggggatgtctgtcctttttcatgggtgactacatcacctccaataacgagcgctctgctggcccctattactatcatttggaaattggcaaggaacactggacattaaagaaaaaactttaaagtaatcttgaaatttctgaatgaaggctctgaagaaacccaacaaagggttctactcctggcccagatggatgcagtgactatgtgcagcttgtctgtcagagcttgcatgcaaaggagccacttcccataccagccagtctttgtttttttcttcttcttcttcttttggaaagagtcttgctctgttgcccaggctggagtgcagtagcacaatcttggctcactgcaacctccgcctcctgggtccaagtgattctcgtgcctcagcctcccaagtagctgggatcacaggctggcactaccatgcccagctaacttttgtgttttttagtagagacagggtttcgccacattgcccaggctggtttctgactcttggcctcaagtgatctgcctgccttggcctaccagggtgcaagggattacaggtgtgagccaccacgcctggccccagccagtcctttgatgagaagaacaacagcagaaaactgtgaaacagcttcgcccaaaagaaaagccattgggattgggaagcttgtacaacacagcataagcaaacctctgcagcaggcttcgatatgtttcatactttctcaaagtacggaggcaaaacccatttgacaggtgaaaaagcatctctattgactttctacaaactttatgatattctaggtggatcgacacttatcatagccctttaatctgccagccaggataatgtgtgcacggacaatttatccactgtgagattgaaatgctcaatttggaataactttccctacccagtaaattgagcattactctaggattctgagacagagagaaagcacaattttaaaagctttgcagagttcctttgtaattagtcgcagctttccttgaatattaattttccctgcatccctttcaagtggttgagagactgtctctacaactacagagatgcaccctcagaacaacgacagcaagcggcatggtctcaaacacctatgattaagtagtctacagaacgcaccctctgttcttcagtgcagtgtgtagcttatcagtgcaaacagtttaatatttatgctaagaggattgtcaaaagcagcttctgttgctttaattcttgttttaaataaataatgagaacatttaaacacattactcttcttggggccccggggtcagctaatcttattatttatgaagtgatgtgctacataatagtacttagtgcatgttaacagacgctattatcagggccggatgcagagagctgaagatatattagaatgttatgtgtaatgtacgacggattgagtgcataggatgccggtgtagcaattaaccacactcgaaaataggtgtaaagttgaagtatgttttccccggggggatcccctcaccattaataattccccagagaagaagatgtctttcagttaggaaccctctctaccatcaggcttggaaatggggccaggatattccattctttgatctcttcatagtcagtcctacacagtcagaagacaaatagtgagcatgaccactttttaattgatttagacaaaaatggagagaaggcgggggtggagggaggcacatgtgcaatgctcccaagtgtcctcatagtgtttggttttgatccactcgttttcactgccacgtactccaggagagtcgagaaattgttcattccttaatgcaatctgtttccttctctctgatcctcattttgcagataaataaagctaaagccactgagttttcccaggtcactttttaaataagccagtctctctgagagatagatgcctgccaaggtgtaagaacgttgccccaatttttttcctgtgaggctataatttagcttcatatgataattaatttctctactattgatgaataatccattcaataaaaaccgtgatttaagtgttttccttagggactaactcttgctggcctcttaatttaattttgtgcaagtttttcccacctcttcatcagtggaaatgattattaacctctatttgcatatatccttataaatcggtctctccttggagtgcctttttctgagcacagcaagctgggacacttgtaaatctccaggatctccaaagtcaatcccggcctgtaatattgtttaatctattcttggacgttttaatgcagtaaattcaatttaatctttcccagtaatctagtaatacattgaaatcccacaaacatttaaatctgataatggcttaatcacacactttaaataacagttgagataatgaaaaaataattcaccattttaaaggcagagtaactgaatttccctgatgattggcttctacgaagccacctgagataatacaaatctgggagtcaaagcaaaggaagtcccaacaccatcagaaacagtcttccttcttataaacacctgcgttccacctgtagattcattcagtcgtcaccatgaccttcacccccgaggactgtctttggagcattggccagtgttgctccaagcttcctgtgggttggggtcttctgggggtttcctcccgtggattaatttcctatttttactcttccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagat

SEQ ID NO: 37307 - DNA, 105390 bp, Homo sapiens
ggccggtaccggcgggcaggaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggtaagcgcgtctcctcccggagcccgcccggccgagcccggtcccgtccggaccccagagagggcgcaggtgcgggtcgtccccggggcccgcagctctctctcacctggcgcagccccgcgcccccggccacgctcactctcgcctccgcgggcagcgcctgctctcccggagccccagaaggcgcgcggtagggaagccgagcacggatgaccccaggcaggtttccttctttgaacactttcctgtccccagcgccccacttaatagacgcccccccgcctacacacctgcaatacaccccgcttcatccctgatgggaagggagaaggacctaggctttggctttggggacctaatgggacagctctcagaggagggaagggacagagcgctttagtacgtcgcggacttgctgtctaggagtggaaatctcagaacttcccaaatcgtggctatttgggagcctccaggcgcggggctgatgtcagctacaccattctccagaagaatgaagggcccctaagaatcgcttagggactttcctattccgagagctgttcaggaagccacatttagagaccaaaatcgaaggtccccaggcaaaatatcctatgaagtgacaaaactttggcttactttaataaccaataaagttaatttgaccgctgctgatttactttgaaggagcctaagtaaccaccttgcctgttcatgggtgctttactaaatagaaagaaaaaaaaaaaggaagaagaagattgtgagatgaccagaatgattaggtggctaggtttcctggacatccttgcttgatcgtgaccaacgtttggatggcggtgaacgtacacgctttgttattataaaaattcatccgaacatactgccctttgctaaaagtcttgatccagatgaaaactccgaattgttctggcattgcattaaggctttgatagtatttaaatcagtgttctccgtggatttagagtgcgcttcttagtaattttatccccaggttcttttcgactgaaatatgccatcaaacttgaacgctgattctggcactgagctgttaactctggaaggaaataaagtgacaacaataaaaagttcaaaaccactctattatctattttttcataaattaatcgtttcttcccccaaataagtaactttacaactccaataaaataaagttttatgaggattgcattctgctgaagtcactgatgtataaatattctcctcctgcagcatctcagacattaactttatgaaccaagtatttgaccacaaatgcaggcctcactaggggaatgactcattctcctgtaatataaagtagacaataccttatttaaatacctatttaacgttttttaaaaaagaaattttaccgtttagggagaggagtatagtatgccccttaactatccttgcatgttctacaaaagggagcataactcttactatgctaatattataaaatgggacatactttgaatgttaactccatattattttccctcaaagagtagcatttctagaaagcccagccaattgtatgtcaaatgaaaagccgtgagtagaattctgattcaacatgccataataggcccaccacaaagataaacttggttaaactacagtgttttcaccctgtttgtggttcttcatagagattgcataggacttagttaagtactctttagattgattttgaaacatagaaattttcttaaagtaattagtgaatacacatcactatgagataaattatgactggctgcattctcaatacatttaatgagcaataaataggacttcccgtccatttttattcctaaggaaataaaatcatttttacatgtaaaggatgatcgttttcttacttggctgacatattttaccttccatttccataaacattctactcattttaggacatataaaatgcattaaaattatgctattcaattaaatggaaagacagttaacttaaaatctgtttaataagatgaaatacaccaaataatataaatgaaataaatgtatcaatttcagttttattattcaggctgaatgattccattctccaacgctcgaaattcagtctcctctctagaaactatttatttaaggttcttcatacactagtgtgagaagagtattttcagcaactataccaaaaagtgaataggattctcttttttttttttttttttttgacaaagtctctctttattgcccaggctagattgcactggtgcaatctcggctcactgcaacctcacctctcaggttcaagtgattctcgtgcctcagcctcccgagtagctgggattacaggcgcctgtcaccatgccaggctgatttttgtattttagtagggaccgggtttcaccaggctggccaggctggtctcaaactcctgacctcaggtgatccacctgcctcggcctcctaaagtgctgggattacaggcgtgagccaccacgccaggccataaataggattcttaaatgtagcatatttgattctattagtagacttcatgttttgtgtaattttgctcccggcgagaacaacatttatatagaacaatgacacaaaaaacattggctcccggggcatcaataaatgcacagcagccactaagagttggacaattacaccagggtgtatgataataacctaagttgctatcctagtcacctcatcatgtggctttttggcatgtattttattttatccttttaaatttaattttaaactaaaactttagtttttaaaaatttttctgacttttattttcctaattatattaaactcttctttcaaaagggtgttaactccttgagaactatgtaagtgtaaatttttatcgatcaggtagagaatcattggcttaatagatgtcacaagtccaaatgtctatagatgtcaggaaataaatctaagagtgactggaggccattaacttaagtgaaacaagctagatgcagaaagataaatactgcatgttctcacttataagtgggagataaataatgtgtacacaaggatgtggagtgtggaatgatagacaatagagactcaaaagggtgaaggagtgggaaggtgtggaggaatagaaattacttatttgttacaatgtatgttatttgggttatggatacactaaaagccctgacttcaccactatgcaatctctgtgtgtaaagaatctgcacttgtaacgcatacatttatataaattaaaaaatgagaaaaaagagtgatgagagcttgaatggaacaggcaggatgtaatgcaacagagaggagatggcactgagggaactgggggttttgtgagtgaattactgttaaaaaggaatgtaaattcagtattgccagatcttctgtttgttcttttattttgagagaagacaaaatttagattctctttactctttctttttctttctttctttctttctttctttctttctttctttctttctttctttctttctttctttctgtctctctctctctctctctctctgtgagtgtgtgtgtgtgtgtttaaataaaaatctaattactaaatactggcaacaattcaaccatcatatagtgtgcattcacacacactcacacacaatttcagctgggatatatcttatagacagcctaatctgggactcagagagaaagtctaatgttaataaagaatcaacccaaataatgaaaattcatgaaaggcagagaagcaagtcccatttctttttaggccagttctattctatgccaggaaatgggtccagtattgggggctttgcccattgttctggctgtctattcttggtaacaaaccatctccatacagagtagcttaacgcaatgacaaatttcttttgctcacaagtctgaaatttggtggggacaactccaaagtgggtggttggaagaatatgaagccttgtttccttgaagttatggctggcagttgatgttggctcttggcagggaccttgcctggtgctgtggtaggatcatagcctctctgtgtggctgcttgactttgtcacagcatggtggcaggtcccaagagggaaccaagaggccaggtggcaactgtacagccttttatgacttagtctttcactgtggtcacaagcccactagattcaagagggaatgtagactctatctgaacatcacgtaagaagacagtcacatgggaattcagcagtgaagccccaagtcttggactttctatgttgggggagactttttattactgattcaatctcattactgattgttggtctattcaggttttttagttcttcttgattcagtcttggtaggttgtatgagtcaaggaatttatctatttcctctaggttttctagtttgtgagtgtattgttgttcataatagtccctgataatctgttgcatttctttgatatcagttatacttgtctattttttcatttttgattttatgtgggtattctctttttttcttggttattctagcaagttgtttatcaagtttgttaatcttttcaaaaaactaacttccttttattgatcctttgtattttttttgtctctgttttgtttagtgttgctctgatctttattatttcttttctcctactaattttgggtgtggtttttcttgttcttctagttttttttaggtgaattattagatcatttatttgaaatctttctactttttgatgtaggtgtttgttgctataaactttcctgttagcactgcttttactgtaccctataggttttgatatgttatgtttccattttatttcagaatttttttttcctctttaatttctttcttgacccattggtcattcaggagtatgttgtttaattttcatgtatttgtgcagtttccaaagttcctcttgttattggtttccagttttatttcattgtggtctgagaagatacttgatatgatttcgattttttaaaatttgttgagacttgttttgtgtcctcacatatgggctgtcctaaggaatgtttcatgtgctgatgagaggaatgtatattctgtagctgttggatgaaatgttctgtaaatgtctgttaggtccatttagtctaatgtgtaatttaaatccaatgtttctttgttaattttctgtttagatgacctgtctaatgctgagagtgggctattaacgttcctattactgtgttggagtctatcactccctttagatctaataataattgctttatagatctgggtgttttggtgttgagtgcatatgtatttagaattgttgtatttctaaatatatatgcagctcttgctgagttgatccctttattattacataatgacattctttgtcactttttagtgttttatacttaaggtatgtttcacctgatataagcatagccactcatgctcacttttgatttttgtttgcatggaagttcttttcccatcctttaatttcagttagtatatggctttacaggtgagatgagtatggtaagcagtgtatagtcaggtcatgttttttaacccattcagccagtctgtatttttaagtgaaagttttaatttgtttacattccgggttattattgatatgtgagagcttattcttcttattttattaactgatttctagttgttttgtgtatcctctgttcctttcttactctcttattttttattattgtggttttgtggtttttctgtagtggtaaccttctagtcttttccttctttgtatgtttgctctagtagtttttatatttcatgtgttttaatgatattagatattgttctttcacttttgggtgtaggactcccttggcatttcttatagatctggtctagtggtgataaattccctcagcttttgcttgtctgggaaagacttcatttctctttcattttataaagaataacttttctgggtatggtatccttggttggcagttttttttcctttcagcatcttgaatatatcagcccattctttcctagtctataaggtttctgctgttagtctagtctgacagacgtacctttataagtgacttgatgcttttctcttgcttttttgagttttctctgtgtctttcacctctgatattttgactataatgtgctgagcagaagaactttttgaattgtatctatatggagaactttgagcctcttgtttctggatatctaaagttttttgcaagacttgggaagtttttatctattgttttgttaaataggttttctaactccttcattttctcttcaccttctcagatcctaaattcaaatacttggtcactttatgatgttatataggctttgctcattctttttttatccttttaatttatttttgtctgagttatttcaaaatacctctcttcaagttctgagattcttttgcttcatctagtctgttgttgaaactttagaatgtattttttatttaattcaatgaattcttcagttgtagaatttctgtttggtctctttttttatgacatctatctctttggtaaatttctcatttatttcctgaattgcttttctggtttctttgcattatttttcagtattctgttgtgtcttactgagcttctttaaaatcaatattttgaattcttttttggggggtatttcttaaatttctttttgatgagaatctgttgctggataattatggtgtgcctttggagataccatatttccttattttttcatgcttcttgtgtccttacattgatcatttgtgcatctgatataacagttgctccagttttttgaatttgctttcataggggatgacatttcttgaagatttatctacggtgttggctgggtagggcactttggccttgactctaggtgtgggtggttgtatagtctctgtgtaatttttccagctgtaaacagtgtcagtggtgtctgtgatttcctcagtggtttagggtgtgattattagtggaggttgtggtgaagttttgctgggaactaggacattaggtgggccagtctttgggcctcagtggtggcagcagtgggttgagcattagcctctccaggtgctgggaatatcatggtgggtcaggaggatgggcaggttatcatgcttctgggtagcaggtatgctgtggcaatggcagtagctgtggtgggacaactttctggaacccaagtggtcagtgctggtgttggtgatgtccatgatgaactgggcaagctggtcctcagtcctgcagatggcacatgaaaatgtatagctgcctttttgttggggtggcaaggtcacttccagtggctcctgcctcagcccaacagtggtgtctgtgggtgatgagtgtcagttgggctccagggatatggaggtgcaggggctcttgggcccccaggcagaacacattctggcaggggcggggctttcataatggcacagtgctgcagctgcttaggacttgggggtttgtaggactcagcatgagctccctgtctagaacaatgccattatgtgatctctaggcagttctctgtgagtctcagggcccatgagagtccaggggctctcctatggctagcattgtagaattctgtggcaggaatgtggaccacttggtgtctctcacttaccctttcctcacattaaggagcctctccgggctcccagctgatcccagctaagctggcttccttgcttccctctccttccttgctttcagtgcttcccatcacttctctgttgaattccagtattctctctcagatgatctattcaaaatgtgattatctaattgctattttagctcctctctctggaaaaggtgagtaccagatgcatttagtcagccatcttgaagcttcctgtctacatgcatcctttctctgttggcactactgaaattgggggcaatctttacttattctcctttccttttcccacccccttctctgtctgacacacacacacacacactcactccactcacaaggagttggaagcagttggtaatttttcaactgtcctcctattctataccctctccaccctagaaaaagacttctgaaattcagcaaccatatatttttcagtagctggcaatcattaattcagggttagatccaatgagactacctccagagggcagtgtgacatttacctgcagacctgtggagttaagaaatcagattttacttaaggccacaggccctttaaaactatatccagggacctggcatatggaaatttgcgctgcccattttaacctttttgactccttctggagatatttccgcaaagaggatattaacaggtatgatcaagatgggaaagaaaagagagaaatgtggttgtaaagtgaagcctatctcaacataatctattggataaattgttctggagcagctcatgcttgtggaaacatttcccttgaatgctgccgaggtcagtttctacaccatctttcacagaagtgtcagggtgaggtgggaagccatctccttttgcactggcttttcaaaacctcactattttgtctcagtgaatcagttcagctctcattgccctgatggattcatgtcctttccttgttctttgcccctttttgacacagagcaactccacccccgcccgaatcatttagcaactgtgagtgcccatttgaggcaagtaatgcagccgatgaatgctgagtttgtgtgaattagagaagagagcaacgttgttgaatatgcctgttgaatttgcatgaaaattgattcacccttcttatgggggtataaatcgctggtgaatggaggctgaaacatatgttatcatttcttacagccttgcttgcttgtctcaaaaactgaggcctgtgatgcgaagtgtcttcagcagcagggtaattgctgccgggccacttgctgaggaagtgcttggaactgatttgaaatcacagaaaacagtgagcattctttgtggttaacgatgtgcttcttttaagcacaccccagccaacggcgacaaagaaatgtttggaaagcaaattgaaaggctgtaagggagagatgaagagagtgtgcaaccctgacacagctcagctggtgctttgttaagagatatttataagtcttcagattatgccccccaatttccaggcaacgaagagacttctccaagtgtcgtgctttgtgcattagtaataaggacacatgctccacagtaatgctggaacacaggatgatgctcttcagctgtgtgcttcttcctggcggagcagatgatttcataattagcctgaggaaacaggcagacctaacagccaaggaaacaatgcacctgaattgacaaacgaagttcaaggctttaggcaaccaatggcatatttctagagtgttggaaggagaggcaagagtctacttcaaagaaactgaatggtggtttattgatttttcatttgtaatagagccatattaaaataaagttactggtgaaggggatgaattcattacacattgtcatgtttctggaagtatttgatccatacgtaatacaaaaaaactgcgtatggatgactcacaatgctttttattgtaacttaaaaaaaactggtaaagaacttttaaacaggaaaaacatttctccaggaagcttcttctaaatctatttctttttaacttgttaaatttcagtagaaaaaaaaagctgttcataaggacaccatatagcatatacgcaaaaatgtctgcaaaaataatttcaaatggataatttttattaactgtaagctagggattgtatatctgagtatcatacaaataatgtatagatcagatttaatttattatgaaggtctatcttattcatctaatttagccaaacattgtgagaaaatcttgacgccattctttcttttatgagctaaatattgatttttgcatatttactcgctgcctcttaagagctcatatttcggttgattcccctcaaacctcctactcttccttgcctctcccctcaatgtttcaggtgagaaaactaaaccttaggtaactattaaatggcgtattgggccatacagatcagcagcctggatttattcctctgagtcccagtttggtactcttcttctcctgaaagcaaactgtagcttacataaaaacatatgttaattttcctcctaaatagtgaaagaacatgtataatcagatacattttaaacaaattgataaaatgaaatcatggcatttctcttactgcttttattccactataaatggcacactgacacatttccataatatgatttttatgatttttcattcatcatatgccataccttgtgataagtccttacagtgtgttctcatgcaattctcgtgatagtcctgtgaggtcaatatcttattactctcattttgtaggtgtataaatgtgggccttcatgtcacaaagcatggaaattgtctgtggctgtcatatgactgtttcaggaaagtactcagaatgttggaatgttcatttactgaatattcactgaatgtttattgaacacttcgagatgctggggacacaacattgaatgagataaaaccattggtatcacggagcccgtattgtggtggtgggggtagcattaaacaaataaataagcaagagaaacatcagaaagtactaagtgctaagtgctgtgcagataattaaaacggagtgatgtgataagcagtgtgtctgtgtggctatttgagatcaggatgctgatactcaaaacatgaaagaaaacaagtgtcccaagttttgaaggttgtctttcgacgttaaccatagtgtgtacaattcaaagcattatgtactatgaagaagatgatctggcataggcatcaaagaactcagtagaccttgaatacaggaaactacctacctggggaaaatataattaatgtttttttcaaatgtgtctgaaccgcatgagctctcttttctatttctgtggcattgttacacagatgtttagtaagctcagctagagtctttcaagctttgatctagagacttggtgattttatagaagtttctttcttaatactaggcgttgatgtatttctcttatattctgtattctttctcatcttcaataatattagagagctaaaggcctttgagaagacagatcaacaaaaatgtatgcctgaggaagatttccatctttcatgcaatttttaaactaaaactttgaaatctcaagtttcttaggaaaaactaaatgtctgccttttttttctatgaagtttatacattgaaacctcacttataaaaggaaactcatgacagatgtaaccaggtagacactaggcctcctggtacttggcagacccagatccttttggatagggccaagatgagttcatgctatggcagattgcagtccagtcatgagcaggccaagttaatagagaagtgagaactgggaaagatactttttattcctatgtcaaaatttcaagttcatctgcacattagaatcacttggagatgttttaataattccagtgcccaggcaaccccatcccccaccagtcaaagcacaatccttgggaggtggacacaggcattaatatatttttcaagtttctccattgattccaatgtgggccaagttgagtaactactgaccttatatggttaggttgtttgataggaatcaggcaattcaacctgcagaagcatggaaaattgcagacataggacatggggatacaaagcaagattccatacacagccattcagagtgaccatctgatgttttaaacaagggctagcatgtgcttgcacatttaagattattttttaagataggaaaataagcttggttttcctggcatggaaacccttctgggataagcttaatgagtaagtattttctctaatttatatagtgagggctgggcacagtggctcatgcttataatcctagctactcaggaggttgaggcaggaggatcacttgaagccaggagtttgaggctgtagtgagctatgattgcaccactgcactccagcctgggcaacagagcaagactctgtcccccaaataataataataataatttatggactgacacagcaatcgttgaactgagggtagaggtgtgtttcaaaattttctgaactaggagcctttctttcatcctcatagccctctcccattcctacacaccttttgtcaaccggtaccagctgctgtatttctaagcaacacgaataactgcacacacagagtttaaaatttaacagttgtgtgtggtcacagggcgtcaaagcaatgttatttcatttcattagtaaatgaaagtcctaggtaattctaggcttgtatttaagccaagagaagtattcttctccaaagtcttttattagaattaacagtaacaaaatggaccccctttttattctgaaaaattctccagcgtctttccagttatgtaaatagatatcccttcccttccctttcctctccattctccaaggttactaataagcagtgaaatgccctcaagctatagttgcagaagggaggaggaggaagagtaacagcagtggtggataattagtatcttattagagtatggaaggaacatttgcaagttgatgactgtgtcaatgctgccaaatcttctagaggtaccaggaatgattccatgtgcttggcagatattcaataaatatctgctgagcggtaaagagcaggaaatcttctagacggggtgtgaatcccagcactgcttgctgcttattcattgtgtggcccttggcaaactccttaacctaagtgacagtttctttctgtgaagaagggagatcatatttaatgcatgggcttttgtgaggattaaatgaaataggcatgtaaaattcttaggagagtatgtgacacactgaaaacacttaataaatacaagatataatgaatcaatcgcttagtgtaatgagacgatggtcagaagaccacatgaagacaaatattccagcttttgaacttaggggaaaggtctccactaaatatataggtgggagagattatagtaatttttgaaaaaacttcgaagtcaaacttgaagtaattggtttgtgaacaccttgtaatcattaatgactagagaccagtatggtttcagtacacaaattatacaagactgcattttcttttgcatttgatttgctggacctgtagattagggtattaaatataagtgcatctgagtaatagtaaggtattttgcagggtttctcactatatccttgtagaggatgcactaataaagttgaattagttataatcctaaatattttaaacctatacccaaactcttttttttttttttttttttttttagatggagtttcacttttttgccagactggagtgcagtggcgcgatcttggctcactacaacctccgttccccaggttaaaatgattctcctgcctcagcctccggagtagctaggattacaggcgtgcaccaccatacccggctaatttttgtatttttagtagagatggagtttcaccttgttggccaggctggtctcaaactcctgacctcaagcgatccacctgcctcggcctcccaaagtggtgaaattacaggtgtgagctaccgtgctccaccccaaactcattattaatagactggctacattaggttacataatgaggacttaaaagatagcgatattcttaaataataaaaggaaactaaaagttaaaaattcattgggaatacaagtaaagttcaacaactctgttaaaaaatgatctgtgcatgtacacagtataaaattgtacttaactggaattcataggaaaaagctctacgtattagctatattgtattagctcaatacaatgtggctgccaaacagataaatgcaacattagcctaaaattctactgttcatatcaaaggaagtaatattgacatagcaccctatcttaggctgaccacaccagaggactccttctggaaatagcttttaatggacatatggataaactggagcatatcaaagaattacaaggatggttgaaaccttgggaaatctgagtacctgaggaaaaaaaaacagctggcaatattttgcctggagaaagaacaatgagaaagacatgatcattgtctttggcgttgtagtgtacagtcttgctcaggaaaggtggattagtgcctacttattaagccccagaagaaagaagagaagacccaataaatataatgaaagagtagaagaatttagcttactataaggaatacatttctgacaagcagagatattaaaattgagtagattgccttgtaagattgtgagatcatgagcattgtcactggaagtattaaatactgtgtgatcatttcttaaaacatttttgagacaaattctcctttggtgggagctgggattaggtttccttcagcctgtcttccaacttacgtgtgatgctaaaattactttgcatttacactttcaggttattcaagaaatgaatggaagggaagacattagcaactataaaactgtctatattgctttttcacctgcctcaagaagtttgcctggtctctggatagatatgcattgaatcattatcatcacaatggttatgagattatttcatctcttttcccgttttttttttgttttttttttttgttttgttttgttttgttttgttttgttttttgagacggagtctcgctctgtcgcccaggctgaagtgcagtggcgcgatctcggctcactgcaagctccgcctcccgggttcacgccattctcctgcctcagcctcccaagtagctgggactacaggcgcccgccacgaagcccggctaattttttgtatttttagtagagacggggtttcaccgtgttagccaggatggtcttgatttcctgacctcgtgatccgcccgcctcggcctcccaaagcgctgggattacaggcgtgagccaccgcgcctggccttttctttttttttttttgagacgcagtcttgccctgtcgcccaggctggagtgcagtggcgcgatctcggctcactgcaagctacgcctcctgggttcacgccattctcctgccgcagcctcccgagtagctgggactacaggcgcccgccaccacgcccagctaattttttgtacttttagtagagatagggtttaaccgtgttagccaggatggtctcgatctcctgacctcgtgatccgcccgcctcagcctcccagagggctgggatttacaggcgtgagccacctcgcccggcctcttttcctgtttttaatttcagtatattggttgggctcagtggctcacgcctgtaatcccagcactttgggaggccaaggcaggcagatcgcttgaggtcaggagttccagagttcgagaccagcctggccaacatggtgaaaccctgcctctactaataatacaaaaattagccaggcatggtggcaggcacctgtaatcccagttacttgggaggctgaggcatgagaatcgcttgaacccaggagatggagattgcagggagccaagattgtgccactgaacttcagcctgggtaatggagtgaaactgtgtctctaataataataataataataataataataataataataatttcagtatattttgaattctctatagttgttatgtataagttttgaaatctgaaaaaataattaaaagagggaaaagaatgttttctgactggtatatactcaaaagaaggtggagggcttcaaaagcaaagctgagcgtgaagtttctgaggtcctgagcccctcccctggtggtacattactttgacctaagaacagtctacatgttctctgcctcctggccttccttctgggtaggcatcttaaacttaacctgactaaactccaacctgtttccttcccaggcttccccatctctacaaatggcacttcttgttagctttagctccagtcaaaaattagaagccatccttctttctgctccttccttcacccaatatataaaacccatcgtcaagttctattgactcttcctcgaaactaaatctaacacctgcccacctctctccagtgatactaccactcaagcttgaacctgcaggaccactgccaggctcctgagtgtcttccaactaccattcctattccttcttctcctcattcctcacatggaagccacagaaatacagagatacagatacagatacacattatgccacttgctgcttatagctccctacaatggcatgtaagttatcacagtgtttagggcctcatctgatctctgctgacctcagggacctctttgggcactgtaattcagtcccactggcttttatttgcttcatcccactggataacccaacctcctgtccaggcccttttcaatagctaatctcttcctggaaactactttctccacacattgcatggatggttcctaattgtggtttacttcttagcctaagtatcattgcctcagtggtgacttttctgatcactcaccctgaaatagccttctgatccccctgttatctctgttttatttttctgtaagtatttatctaaaaattgttggatattttattgtttaagtttctttagaaattgtctgtcccccccaactaaactataagttccattgtctactgtccagtatagtcatgtatcctcaaccctacataaggtctgaagaatagtaactcaataaagtatatgctggggaaagaaaggagagggaagaaggaggaaaaaaggaagaatgaaagggagggagggaggaaggaaggaggaaggaaggaaggaaggaaggaaggaaggaaggaaggaaggaaggaagagagggagggaggaaggaaggaggaaggaaggaagagagggagggaggaaggaagagaggaagggagagaggaagaaagggagggaaggataaaggaaagaactagttttaacttcaaaatttattccttgcaaaaaatagacataaccagttaagataattcatttttttttgagacagaatcttgctctgccgcccaggctggactgcagtggatgatctcggctcactgcaacctccacctcccgggttcaagtgattctccagcctcagcctcccgagtagctgggattacaggcgccagccaccacaaccggctaatttttgtatttttagtagagatggggtttcactattttggccaggcttgcctcaaactcctaacctcaggtgatctgcccgccttggcctcccaaagtgctggaattacaggtgcgagccactgcacccagccatcatccaaattttttaaaaattaaggtgatgggataggatgaaggcaaagtagtatcttattcagatggtgtagtctgaaattgttttttccactgaaatatattattccaaataaagagtcaaaattttgattttatgctgtatctttcatgattctataattatagcaaggtattacattatcctacgtgacaactgaaatgagacagttggcatgggagaaaattcaggatgttcatttttagaaggtgacacttaaagaacaaacaggttgctcaggtgggcctctttctcattggaacactagctacagggttcatattttggcattttagtaggtatttaacagatcccttattagacatagacagtttcagctttatctgaagtggtttctaaaaggtaagtgccttctattttgacattccacttaaatttctaagattactgaagaaataacttattaagatcagcttatattgaactctgaagattgtgtttatataatttgtttgtacagctctgtgattttttaggatcaaagattccctttaacacaaaatatttattattatactatcaatattattaaaccaccataacacttattgtagaaattgatattataaacaaatgtttgaagtaacgaggcttttgagatttagaaaaagaaaaactacaagcacctgttgaagaaaatgatgacagatggtaacatttttctcaagaatctccctgcagctgtgcttacattcagttttccaagctcaaccaaggtctattcatatcttttattatacccgtaagagtttttacttcctcctgtgtaacacagcaccagtcaaagattttatttgagagaaaaatagactgacaatgagtgagaaccaatttaacatctgtgtcatcatgcttttaaacaagaggtcatagcaaggtttttttggtatatgttatctcagtttgaaagtgacagcaagtactgaggctatcatgctaaataacagatgtcaacttactatcagcttctaatggcaatttctgttattgttgctacatagcattttgaaacctcaagtatatatttcatacatttttcaaagcacgaagtgttcaaaagaaaaaatatcttgtgacaacatgtttcaggagtaatagtctacggtacaactgaaaactagctttattattggaattgaattattaactcattttcaggtgtaacaagtaatttttatctaaaaatgtataaacaagctaaatacataatcaatataatccacaaaaccaaaaaaatcatacctcagtgatgattcatattgaaactgatctaaatcaaagtgtttgaattagaatatgactgagagccacataaagccatttatatagaataacattacctcaagtatatttcactttgcagatcattaatactgtataaatgtgagaatgacttctgtatatcagcttttatatttacattttaaaaaacatctacttttttccttaaattcttacaaaatttatacagaatcatgattctctgaatcctctctatccttcttacccacataaagtctaattttaatgattcttaattggagtgacttttatcaatattgtatatttatgatatgtgtatatgatatgttaaatacgtatattatacaattacatttttataatgactgtgatatcaggccatgacaacgagagtgcacagtgatcaatatttctatttttatttttcaaatcctggaatataaagcaccataggaagatagctgaggaatggcctttaccatgagtgcataatagagctgcatttgattctatttgctaaataaaatgaggagtgggtgaggatgtcatttggttctaattctaaaggtgaaatcagatgtagtgaaaatgatgtaggaagttttcttaagtatctgttaagtactatacagtatggttttgtgaatgtcaacttctaagtgactttacctgtattcaaactcttaattggtcaatgttttactgtgtctgtttcattctctagtatttttcctagaggatgatagtaacacaataacctatccattgattatccacttgaataacatttatccctttgtcagactgtcaggagacttaaattcatttaacactttttttcagtttaaccaatctgaatctcaagactgatggttttattgctgactgtgctttcagtggcttgctttttttttctccttctatttccctcttttcttttcggcttttcatcctctaggcaagaatagttgaatgctatgaagtttaggatcccaatttttttttgcctttttctcttcttttacttcatttaattgtgcttttaagattggccaatatgccacttctgttgtataatattgacagcattaaggctgtgtttgattacagtccatgtattttcttaatacagacagaagaaataaggtactactggggaatactttggtctcattaagttaaactatttctataccacaaagctgtgaatatcagatgataggttcttgtgttttatcttttattttcaaaattatctccttatttagatttaacagaaagaaaagcaggatgctccttttcaaatatatgcatgtatttcatgagcatcttcaatatgccagtcactttgttaggtactgaggatataaattaacatcagaaaaccttctgaaacatgacttctccctcttagatctatttttttcttatttatttaaaataggtaggggattatctccttgtgtaaaaggatttaaaatagttgttgcatgtataaacccttttttttctgaatactaatgtcggtctcctaagattcatgtgcgtgtaggggctaaaaggtcacaacaacattcccagatttcagtgccagatgtgtctgtatgacagatcatgcagacccaaactcattctagcatctggttaaacacaatccatatccggtcttaaccatgtgtaaatataattaagagcaaatgggaaaataattgtcttcccccctttttttgttccattgacaatgtaaataagtattctaaaggcacaaatttataactgaaatactaagattaacttttgaattctaggcaattatcacatggttgaaaagataaggcaatgcctaaaatagattgcatgctacatgggaatgtaaatagaggaataggaattcagagagggaatgatcacttctggttggaatgatcaaagaaaacttcataggggaaatagaatcatgagccttagcaggaaaaagagattcagtaggtggagttagtggagaagatatcttagttgaatgaagagagtagggggatagggaagaagaatgtgaacaaaagcaaagagctgggaaaaggcagagtaattgaagggagcaattagtacaggtcccgtggtgagattgataataggtaacctggaaagccaggttaggctcaatgtgaggaaacctggactctaaattatagactttgtactatatactgttgaataaaatgcaatgacacactgagggtgatttttcaaggaagactatgacagagtatgtaaacgtggagtgtgggagataggaacagtgaaaatgaaatagaactaaaaggtaggtttgttttcaaaggaagacttgatagaagcaggggctatgtgtggagatgtgagtcacaggaaagaagttaaagaaaactacaggccgggcatggtggcttacacctgtgatcccagaactgtgggaggctgaggcaggcagatcacttgagctcaagagtttgagaccagcctgggcaacgtggtgaaaactcatctctacaagaaataaaattgaacccaggaggatgaggctgcagtgagctgtgattccaccactgtactctagcctggatgacaaagtgagaccctgtctcaaaaaagaaaagaaaaataaagactacagttttgaatttagatagctaggagaatagtagtgtaattaaagaaattcaggaactcaagtaaaatatgaatacaattttggatccattgcatttgaaatgacaataagacttccaagtgaaaaatacttttgaatatgtgatactgaataaaggtgataatttgtaactattggagcagatgagattcccaaatggtgaaatatgaagacagaaatataattttaaggacagaactttgaagtccttagttagagaatgggaggtgaaaatagagtcagggaataacagaaataaactgttcaaggtggacaatcacctgtagggctttccacgtggagaatgtgccttgctttgtttcccggacttgttcctaaacttagggggaagaattcagtcttttatcattaagtatgttagctgtaggttttttataggtgccctttaaagggttgaagaagtgcccttctattgctagtttactgagggattctgcagtgaatgaatgttataaactgtttttttcttcatttattgggttcatcatatggtttttcttttttagacttttgatgtgctaaatcatattgattgattttctaatgttaagacaactctgcatgatcatgctatattattctttttttatgttgctggcttctatttgctaagaaatatttctatttctatttttaaggaaatacccatctaggtccatgagtgttgatggtgtgtagtttttttggtagtgtctttaattttggtaacaaagtaatgctggtataaaaaaaggaattaggaacccaggaggcggaggttgcagtaaactgagatcgcaccaagctgacatcatgccattgcactccagcctgggcaacaagagtgaaactctgtcgcaaaaaaaaaaaaaaaaaaaaaaaaaaaaaaaaaaaaaaagaggaagtgttctgtcctctttcattttccagaagaaattgtgaacagttggtattacctcttccttaaatatttggtaaaattccaagtgaaagcatcttggcctagaattttcttaggaaggtttttacccatgagtagattataaagctattcagagtacctctgtttttctgaatgactttggctggtttttgtcttgtaaggactttgtttctcatctaaaggatccaattatttggcttcaaggtaagcataatattattaaccttttagtgtctgtaggatctattgtgatgtttctccatttcatttacatctattttctatttattccatctttgctttttttaatctttttctgctttcttttacaatcagtatttttattttgattccataaagtagatattttttaggatagaaagaatgaaaatgggagctctcatgcatcataactgaaattctctcaataaactgagatgtgtgatcataagctgagggtggggaaatttcggaatcttgcatagagaaggtttagactatttgttttgggaggtgtcttcagaaaatagcaagagattaacatggatttccagccattagtgagggcccagctgaagtaaacatgttaaataataatattatttggatagctaaggtgtattatagtcaaatctgaagatctgcctccaaaataggacctcaaagttggaaaatatgaaaaaaaaattttttttttgagatggagtttctctcttgtcactcaggctggagtgcaatggcgcaaacttggttcactgcaacctccgcctcccaggttcaagcaattctcctgcctcagctcagcctcccgtgtagttgggattacaggcacctgccaccacgcgcggctagtttttgtatttttagtagagacggggtttcaccatgttggccaggctggtctcaaactcctaacctcaggtgatccaccccccttggcctcctaaattgctgggattacaggcatgagccactgcgcccagcctgtgaaaaaaattatagtggaattaccatggtggttaggttagttcatatttaaattttatttcaaataagatccaaccatattttccttcagtaaggttgaagatatgagcttcttttagacaactgcttcttttttccgggagttcagaactttgaaataattggcagctgtcttttctaaatattaagcactcacttggttacatagggcagatggcgcaaggggtcatcaacataagttgagtgaagtttctctcattttctaataactaagttatctgaaaagccagaaaaaggtggaatagctggaaggagttggtattgttgagtggaaatagaatgagtggaaaattggcaaaccagctggatattttgtggaaataatggttttggaaacatatttgcaagactcggataattattctactctttgaactgattacagtttgtattgtattgcaaaaactgcttggatcatgtaatgaaatatgagttcagtgaaaaggcacagttaactgatctaaatctctcattgtctacagacattgttatttcatttacatattgaaaatctatgtgatgaaaaatgggaaaatcacagactcacaggagtatttcatttaaattgctttcacaattgcaacccagttctcaaaataagaattttgacaaacctcaactttggcagaagaaaagtaacattttatgtgaaaaactgacatagctaatttctggagacagaaaaaaataaacaaaaataagcgtacccatcctatcccagcagtggccactacactgtagaagagtgaaaaaggatccagactctggggccagagtgccaaggtttgaatcctgcctttcggtttactagctgtaaatcctgggcaagtcgcttagcctctttgttctttgatgtcttcatctgtaaaatggaaaaatagttttatctgatagatgtgatttgaagattagtttagttaatacatgtaacaggtgtaaacagggcctggtgcatataagaagctgtagttggccgggcgcggtggctcacgcctgtaatcccagcactttgggaggccgaggcgggcggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagaagctgtagttattgttaccattgtcaagaaaggtgagttagactctgcattgccaacaatttggggttttaacatactaaagaaaatctagatgtggtaccctggatgggaaacatatgcacacttataattaccatacaaagatgcttggaataaaaatgccaaatgccatctatttgagtatgacttttatagacaatgggaggttttatcttatatattacattttctcagtcaaacatagctataaattcttcaaatacaattttactgttagcaaaagtaattataattatgtttcagcatgtatattctaaatcaactgtacaacttctcaaaaataaaatatcatcaggtactgaaaaaccagaaaggcagtaattaaggcaaattttgtgtcttttataagtgacaaaaattaatactttgatttggatgactcaacagagtaggcgaatggtaaaaggcataagaagatattttggggataaaaccaaactatggtgcaaaaaagaaaatatgtatcgaatgggcgctaaccatgtaggcagttatgaccccgcccaaaccatctcatttgtttatttttcaaaatctataaaataggtatgtattatccccattttagtaatgttaaaacttaagctttcagagttttacttcaacaattcttcaaggctgtttaggagtacagctgggagtcacatcctagtcattttcttccaaagcccatgttctctccactgcactggtctgcctcccagaagtgataggtacactggctgggcgcggtggctcacacctgtaatcccagcactttgggaggccgagatgggcagatcacgaggtcaggagatcgagaccatcctggctaacatggtgaaaccccatctctactaaaaatgcattagccaggcgtggcggtgggcacctgtggtcccaggtactcgggaggctgaggcaggagaatggcgtgaaccctgggaggtggagcttgtagtgagcagaggtcatgccattgcactccagcctgggcgacagagccagattccgtctcaaaaagaagtgataggtacaccgttgaacaaatttagtacaaaaattatggctaatcccccaaaacaaaacttccctagtttttcaatatcgtgtaattcaactagttttgtttctttgcatatttcccattgcattttattttaataaggatatgccattaaaagtcatattgaaacaacctataatccgcacttgcccacggatctctttgcttttatgaatggtgaagtggggctccaccaggagttgtaatggaaagagtgatgaccttagggctgattctggctttgctgctaactagttatcaaactttttttgtataaatgcaaactttgcggtaagacatttcatagtgctatagtccctcttttaatttttccaaggaaggaaaggcacacaatggtatcaaatgttcattcattccatctcttgatgctctacgatattatcagtctacactatgctttcctgaaaggccagaagttcaaagatggactagtttcccagggacctgattccccagttggaatactccagccccttggaaattcccgggatttataaaataactctagacaacaagactttgtctttaaaggtcctatgaattcttttctctctgtatttaggtatcctgatttttcttttccatattttccacaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggtaaggcatctatgagtgaatgcatgcatgaacaaattgtatatttacacttgtgaagcactttaaagaataagagaaacaagtcatatagtcttttttctaatatttttgaaatcttttttgattttttttagttttttttttagttttttcttttttacttttttagaagccaaaaatgtgtaagaccaaaaatttcaataaaatccatttttgtgtgagtttaacattttgaagatccctttaaaatttgtatgatttagccataaatacattttactttcttctccataaagtttgaaaatacacaacagataaatgtttgaagaaatgtattacacaagaaagaattatgaatctgaatattaggatataattcatctgatttgtaatggactcatctttgtaaatttctaaaatcaagatgaataggtggctgattataattgcctattggtatattaaatgagatttcttattttcagacttcatgcaaaaattaatatctttatgtgcattcaaattaaatatttagaagatatgtaatacttcagaaatttccatgaattgtttggattaattttattttgtgtagaccaatacgattacctttttattttgtaaatcaaagcttcaaaaatgggaatgtaaaaaatatgaagcagttctgattaacattcagcataaagagtgaacgaggcagaaaaaatgcatgcaaagagagggattactttttaatgcaatatacagtgcaattatactttaattggaataataattatagtcatttgacttattaagaaagaatatagcaaagagaacatttaaaatacttttgcgttattatttattttcaaagttcttattacaaagatctggcaaaaacacctttatctgtgagaggattgaacaatttctttacaccccagcaaaccctccccaacccatagccctttgggcaatctctcctggttgctcaatggaaaccgatttcatctgacagtactttccatagttgtggtaaaccagtccctaggaaattcccaggattcataaaatgactgtagattaactgtagtatgatttaaaaactcagaatcagaaatccttctatatttatattttctgtaaatgtatacgtgtgactaggctagtgcctaggaaaacatctactgtaaaaggaaaagtattaggtaattttaatttttattgtattaatttttccctaaaatcttccatggcatttaattttccaaagtctctgctgctgaacaagaatatttgtttagaagctaccagttgcaaggttaaagttttggcgtgacaatgatttattgttgtcatatacttcaaagtgtaattactgagtcaattgtccttcagtatgttttggaacacataatcttgcatgctgagagatgattccttccaaaaagtaactcatatatttggatccttaatgacttaatcaaatttgtgcaattaatattagagaccatgttgataactccaaatgtcattattgtcttttcttcacttctatatcttgtttacaatagagttctttaaactcaactcagtggtaaggaaagtgctctcatgagacctaatcatgcccatgtctgatccccaggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtaagtgttttcaggttttatgattgtagggatgggcttattgaaagtgtatacgagcatttttgcttacattattgtattcaggagcatgttaagagaaggtgactttgtgtcttcctcccctttttattaagacaggtccccatcccaaacaaagatacaacatattggtgccaaatgtttaagattcctgtgttccaagaaaagcatcatgtaataaaggtatgtgactcattcataggctaaaattaattttcatgagtggaaaaataaattgatgttaatataatgaaaacagtaaaagtatagaaatgtttttcaattatttgaaagttttttagagaaaaaagaactggcttggctgacctgcatactttttcaagagtctgaaagcttggattatatctaatattttggttatctcctaattttacatgtcaaaggtacaagttttggtatgcacatgaacaccgctaattattattttaggcaacatttctacaattggaattactggaattgcaatttaaaatagtatgtttacgtattgataaattatacccatgaaggttacattcctcaccaatagtgtttgagaacatctgcttcattgaaaacactggatattgtcataaaaaaacagttataataattttttgaaaatagaaaaaagaaaattagtgaatttctacagaaataaagaaatacagaattgggtagtaaataaacccaatttgcctgtgcaatacaattattttccacccttctggaatgggcctcccagaacttttgcatctacttagcgaatgaacaaatatttttaaaaagttacaagtccttggctccgtgctagtaattgttaattccacagaggccaaaggtatgatccatgctctcaaagaacttacagtgagattggggagacatggccaagacacaagaaagaataagatagaattaaatagtgcatacagaatactgtaaacattcagaaggccagatgttgctgcctttctgtcagttcccagactatgtaatgaagcgatgtggataaggaatgaattgccagactctggaatctagagggaaatacatgggtttgagaatcataagtccaccctttaattaaactatgtgctctcaggtaagtcactctggggtaatgctgtagccttaggttttctcatctgtaaaagatggacagccataacacttttcctatcaacctcaagacattttagcagagatagaaacactgagcacattctataagtttattcgtggctaaaatttgttaatttctaatatatttccctagttttcttttgtttacaaatatttttgtttacagttctgcctttggtttacaaaatgattcataactacatacagaggcaaagggagtggctttagggaatgttattgagttaatatgtagtcctaaatatttataggttatttttgcaaacaggagactgtgactgcaggtgaatcatttacctctgtgcaataagttattttctactttgtgtatggaaaaggggaatgcaaattctaattttgtataattaataccatgcccaagtccttcccttgtaccaatgaaaagtattcctcaggaaagagaatgtttcatttatatgtactgtatgtcatttgcagtaaatttaactggaaccaggcttaagaggcaaatgtaaaactgtagattcagaaatagaaacaaatgtttcaaacaaccggtcctttatccactttctggcaaacattaattgtaaatttcttaaccacttactgtgaatgcatttttattcttgccattgttaatgctaataattgagttgaatgaaataaaataattatgtatgtttcagggaggtcagtgtatgtttcaaccctctatgtaggatatttgcttggtacctcatctttcttcactaactttcctatatgaagcatattaaatgatactcagataaactttcctataagaagcgtatcaagtaattctcagacacatgaacttagaattaagtacttttgggaatacatagctgtcttcactagacatttgcattaacatgaaaggcattggagcattttttgcaatgtttggaggtcttctagacaacaaaagttatttaccttgagcaaaagggatttgagggaaggacagtaggtcataagggagtgctcatacaaacttttgttgttacaggggacagaggtttggtggctagaatttaaaatcctattattatgtgagaataccacttataggatagattccttatcttgctaaaccttaaaatattttaaagtttattaagtattatgaaacattttccttgaaaattaactaaaataggatattattcaaaaaataaagaaaactctactgaaaaaataaattcaaaatatttagtaatatgtaagtggttttaaggcagcctttcaaaaccagttttcatttgcaacttattcaagatttcaacaaaattttaatgatgtagaattcataaatctaggacttgccttaagttgtctgatttccatgctcttttttctagtagagaggatttctaataatttaagaaaagtgtatattctttccataaaatcaaagactcctatgttttgaaaagccatcagttaagagcttctccttatttttcattttatgttccataaatcactgtatcaaaaagcctcagtccttttcttctgcaaacaaaaagtactttcacagaaatgagaagattgattttatatcatattgtgtggtgtgtcatttgcagtgagttttaagaatatcgatcacagttgaattgtgagaagtcagtttcattttctggtgtctaattcgcacaaagaatttgtttgtatttgcagtttaaatgttgatagtgcctagacccacttatctgtggttccatgggttaagttgcccatggtcaactgtgatctgaaaatattaaatggaagattccagaaataaacaattcataaattttaagttgcatgccattttgagtagcttgatgaaatcttgcactgtcctgcttcattccagctgggacgtgaatcattcctttgtccagcatattcacactggaaacgctgcccatccgttagtcacttagtagccatctcagttattagacttactcttgcagttatcagattgtcatggtatcagagttcttgtgttgaagtcacccttattttctttaacaatgcaccccaaagcacaagagtaatgatgctagctagcaattcagatatgcccgggagaagccatcaagtgcttctgtaagtgaaaaggagaaagctctcaacttcataaaaaaaaaatgataaggttgttaagacctatgctaagaatgaatcttctctctgtgaaattgtgaagaaggaaaaagaaattcatgccaattttgctgtctcacttcagactgcaaaagttatggccacagtgcatgataagtgcttagttgaaatggaaaaggcattaaatctgtgggtagaagacatgaacagaaacgttttccgattgacagcaacgtgccgcactagaaagcattgagcctatacaaagacttcaacaagggattgcctgaaatgagtgacaccaagccatttactgcaagtggggaatagttgcagagattcaggaatatagattctgatcagtagtagcctaatactatgtcacaatacctacgttattcattatgctccatctcattatgtagggattgtatcatctcgcatcacaggaagggtgagtacagtatgataagatattttgagagagagagagaccacattcacgtaactttaattacagcatattgttataattgttttgctttattattagttattgttattaagctcttacaagaaagtatttggaaatctcctaatttataaattaagctttaatgcatgtataggaagaagcatagtatgtgtagagtttgtagtttctgccatccactggggattttgcaatgttttcccctcagatgagggaagactactgcatacatttcatacttataataactataagactaagcaaagaaaatatatcagtagtttgataagaatgactaaatttaaaaatatttattacatttaaaatttaaattttaaccatgtaaaaattatttgcttctaaaattataaaataaggtaaataatctctaaaatgactaaaatataaaataaacataaatgattttatctctagaaaagataggattataatacaattattggctgttgaaactcgtttgtgatctcaatttattgatttgtattttgattcttaacaaaatgttgaaaattgtggcttgaaaatgtgggtattatcagatgacagcatatcacattgcaggtgaatatggaaattgtagaaaagaatattcttggtaatttatatttaaactgtacttctcatgtgaggtcatctctttgtcaggtactcgagaccactctgcagcccacctctccatatttcagcatgactctttttaagctttattttagatgtgactttaccgtaaatttaaaattttttaaagacggttgattctaccactctctttagtcaacagtaatggcattgccatgactattagtcgtggttggatatactttgctagaaatgggggttattgaattggcttaacacgctgctttttttgaggtgcttttattgtcctggaattctcatagatgaactacactcctaatatatctgtttaaatgtgatgtgtctcattccatttaatagaaaatttgctgatggcctattatggcaaaggggagaaaaaaagaaaaacagccagccaaaatcatcatcccttagtcctctctccttaaaggactagctccctaaatagggaggcagtacacctcatactacggtaggtgggttccgtgactggatggatagttcaggtttgaattccttctttccatttattagtcatgtaacttacagaaaagttgttagccacacacagttcagtattttcatttaaatggaaatggtgcctcctaatggaattgcttacattaaggatcaaacaggagttgttgttttttaagcacttagcacagtatctgacacttacaaaactattaataaactcaactattatgatcaggcaactatttattttcaatgttgctccctgaatgacttttcattgaaaactcccatttagtgagaaggcccggaaaaggatgcagtatcaggcttaaaggctgaccattgctgggttttaagagaggattatacttactagttgtgtgaccttaggcaaatcaatttacctctctgtgcctcagtttcctcctctggaaaatggtgataataatagttcttacctaacaagattgctatgagtattaagtgaatcaaatgagtttaatatttataaagtatttataacagtgctgggaacataatttctgttaaacaaggtaagtaaattcaataaaattttgtagatcactagcaacactcaattgctaatctgttgatcatcttgttaggtttctggattacagagggatcccaaacaagtcaaccctttctaggcagtcagagttccaaagaaaacctagtttgtccatcacttcatttagggaggtcaccttgaaaattttcagctttggagaaatgtgaagttgaggtaaaacactgtcatcatcctcttcatcatcaattgctacaggaagagaaatgctatgctttattacttgatactgaacagaacatcttttttctcccatgaaatatccatgcttctgttctcttctattggtagcactcataaatctcaatgatttcatttggggagtgtttcctagaacatgaaaatttaagaataattgacattgaatagccatggaatgtccttgaagccagattactgtagagccatgaaatagccactcgaaaattgattttcctatagtaggcacctaacatgaacgttaggcttaatacaacatgtcaaatggacattgctgcctgtttttctactgtgctcacttaaaaagacacagtcaaatggaaaaccttatcattaacacgtttctgaaatgttaagtgcgatagagggtttctattttctgagaatgtgtaagtctttggggttaaatttagtaaactgtgggaatttaagcattctcaatgtcaaactacatgcttttatggctgtcagaattagctcttctctgacagtatatctctttccttctttcctgaaataatatttcaagacatattttaattgatgcagtttttcccccgatggaaacagcattttggtttgttgtcagcctgcatttgcacagactgccccgtctagttctcattgtttttttatgtgttcaccttctgtttcactttttcatatgggagactaggtgtttgctgttaactactgacttaatggttatttgtgtttttaacccatatccattccaactctagaattttttcttcttacttattgatgtttcccttctatcttttcttatttaactctatttattttctaaaggcaaatctttggatttttagctagattcatgttgaaataaattaactttcataatctatcttacgtgaaaatactttccatttctcttaaatattttgcaacactctatttggttattaaattattaacaccaatggattacccctgcacctctgggttttgtcatcaattgataaaatagatgattcttgatcttctagagaaaaagttatgctataaaaatcaagaatcttttcctttaataatttgtgttacaatgtttatggatgccaaaaattattcctcatttctaagtgtattgtaagttttatctattttttatctactagacaagagatgaaaatactggggcatttactgtggctgaaactgtaactttgtacagaaaaaaagttggtaggaacacttcccctaaaagtaatgatttgactcaaattagtgcatttgaaagactgctgacttagattgttcaatgttgtaaagttcattcaagatcctcttgagttacatctacttcatggaaacactggagatcgtctagctacatgggtgttcttattagtcacttgagagtacaaggtaattaaatttgctttgaaagcatgtcttttcatggaagtgatttattgctaactctgtcactaattagctttctgaccctagagaaagtacttaaccttgcctggtcctcaaattccttgtctgtaagataaagggattggaccagatgacctcaataggctctttctacttctaaatatctgtgatttgacgaaaacaaaaagaaaagtctgtgctggggtttggctgctgctctgtggtctgagttcctgacatgcatgcttttcagtcacagggcatgctgaggtgaaaatactgagtacgccactgcctcccttgaagttaaaaggcccctttctttagcacctcgagcatggacttggaggataagtttggaggcatcttagtcctttctagagcatgccaaagtgccccagaatccccaggagaatccagaatgtctagagacatgtgtggctgcttggtctgttgacagaaatacttgattttttaaaaagaggctcatagactttcttatttctgggctatacaacactcacttttttatctttaaattcccatgcacttaactaaacttgttactgatattatttaatggctattaagttttgggaacagctggttctaaacacagaaaggctgcaaatgtaaagtattcacaacaaatcaaattctgaaaccacaaatctttataatatccgtattatctagtggttgtaccatggcctacagggtcagagcaactggtttgaatcttggctcctcagcctactagtgtggaatccagggcaagcaatttaacttccttgagccttaggttccgtctgtacatagggctgataaccgtatttgcctcgtatgttagctgtcatcaaatgaaggcagtatctgtagagtgcttatatgtttggcaatgtattagatagctcaataagtactggctatattcccaatttgcttcagttttcagatacctcttaagtcacagagataatgtcattttaaaataaagataaaaattaggagtgccagggtgagcaagactttactgagataagttggtgcagtgtacaagaattggctctggaggtagttagcagttgtgttcaaactctctttctcattcactggataaccttgggaagactaaatgctcatagcttgcatcttgacttgcaaagtgaggaaaataattttcagcaaagatgaaatgaaaacaagtgaaaacacctgttgcataataggctcgtcattgcttgttttcttcccttgaagggaattatagagatgaatgactaaaacttcatctagtgttttctcattcttggagtcagggctgcactgaaacaatggtaggcagtaagtctctattttattttgaagaaaagattccctgggaattagatttcatagcttgcttccattactctaacccaaatgaaatttaagctaatttcctcctgttcttgtctaagtaaggataaaaaccaactggtgactatcctctgggaaataatctttgacattcttaagtcacccattagtcttccattctatggccttaaaataatgccattttcaactgacatgaaacaatttttttttattttttaatttttcttctaccaaccaagtctactccaaccttgtatatctttttcaggtagtacaaaagtttagatgagaaaattgaatagcactagcacatttcttggtaattattcattataaaaattagtaaataatttaattaacagcactttattgaaagaatactaagatatttatgttgaattctagatgttgatagcacaatgggattaagaggtgtggtaacattaaattatgaatgacttttacttacatgcaaggaagtatgtaggtaaaatactttcttgtttttttgatactttaaatacattatttcactaggttttcacagcctcccacaaagtaagttgaataaccaccactttccatatgaacacactgagacacagcaagcttatgtagcttgctcaacattacacaaattaggtgaagtagagccaagacttgaatgcagatcttctgagcaatactaatggggctttttccatacaattttgctagccttctacttctaaatatctatccaggccttattatttttttcaagatgcataagttacaatgaaaaataatttgcgtggaagaagtctgatagcttatatccagccatgagttctttaagtaaacttgtcagaacctgagctactttttattttttgacagctttgttgaggtataacagatatacaaagaactgcacagttatagtgtgtaccatttgatgagcttggaaatatgcagacacttatagtgacatcaccaaccaaggtaatagacatattcatcacctcccttgtttccttgagtctctttggttttttttttttgttttttattgtggtaagaacatttgacatgagatctacactcaacaaatttggaagtgcaaaatactatattctgctggactacttttgagtcctacggaattaatgcatagacacaggacacaggactgtgtgagcagaccccaccagaatcttccagagacatcagtccagagatcctggaaagtgacttagatctagtcacatatgagtacacagagactgggtgatttcacccttggggattacaaatgctcattaacaatggatgacacatacgaagtttcatttgtgatttaggaagtctttaaagtaagattagagtaagatgattaggctaaagattatggctgcaaaaaggcttcatgttaaatcttggagatgatattagggagaaaggaattggaaataatttccgtggaaagaagttagtgagactgctaatcttattggacacgtcttgtagcataaagattgctggaagcaagccaaaagctttctgtttaagctgagctaagatcttctttggagttaagtgaaattaatggtaatggactgtttgattcccctttgctataacgatctgtaaaaagctactcatgagaagaaatactaacatttttcacttggcagttaaatttatgacaaaatacctaaagtgctctaaaacacgaagagatatatgttgttggagagaaaactagaagtgttggcatctcagaaaagacctaagaaccagactgacagtctgggttctaatcttactttaacctttggtcagctgaaaattaatgtgactgcaccacaatgcctctcaagagaccaaattcatgttaataacaactcaaagactataaatctgtataactgagaagttgttctaagtgatctttaacccttaaaattctgtgacttctttcattgtattattggaattgacaaagttggaaatttatagaataagtgtataaatatatacgaataaaattataataaaagattttcttaaaattttgaaaggaattcagataatttttgtgtgttgccataggatatcacaggtcaattttatttttttgttttctattttcaatggaaacaattgtatacttatcaaaacaggaagatatctgttgccctatgatacaacaatgaaatttttaatagtttttataaatggagcttttagtgattagcaggaaaaattatatgtggaaactcacttttgataagtgagatattttatattcaagtttataaaactcataaatcagaggatactttttcacacctttactgagttatcaataccttctttaaggtatcaagactttctttgggtcatttaacatgaatgtatttgtgcatcaaaaattcagattatatataagagcttaatagtatatctcttttatgaagaaaaatactacactaacatatcaaaaatgttatagttgagatttgcttcattgagctattattgtatttttcttgattcataacctagggtgcatgttagaatcagaatctttagggagggagtccaggcttttgtgatgatagtggttgttgctgtgttttgggaaaagttccccaagtgactctgatataaaccctctgtttgaaaataactgttttatatatattaaaatttcccaggagattgcatttgtcaagttacattttatggcacctagtaaaatgcccttcatattaagtagcagtaatacatcttattatagtaataaagtattttattcaacaaatattgtaaagggtgaacacatattgaatgtctatcgaaatatactatgttagttgcatgcacatgaagaagagttaagcagtttatggttttgagatagtttattccttgatgcattgcttgctgtttttttttttttggtgaaaatggagaggcaaaaacaccagctgtttcctgtaaccacagctgagttttatgaactaattcagatagaaggggtaatttcttctaagacagaaaaaagatttatgctctagtgaaatatatacatggaggttaatgctatacattcatgtttataatgtaatgggtccattttaggaaccatacactgaaaaccacctcactgactttaaaatgcatctcattaccaataaagagagatctttgcaccactgaaatctcactgaattgctctgtgtggaattataaaaattagtgaaggcaagaccatgtaagtaactgttaataatgctcccatagcctcttggtctttagcttgtcctgaggaaatgttgaaaatataggagagacactttggtttatggtatgtttcagaaatcagatgtatactcgatatgcccactatatattttaatcagctggaaacattccttcacactacacctgtaaatcgtgaggaagaatcagagtatctagtgagtgtctgctttggacagcattcagtgctatgtcttgtatatagagcaatataacacgtagtttttcagcccaaagacctcacagtctggatgggaggaagagatgtacacataaatattagagagcccccaaagctgccgaatgaacattcatgtcaagctatgtgatagtggcagtaaaggagaagaagaaaggagaaagcagtgattgtttgggcacagtcccatgccatatggaaagaataatttggggaaagcacagagtagatgaattttaggtaggtggaagtagtggtgtggtgagcatgactgcagaggcataaacagaggcaacctctgttgatgtgcttaagcatcaagataaaattagatgataagaaccaacatttattgagagaactgtccaatttggggattgtcagtcctcataaacaacctatgatgtaggcagtgttactatcttcattttacagatgaggaaactgacgcccagaaaggttaagtaatttgcccattgctggggaagatgatctatttaaaaagtaaacagacataaacacttttgctggtttagcctccaaacgtgactgttaggtctacagaaaacagcattcattgactaaaaaaataggacgctgacttcaacattaacattctgaagtattacacattggtccctgaggaagctccacttggtcccacatgtggcaaagaatacttgatacaaccaacatctgcccatactaaagccagctaacagctgctggctaaactttaaacccatagtctaatacatcaaattagaatgcagaatccctgcagttacttgttgtcaggataaatggattttttgatcagagaataccttaaccataccaaagtccccattttgtaatattgaagggaggactgaagtctgaggcctttaatacctaaatggggtcactaattttatcttgagtattactcctgtgtggctttaacaaattttatttattgttaaaactctgggccgggcgcggtggctcacgcctgtaatcccagcactttgggaggcagaggcgggcggattatgaggtcaggagatggagaccatcctggctaacacagtgaaaccccgcctctactaaaaatacaaaaaattagccgggcttcgtggcgggcgcctgtagtcccagctactcgggaggctgaggcaggagaatggtgtgaacccgggaggcggagcttgcagtgagccgagatcgcgccactgcactccagcctgggcgacagagcgagactccgtctcaaaaaaaaaaaaaaaagaaaaagaaaaaaaaaactctggcaatttgtatcatattctctaaaatagaaataaaaccagcctcttaattgcacacatgtgcatgtaaccatttagttctttaaagtgaagctaggcagatgcagtggctttcacctgtcatcccagcatcttgggaggagaattcgagaccaccctgggtaatggagggagttcttgtctctaaagaaaaatttaaaaaatttagctggtaccagctagttgggaggccgaaatgagaggatcacttgagcccaggagtttggggctgcagtgagccgttttctcaccactgcactccagtctgggagacagagcaagatcctgcctcagaaaaaaaaaaaaaaggaaagctgcaggcagttcctaagaggacgatggcctttcagttcttgtggaaatgacaaggtcttccctagagccagtgacttcacagtggagtttgttagagccatgtccatttccatcgctaatgtcagctgtgttttcttaataatttaaatgtatgtgatatatgtgggtttttttatagaaaaggtttgtctcattttgctttctattttactgaagcatgggcctaaagaaagttctcaaggaattatttatttatttaccaagctttgaaaaaatactgctttaaggtcatcctccaaagatgtatgtttgtttctcttagtcatcacaatcttccatagtctttataaaattacctttattaataaaattgggtattttctccataatagctgattttagcctcataccttcaatgtaaaattggtcctttaggatggaaactaaacacagggtttttgaatatgcccctttacttttcccttaacttttatgattttggtgttagtatatacccatatataacataaaaataacaattcatatcttctcaagattactttgaaaatgcttttaaaatattgaattttagaagacaagtatttatggattgctcatcatgtaccaaacactgtgctttacttactacctctgccattttctagatgagaaaacaggctcagaaaaatgtaatgtcatctctaatgtcatggagcgagatgtggtaaacatagagtgggaacctagccttgtttaattctaatgcctgagatctgaattactgtgttgaactcttttcagtgcaaatgtgctacacacataggtgttattagtacgtgtattatgaacaccatttatttagtctagtagggggagctttaacactttatttaacctatatgaacctaagcttgaagggcccttcctgtctttctggtcacatagacctgatttcaaatccgggctctaccatttaccacttatatgaccttgagtaatttacagaacttttctgaatccgttttcccattggcaaaatggagatatgacctatcacaatactactgtaaagttatttggaaaatgtttatggaacacctgaggcacaatagatgtgaaatattgtcattttatagtaatccttctttcctctaacagtctaaaccttctgtttgcttttgtcaacattttatttcatggttgcagaaaatgaagtccagaggaaaaaactgcctttctcatccagttaattaattgaaattgagattgaaatttaggtcataaatttttattacttatctctatctctccttcaaaatatgaaatataaaacaatttcaaagcaaaaaatacacctaagatttatatctccattttatcatctcttaactatctataattaaataatttttaaagcttttcaaaaagctctaaattacttggatattattatccagtaatttagaacagctggacactcactttgatttcattgacttttctgagacatttaaaagagggaaaaattgaaatatttatatttaactagatttttatatggtatattagttcctttataacttggaattcattacttttactatctttcctttttatttctatacttccttttaagataaagtttagttcctttaagaactggactgccagatgaacctgatttgtttagtaaggcaaactcttattgtaagtgtttgtaagattcacagttgaattacatttacaaggttagagaactaagttcttttttcagtggtaaacaggaaatgtcagtactctgagtaatattttccactcatatagcaaatagaattttccaaaagattgttagttcagtcacatttttttcaaactatatttactccaagtgctaagagatattttatgggataatttatttcttcttcagcttgaattaataatcagataaaattcatatgtgatatgatgtgcttctggactggcttttaacaatcttgcaaagaggtcacaactgttgagtttttatctctcatcatttgaaagattaaggagtttttttctctagagaacactttattttctaatatgagaatattttctaacgtgtatttgtttcatttccagtgtaatatatacttctcataataagtaaaaaagtaaaaaatatataaaataaaaagtagtagtgccctctttctccaaattctactttcctgaggtgactaatgctaacagatttatttgtatttttctaaaactttatgctgaagaaaacatttacaacatttatataggatttttttgggttaatctcttttatttgtaaacaaattaggatcactctatatctattactttgaattttgcttttcaaattaatgccctcatcattactggacaaaatattataacacattatttttaatgtttacataatttaatctcctattatgtataaaccataatttttgcagccatacacttttgatgcacattcaagatgttgtaagctttttgctaccataaacattgcttcagtaaatgttcttgtaagtatatcgttatgtattggtggtttcattcctatacgctagattgctaaatggattgaatcaagattacatgtatttcaaactttaatatatttgtcagattactttataaaattcacacactagctgtatgtgaatattttctcatcccttcttgagcactggatattttagtcttttaaatttattgcctgttaatggatgaaaactaatatttctgattgctttggcttgctttccttagactactagtgaggcttatgctctttttatgctctcttctgtcagtttgctgttcaaccctttaccgatttctttttaaaacattcttttattgaattgcctagataaaagtgcacaaacagtataaaactcattgaattttcataaggtgaactgactcatgaaaccagaatcaagatcaagaatagagtatcaactcagaagcgtcctttgcgtcccctcccaggtactgtctgtccccagaggtcaccagtttgctgacttaaatcactctttactaattttgcctgttgtgaattttttgtaggtagacagaaacgctagtgctcttctgtgtctggctttttttgccgaacgggatgtgcaagttggccatgttgtttgtagaaaataatgtgttcattttcatctttgaatttcattttctgaacataccagaattttttattcatttttattggttagctatttctgtgaaccaaaccaacccaaagttcaacaactttaaataagctttaaatgaagaagcacatgttatagtttacaagtcagcttggtggttcttctgtttgtagctgggctacaaacaggtatgtaaccagcttgggttgggtatgcagctttctaatagtgcctgggctctctcttcttgttgggagtcagctggttgtaagcaggtctaggaggcctcagctgaacaagtgggctctcctttatagtatcttgttctctagaagtctagactgggcttgttcaaatggtgatggcacagttccaaaagagagagtagaaactgtaaggccacttgaggcttggtttgggattagcacgccattgctcctgccataagaagcaggcccagcctacataccggagaatggtgatagactccaacccctgaaggtctagtttgtgggagaactttctgaccttacctggagttgagtcaatttagagagctgagcaaaatacagggatagaggaagcagtgggaaaggacctgggagctcactgggtccctaagcatgccatccctgcttggtaccacagggatcttttgggagggtgaccagaggcacagggtaaaatgccacagggagaaggaagtccccagctgaactttgtaacaatttgaatccagcaagaagcctcctggccagaacctggggaagggcacgaatctggtgtgcagactccacgggtgagggaagaaccaaatcctttttcttctgcacctgggaagtggctagtctggggcaagttctcaagccgtgctcatctactgcctggaaacaggatgttgggggaggggcatgatgggagggagaccagcccttcagattgtgtgggagctgagtgaggcctgtgactgttggttttcccctacttccctggcaacctgcatgactcagcagaagcagccatgatcctcctaggtagatgactccattgacctgggaacctcacccccattccccacagcagctgcagcaagacccttccaaggagagtctgagctcagacacacctagccctgcccccacctgatgggccttccctacccaccctggtagctgaagacaaacgctatatactcttgggagttctagggccccgcccaccaccacttcctcttcgtaccaccacagctgatgctctctggaaagtgccacctcctggcaggacgccaaccagcacaaaaatagaactttaaatcaccaaaggtaagaaccctcacagagcccatttcatctccctgccacctccactggaacaggtgctggtatcaatggctgagaggcccatagacagttcacatcacagggctctgtgcagacaaaccccagtaccagcctggagcctggtagacttgctgggtggctacacccagaagagatataacaatcactgcagcttatctcacaggaagccacatccatagaaaaaaggggagagtactatattaagggaacatcccctgggacaaaataatctgaacagtagccttcacccgtagacttttcctctgacagagcctacccaaatgagaaggaaccagaaaaccaactctggtgatatgacaaaacaaggctctttaacacccccaaaaaatcacactagctcaccagcaatcgatccaaaccaagaagaaatccctgattaacctgaagaagaattcaggaggttacttattaagctaatcagggagacaccagcgaaaggcaagaaaatccaaaaaacaatacaagaagtgaaggaagaaatatttaaggaaatagattgttaaagaacaaacaatcaaaacttcaggaaaccttggacactcttatagaaatgcaaaatgttctggaaagtctcagcaatagaattgaacaagtagaagaaagaaattcggagctcaaagacaaggtcttcaaattaacccaatccaacaaagacaaagaaaaaataagaaaatataaacaaggcctccaagaagtctggaattatggtaaatgaccaaacctaagaataaggaagaggtattcctgaggaagaaaaggaatctaaaagtttggaaacatatttggggagataatcaaggaaaatttccttggcctagctagagacctcgacatccaaatacaagaagcacaaagaagatctgggaaattcatcacagaaagataatcacctaggcacatcatcatcaggttatgatgaagttaagatgaaggaaagaagtgtaagacctacgagacaaaagcaccagttaacttataaaggaaaacctatgagattaacagcagatttctcagcagaaaccctacaagcgagaaggaattgaggctttatcttcagaatcctcaaacaaaacaattatcagccaagaattttgtatccagtgaaactgagcatcatatatgaaggaaagatatagtcttttttagacaaacaaatgctgagagaattcgccactattaaggaagcaccacaagagctgctataaggagctctaaatcttgaaacaaatccagaaacacatcaaaacagaacctcttgaaagcataaatcacataggacctataaaacaaaaatacaatttaaaaagcaaaaacaaaaaacaaaaaatccaaggtacacaggcaacaaatagcacaatgaatgcaatgataccttacatctcaatactacattgaatgtaaatcgcctaagtgctccacttaaaagatatagaactgcagaatggataagaacttaccaatcaactatctgctgccttcaggagactcacctaacacgtaaggactcacataaacttaaagtaaaggggtggagaaaggcatttcatgcaaatggacgtcaaaagcaagcaggggtagctattcttacatcagacaaaacagactttaaagcaacaagcaacagcagttaaaagagaaaaagagggatattaaataatgttaaaaggccttgtccagcaggaaaatatcacaatcctaaacatacatgcacgtaacattggagctctcaaaattgtaaaacagttactaatagaactaagaattgagatagacagcaacacaataataatgagggacttcaatactccactgacagcactagacaggtcatcaagacaaagtcaacaaagaaacaatggattaaaactataccatggaacaaatggacttaacagatatatacagaacatttcatccaacaactgcagaatgcacattcttttcaacagtgcatggaaccttctccaagacaggacacgtgataggccataaaacaagcctcaataaatttaagaaaattgaaattatatcaagcactttctcagaccacagtggaataaaactagaaatcaactctaaacagaaccttcaaaactatgcaaatacatggaaattaaataacctgctcctgagtgagcattgggtcaaaaatgaaatcaagatagaaatttaaaaattctttgaactgaatgacaataatgacacaacctatcaaaatctgtgggatacagcaaaggtggtgttaagaggaaagttcacggccctaaatgcctacatcaaaaggactgaaagagcacaaactgacattctaaggtcacacttcaaggaactagagaaacaagaacaaactaaaccgaaacccagcagaagaaaggaaataacccggatcagacctgaactaaaagaaatggaaacaaacaaacaaaaaacaatacaaaacattaatgaaacaaaaagctgattctttgaaaagataaataaagttgatagaccattaacaagattaacctagaagagagaaaatccaaataacctcattaagaaacaaaatgggagatattgcaactgataactgaaacacaaaagatcattcaaggctactttgaacacctttatacacataaactagaaaacctagaagagatggataaatttctggaaaaatacaactctcctagcttaaatcaggaaaaattagataccttgaacagaccaatagcaagcagtgagattgaaaggataattaaaaaattaccaacaataaaaaagtccggggccagacggattcacagcaggcattcaaagaagaattggtaccaatctttttgacattattccacaagatagagaaagggagaaccctccctaattcattctatgaaaccagcatcaccctaatacccaaaccaggaaagggcataaccaaaagagaaaactactgaccgatataaccaatgaacttagatgctaaaatccctaataaaatgctagctagccaaatccaacaacatatcaaaaagataatctaccatgatcaagtgggtttcataccagggatgcaggaatggttaagcataggcaagtcagtaaatgtgatacagcacataaacagaattaaaaacaaaaatcacctgatcatctcaatagatgcagaaaaagcatccaacaaaatctggcatccctttacgattaaaactcttagcaaagtcggcatacaaggaacatacctcaatataataaaagccatctacgacaaacccacaaccagcataataatgaatgaggaaaagttgcaagcattccctctgagaactggaacaagacaaggatgcccaatctcaccacccctcttcagcatagtactggaagtcctagccagagcaatcagacaagagaaagaaataaagggcatccaaatcagtaaagagaaagtcaaactgtccctgtttgctgttgatatcatttaccttgaaaaccccaaagacgactccagaaagctcctagaactgatagaagaatttggcaaagtttctggatacaatattaaggtatagaaatcagtagctcttctatacttcaacagtgaccaagcagagaatcaaatcaagaattcaaccccttttacaatagctgcaaacaaacaaacaaacaaaaacaaaaacaaaaaacttagaaatatacctaaccaaagaggccaaggacctctacaaggaaagctacaaaacactgctgaaagaaatcacagatgacacaaacaaatggaaacacatcccatgcttatggatgggtagaatcaatattgtgaaaatgactgtactgtcaaaagcaatctacaaattcaattcagtccccgtcaaaataccaccatcattctttcttcacagaattagaaaaaacaattctaaaattcatatggaaccaaaaaagagcctgcatagccaaagcaagactaagcaaaaagaacaaatctggaggcatcacaccacttgatttcaaactataagaccatagtcaccaaaacagcatggtactggtataaaaataggcacatagaccaatggaacagaatagagaacacagaaataaacccaaatacttacagccaactgttcttcgacaaagcaaacaaagacataaagtgggtaaatgacacccttttcaacaaatggtgctgagataataagctagccacatgtaggagagtgaaactggatcctcatctctcaccttatacaaaaattaattcaagatggattaaggacttaaatctaagacctgaagctataaaaattctagaagataacattggaaaaacttttctagacattggcttaggcaaggatttcatgaccaagaacccaaaagcaaatgcaataaaaacaaagataaatagttgggacctaattaaactaaagagcttttgcacctcaaaaggaatagtcagcagagtaaacagacaacccacagagtgggggaaaattttcacaatctatacgtctgacaaaggactaatatccagaattgacaacaaactcaaacaaatcagtaagaaaacaaacaaacaatcccatcaaaaagtaggctaaggacatgaatagacaattctcaaaggaagatatacaaatagccaacaagcatttgaaaaaacgctcaacatcactaatgatcagggaagtgcaaatcaaaaccacagtgcaataccaccttactcctgcaagaatggccataatcaaaaaatcaaaaaacaggagatgttggtgtggatgcggtgatcagggaacacttctacactgctggtgggaatgtaaactagtaaggccactatggcaaacagtgtggagattccttaaagaactaaaagtagaactaccatttgatctggtggtctcactactgggtatctacccagaggaaagtaagtcattatatgaaaaagatacttgcccacgaatgtttatagcggcacatttcgcaattgcaaaatcatggatccaacccaaatgcccatcaatcaatgagtggataaagaaactgtggtatatatatatatgtatatatatatatatgtatatatatatatgtatatatatatatatgtatatatatatatgtatatatatatatatgtatatatatgtgtatatatatatacatgtatatatatatatgatggaatatatctatatatatgatggaatactactaagccatgaaaaggaatgaattatcagcacttgtagcaacctggatgagactggagactattattctaagtcaagtaactcaggaatggaagaccaaatattgtatgttctcactgatatataggagctaagctatgaggacgcaaaggcataagaatgatacaatggactttggggacttgggggaaagggtgggggtgggcaagggataaaaagactacaaataaggtgcagtgtatactgctcaggtgatgggtgcaccaaagtctcacaaatcaccaccaaagaacttacttatgtaaccaaatactacctgtgcccccgtaacccttggaaaaataaaaaataaaataaaataaaaataaataaggagagaatacacacaagggttactgtgcaggtagaagatgaaagacttggcaccttctttgatgttaggggttaggactttagtaaaaatccaaaaagaaatgctggtttagcggggagtgaagacaatgcagtcttttttggaaccattatcataacttgatttatatgctcttttgttagatttcttcctttatctgccaagaaaagagattggccacattcctgaaactgtaaatttttctttgaaaacttatgcaggttgtgaattacaacatttagattaagtgtggtttttatacaatatggaataaatcacccgtgttttttatatgttttcttcatatgtacatccattttaatgtagtttttatggctgcatacctgagaatatttaaactctgacaaaaagtattaattgcaaaagttattttaggcttaacttaaaggagatgttgacaagtttagggaaaaaaacaaatcagacttgtaagactaatgacccttgcgtttgtccttgggacccaccttgatctttgagtttggcaggtcacttcaacatttgagtacccagtgggaacactgaagtgcactgaaatgtactggattaagttagggtgaagataaatagcaaagtaaaaattacagaatcctgggtggttgttatatgaatgatgttacattattttttctgttaactttgcaaattaaataaaatgcaaacaatcaaataaacccaaagattaataagacagttgccttcctctcaagaaacctacatctataggaaaatactttcttatgcagtatctggaaagcaacaggagatttaggacctttgaaaaagtgagttcagtgtgaacctctttactaagataaacagacttcctggagtcgggggtatctacctaggatggagattcacccacggacatgaaggccagtgtttatttaatgcagccatagcctgagtttagtttgttttctctttttcatggaactgttctataaatgagaactttttaaatgggggcctcatgttcaaacacatggagaataagaaaaaaaaaagagagaagagtgagaactaaaaaagtcatccactcctattcatttatttgtttaactttcatgacttataaaagactgtatttcttcattgtagcaatggttcaccacaaattctgcaagaagttaagcatagtcttttaaatatttttgctatcccttttccaactagagggcaacactccataaaataaatcaaataattttttttttttgagacaggatcacactctgtcgcacaggctggagtgcagtggtacaatcttggctcactacaacctccaccttcggagttcaagcgattctcctgcctcagcctctcaagtagctgggattacaggcacccaccaacacacctggctaatttttgtatttttggtagagatggggtttcactatgttggccaggctggtctctaacttctgacctcaagtgatctgtctgcctcggcctcccaaagtgctgggattacagatgtgagccactacacccagcccaaatgacattttgaaacagtcctacaaaattaaagtacaaaattattttgaaccttattttaattccttttctgaccatagctccctcccttgtatctccactgtatcctgtacagataagaaaggtagacaatcagtcacccggagaatgaaacttgaaccagttggaccagggtgcaaatctaagcctgccactaagaatacgtgttaatttcttcagtttacttaattgtgcctcaattttcttggttgcaaaatgaagacagtaataccagtctcagtgtcgtataaagattaaatgtgataacttgtgtaatgtccttggtacatataaacactcacaaacgatagctattattgtatattagcaccttttttagtggaatttatcttttacgtgatcataaaactttaactccttgacaattgatccaattgtggcttagatctgcagccttgggtacagtttcttatagcgtttagtaaatgcttgttggatgagagactcaaatctagactcaagccaataatggggagttgtaaacaatgttcaaaaaatttattttgttcctgggacaaatgcattttgaatgggtggcactgtggattatgcatctagttaatcaaaaaacagctctgctgtgctacttgcagatcgtacatggaaggggcaaaaaaatatgatttaaagacctggacttattatcggttctaaagcaaatttattttgtaccttagagaccacttatcataaatttctcctgctttcattaccagatagaacagaacttactttgcaggcatttaaaaggccagtgaattctagacctttggataaaaaccaacatagaattctgcatgaagcaatattattaatttgtattgcctacaattagatttagcctttagactatgctcagagaaataaaaaatgtcattgatgttattcccctgctgctagaaaaaaaagatgggccatttattacattttttcattaaataaaatccttaaattatgatgaataagtgctaaaataatatactttatttaaaattgccaaaaccatgacaaattacatataaacacaggtactagaagtttcaggatatgaaaacttttattaaaaggaagttagtttaaagacatgcatatttaaattggttatttttatatgtaagttatattttactaagtaaaaacctaagtttttttctttcttctaatttgggctctggtattttatcatgagaatcatgtgttagtaattaagttctgccctttcttggatagaattattaggccttgaaatcattaaaaaaaatccccccatcccccacaacaacaacacaacaacaaaaaaacagacccacaactataacttcaaaggagaccaaaaaagcaaaatgtaatccagagaaacagaaaatgtttgatacagaaccaaagaagggtcttggtgtctttgctgggatccccccatcaggagatgtaactggttggaggtaaagccacatgtactggcatctgtcatttggtctgtcaatcttgacagcagatttaggttaaagaaaaaaaaaagactcctttagttattctaaaggcctaaaaactcagaggatataattgggtttacagaagaaaactccgttgttctagaaacacagctcaaaatccttcctagtcagttattactctaaatacaaattttacattaaaaaataagaggagataaattatgttgcattgactcagtaatagggaagtaaatattttcaaaggcttttggagactattatctaattaagtatgatagcttaccacaaatataaaatgaatgtagttttcaaggaaatattatagacagataatggatggagattatgagaactaacattttgagaactaataggataaatgctttatatataccctgcactgtatggaattcttttcttttctattctttttttttagaagaggaagaaaaacttaccaatttattctgtgaggccagcattaagcagataatatagatagacaaaatcatcacaaaaaagaacctacagaccattattcctcataaatgtagacacagaaattctcaaaaacactataacactgaatccaacaacatgatagtatttttctatgttatctgctacaaatattattttaggcttttacatttaaacctaaaatttacctggaattgacattttatagtttatagtgtggggtaggaaatgacacaagatgtttttcgatgccactttgcaagccagaaaattctgtggccgatggaacctctgctcatttgttcccattgccccactctggaccgtggcccctgggttggcctggctctgctgctggttcctgtcacatagggcagctggttcctgtcacatagctccttttgcacctgctgtttggcgggtcctgggttcttgtcccatgtccaagaagaatgagattacttggacaactgaagagtcagcagggtggagagttttactgagtgatgaaacagctttcagcagagagtgagacacgagttgggcagcctatttacccaaagttgggtagtgctctcaactcaaaggtggtcagtcccccagtgtggctgagtctgggactttcatgagttcagaataggagaatgtgtgtggattggtttgtgagtatgcaaaaaaggctaaaataaagacaccactcaaaggtggtacaacagcgtaaaacaccaattagggaagggtagatatgtgttaaataggtgaagggtggggatcaatcaaaggaatgtgcgccaaatgggaacagaggttctcaatccagtctgtggatttatccaagacttgtggcttggttttcaggctttaaattgtctttagtttgaaggtcaggtttcaccagggacccgcccctatctgcctaggaatttgtctgcctcctgccgctatcagagtcaagattgatttttttccccccatatgaataaccagctgacctcaggtcatttactgagaagactttcttctcctgtgtgggattttttatctcatgcaatcctcatgatcaccttgtgtggtaggaaacagagactcatacagttaattaagttgtcaagttgtcatgggccattcagttagtaagcaatgaaaccagaatttttaaaaatacactgtaaaattaatatttgcttactgtaaaaactcaaatataaaagattgtaaagtgaaaagtaaaatgccctaacttctattaatactactcaagtgtcactgcttataaagccatcataaatgttttcttgtatttttctgaaattgtctatacatatgaaatcaatacctttatgtctatttctgtttatattttcattcctttctcttaatagatatagaaaaaacttcatatatcttatatgtatatatgactttcttgttttaacttttagatcctgataggataacactatgtattttgacacttgcttttaatatttgacagtaccttttgaaaaatgttccccttcagtatgtatagatccattttattattgtatgaatatctgaatttaatataatttaaataacaatattaaattatttccggttttatgctattatattctttctattcaaatcgcctattgacagactttttaaatgttgccaaactgataggtgaatattgccaatctgataggtatgtcattgttgttttcatttcagtatattgaattcaatatatttatttaacacctttttctctgtttgtaaccatgtggatctcttttccatggactttttttttttgatacagggtctcactctgttgaccaggctggagtgcagtggtgcaatttcggctcactgcaacctctgccttctgggttcaagtgactctcctgcctcagcctcctgagtagctgatattacaggtgtgcaccaccatgcccagctaatttttgtatttttagtagaaacggggtttcaccatgttagccaggctggtcttgaactcccaacctctggtggtccgcccacctcagtctcccaaagtgatgggattacaggcatgagccactgtgcccagacttccatgaagttttgattcatgtattttgcccattttcaccattttgttttttgacttgttttatcagaactttttatattaagggaattaagccttttgtttgatataagtgttgcaaataatttctccattattttggtaatttaatgtttacttatctttccttagtttaatgttgctttgaatttcttctgttaatctttacttccccaggataggaggatgggtcacataaaataaagttgtagtactcaagcatttttttagtgcatagttctgtctcctttgtcgttctgtgatgtggagttatgttcctgtatattgcccatttctgcagtttttcatcctccataaaacatgttagtacatgtgcatctatctatcctgcataggactggcagaaattcagatatactcacccctttgatgtattgctgaattgaagcgcatgtattgactgaaagaaacaaacgaaaccaccaaaaaactattggaaaagttctctgaatcattttttctgcagcatgaaaaagcaaaattatatatatctactctgtatgaactgtatgtgcatttgactctgtgaaatgctggaatttgaaatacaggttaaactaaaaaacaattcatgtatcatttaaaaacagctcatacctatagagatgtatgcaatagcatgtcaaagaatagcaagatctaatcttcatgttgtgttttcttaattacacacacacagacactcatacacaaataacaaaggctttaaaaaaagtcagccccatgtaatgaattggcagcaagtagtaaaacaatgaactgttactccaactaaggagaaaaaatttgcatatgaaataattgcattcagtaaaaaagttacatatgtgataaattgtacagaactgagtatagttttaaactaatgtttacaacaaattatgtgctagacacatttctcctttagtttttgtaatagattaaaagttgatttgggccaggcgtggtggctcacgcctgtaatcctggcactttgggaggctgaggcaggcagatcatgaggtcaggagtttgagaccagcctggccaacatggtgaaaccccatctctactaaaaatacaaaattagctgggtgttgtggcacatgcctctaatcccagctacttgagaggctgaggcaggagaattgcttgaatccgggaggtggagtttgcagtgagccgagatcacacctctgaactccagcttgggcaacagagcgagactccatctcaaagaaaaaaaaaaagctgatttgtatttctattttataactaaagtaactgagtttcagtaaggttaagtaatttgcctcaggtcacacaactagtaaggggcagaccttggattccaaaccaagtctttggctttaagctaccacatagtactgcctcctgaaagaagttctgagcaacagggcaaatgtgagccaaaataatcacataagcatccagggaaaacaaaacttgagctttcaaaaatgaataggatttaaataagcaaagttgcataagggggacttattggatggggaaaacagcacgaatgaaatcgtaagtgtaagaatgaacatagtgcataaagggaagggatttctatgactggaattcatgcatatgggaccatgggggtaacatgcagctaatgacagtgagccctgaatgtcagaaaaagaagtactgactttatcagctacaggacgggcagtgtggagccattgaatatgattggtcagattaacaaggtgaaaagtgcgatttgggaagatcatctgcttgggaaatagagtgttctccaaaaggcaagttactaaacatgtcttagtctgtgttgctataacaaaatactttagactgggcaatgtataaagaacacaaacgtatttcttacagttctggaggctgggaagttcaaggtcaaggcactgtcattggtgtctgctgtctggtgaaagctattgtccgattccaagatggcaccttgttgctgtgtcctcacatggtacaaagtagaagggcatgagaatgaacccagtctttcaaacccttttgtaatagccttaatcccatccatgtaatcacctcttaaagaccctacctcttaataccatcacattgatgattaaatttcaacatgagaatttttgggggacacattcagaccaatagcaacatccaagaagataagtagatgactattgttataactcctataggattaatgagagatgtggattaggatgatagctatgactaaaaagcaacttagaggacactttgaagatgaaaaatgggaaataagatgagtcttgccgggcgcagtggctcacgcctgtaatcccagcacgttgggaggccgaggcgggcggatcacgaggtcaggagatcgagaccattctggctaacacgatgaaaccccgtctctactaaaaatacaaaaaattagccgggcgcggtggcgggcgcctgtagtcccagctactccagaggctgaagcaggagaatggcgtgaacccgggaggcggagcttgcagtgagcagagatcgcgccactgcactccagcctgggtgacagagcgagactccggctcaaaaaaaaaaaaaaaaaaaaaaaaaatgagtcttgttgttttagcatgttgtaaatactcattgttctcttaaaaaagtgtttttcaagcacattatagaaccaggcttagctattagttattttgggaatgctttgttttatatgtatatttttccagatagccgaattaaaatttccaccttaacctatttcccatttagaaaaaaaaaaaaaaaaaaaaagaaagtgttgcttgctgccagtgctcatttctcagagcaaacaagaaatgggttaatccagatttgagtagtcacctcagccttcgttgcttgtctgaagacgggaagaaacaaataaagggtgattgaagaaaataattgtcattgacagttattatcatcatcaaacccatttttatttcaactgaatgttgcttggatttatttgaagcaaatcccttagcctagaggttcatgatatttcaagagctgtagctttggccaggcgcggtggctcgcacctgtaatcccaacactttgagaggctgaggcaggcggatcacaaggtcaggagtttgagaccagccagtttgagaccagcctggccaacacggtgaaaccccgtctctactaaaaatacaaaaattatccaggtgtggtggtgcatgcctgtaatcccagctattcggtaggctgagccaggagaattacttgaaccggggaggcaaaggttgcagtgagctgagatcataccactgcactctagcctgggtgacggagtgagactccatcacagaaaaaaaaaaaaaaaaaagagctgtagcttcattttgagcttgcccttaacattgtattatcttcatccttaggctattttgcctcatggtagagaaatggcagcacagacttctgatgtagcacagtttctctttcacatccaggggaaaggagaggatagcttttagctaccatgtaaaagtctacagattccttgtgattggatcaatttcagctcatatcaaggatgggattacataagtgggcttaggccacccaaggaagttggggatcattcttagccaaaagatgtagctcggaagttcaggattcctgataggaaaatattggggaattgatgctggaaagcaacagaaaatgattattatatagctttagcttctctactgttctagaatttgatccataagactgtcagattcatgtgtgatgcatcattatttcctccctcagcacctaacgaagagcacatagtatgtagatataggtggggcttttgttggtgggtggggagttgtcatttgagtccaagaatgaacattcattcataggaacatctcttgaacgaaaacatttttaaatcaaagtgataaggaaaatttatacttaaaactatatataaacatacacaagtgaatgtaaataagttgcctttgataaaagagggatgccatatttcagaaaaagatctctgtagagaaaatatagctaagtcttatacataaaaattagaaaatcaaatccttaatatattgagatggcactcacaaatatatatttcatgattacatagtttgcaatatcattaatatttatggaaatatttttgcctgaatatttgtgacatacaagccttaaaattagattttgaaatattggaacttgtgaatggattacttgtatagacttacttgttgtctgtgagtgtaaaatgttaaaattgcatttaaaaactcaggatccaacttaagatagtaatactagtactattgtttgagcacctacaaggtatttgttgcttcacatggaccagccattgaatgcttaaataatcttataagtaagcctcattatcactaatttactgctaaaggaaccgagttggtgagaagttaaacaaagaaatagagatagaaaataataaagcaagaatcaaacccaataaaatgtgttccaaaaaaatgttccaccattatgctgcttgtcttatttgaaatgtatccccttgagacatggatttatgtgcaattgatttactaaggaagtgccaggagaaaacactgggtcgggggttggctggtggggagagtaaggcaagggaagaagaagctgagcaagagtgtgattctgttgcagttccagcctcaacccaaacccatggagaacatgtcccatctgggcaaggttgctggacatccccatctccatacctttcacctgccccaggggaatgtatattttgtggcactagttctctgcaaggtagtcctccgaggaaagttgcagatacaagtgattagaaatgaggaacctagaacagaaccaggtggtaggtgcactgaaaaggctccagggatctgaagtgttcttggtagagcactgatgctgtcccatccgtgaccctgctaataaagatacgagtatatcacgtggtggtcaggagcacattcttgatccagaccgccagagtcaaatctgcgctgtgacacttgggcaagtttcttaacttatatgtgcttcatcttctgtatctgtaaaatgtggaataattcttttacctaaacacataaggttgctttgaggattaaatgaatatatatattcatctagtctgtacatagactagagctggattggaagcagagctattatcatgtgacttacttatggcatgtcccacagctggttagtcgcacagccaagatgggacctctgggacactcctacttcttgctggccatatacgtatgaatttaaaattaactacttcttgttggccatagatatgttaatttcaaattttcataaagttctaggtgatctctgctgtattgaatatctcaagtaattgataattactatatatgctaatataggtacagaaggtaccttacagttcatgagtaatctattaaaaattcaaacaacaatatatacactaagcatgctgtgttataaactgtcttaaaagtaatgttctgttttgtttgtttttatattcttgaagtgtttggccaaaggacctaattcattcatatttaaaaataaatgactgtaaatcataacatgttacctctttcatcaagtcaaatagccttaatcctaagtgcctaggtggaaattcagaaatcaataagcaagggagaaagatattggtatgtagtagaggtatgtagtagaggaagtgattctctcccaacatattactcttcaagggcatttactgaagtaactatttttaacttacgcaggtccaattaagaatagtaaataaactggaagagtaaaacaaaagcaaagtattttatgtggcaatgttccaatgtgaagaaaaaaatttcaggtagcacatgcatgattgcacatacatattaatgaattgatgatttatacttatttgtgtttgattattaatcaggacttttatttgcaagtaatagaaacccaagctgaactagtttcagaaaaagaaaggaatgtatcgattcatttattaagaggaaaacttgagtaaataaaccacagttggtagagatgcaactggtttcaggaacagcttcagtgaagtgttcgaactctgccaaacctgtcttatcttgtctctggtacctctctgtgtgcttgcttgatggtatctcactgaatgctggcttctttcatgtgctgagaaacatcatccctggaggttgctgaacctcacagctcatattcagcttctagagggggttgaattctttttcgtcgtttgaaaagttccaagataggctgggcacccttccctgaacttaccaattgtggctggcagggcaaggttgtgtttgaagatggtagacgcatgagaattcgggattacagtaaggggtgagttatttcccagaagcctcctcgccctcatttcttctctttttccttccttttcttcatctctttcccacttcatctcttcttgccatcacctcatgtgctttagctgacaggtccattcatgctgtggccccttgactgtggccccttgacaccacatcagcaagtcaggatttgcattgcacccttaccttcttcagagtggagtgtctgtggtgcaaagatgccatttccttgttaattctggttgtctctcatacctgggatacattgtcaggctaaaagagccgttcctgttagggatgaggatacggcaggagacatggagagagaggggcagatacctctgtgctcccattgtcacatgagcatgtcagcatgatcatatgctcatccatctacatggttagttctggctgaaatgttcccataggcagcatcactttaggagctagctgacctcttgataactttttccagagatggattacgggcttttatgtgggcagcaacttgtgcctcaggtgggtatgtaaagctgggtgccaggaacaagaacaggcaggaagaaaagtgatgggaatttacaaaatttccagctcattacagattacacccatcgcctctctccttttgttttagttttgaatttatcgagttgcaagttgtttttgaagagctgtgttccactcgtcctctcatgttttaacaagcaaggagccacaggttaaatgggtagagttggaagaatgagtacaggaaaattgttcaaaagggcgctagtaacctccctgtgtttctcacatattgctgagtataatcagacaagacaagaaaggtactttctcccgctttacccccaaaattaatagctaaagcatgacacacatatatttagctataaataaaaaaacctatttagcttcagtcatgtatgagaaatgtgtatttgtgatgagttgatgagttcgtgtcacaaacaatgacagggacaatcatgacctaggtagaaatgtacaaatctccaaatttttagtttgtggtagaaaattgaggatgtatgaatttcctagggctgctgtaataaatgactgcaagctggatagcttcaaacagcagaaatttattctctcacagctctggagatcaggagtctgaaatcaagatataggcagggccaggttccttccaaaaactccccttccttgcctcttccagcttctggtagcttctggcattcctgggcttgtggcagcatcactccaatctctgcctccatcttcatgcctccatcttctctctgtatgtatctatgtctgaatctctctctcctttctctcataaagacacatgtcattggatttagatcccaccttaatccagtatgatctcctctcaaccaattacatctgcaaaaaccctattttcaaataaggtccccttctgaggttcaaggtaaacatgaattttcaggagacgctgttcaacccagcacagggaaataaagcaaaaaaaaaaaatatgtttctttcagccagcattattgtttaggtaattggctatttgaagcctccaaaaccatacggatttttttttttccaatactcggtgtctttcacaaaaagccctttttgaactgaatctgttttcagggtaggtgctggtgaagagagatcagcaggtaggcacagttttgtcaaagatctcattctttcagtcactgaagggaaatatacatttcccctaagattttcttgcctcaaattctgaaacattttcttcgttctaagttctagggaattctgcaacacatagaattttttggtattatctctgtacccagtcacttggtcttaggttctctatgtctcatcccactctgtatagctcaagttaagtagaataagatgccaccaagtgtagattctttgaatcgtttcattactttctacattgtaaaaaatgaatatataaaatgggttcctgatatttaagattttttcaatcatattgtgtcctttgcatcaaattctatccccccagctctgccctcaggcagctacagagtggatagaaacgctttcctctctcatcaaaataatgaagacatttgctgagagctgattaggaggtgtgcataaattgggaaaggttttaggatagccacttcagggagctgaacagaatgcagagcaaaaccaaagaaagattgacgttctgaggcaaaagtgtgagttatgaactttgaagtctcatgcgaatacttgtataaagtttatctccagtgtccttagtggaggatgagaaggagcagatgacaggagtgattcaccatttgagcatttgggtcagttgtgagtgctggtgagtgatgagttcagtgaccttccaggagaaaatggctggctgagcaactggaaaagtgtgaaagagctaacaggaaaggaaagaggcacagaaagagaatttcagaggtagtgtactcatgggcagggtgtgacaatgggattcagtagctgaagtgggatgcagtatagtggagataatcaagaaactaagaggcaaatgaatttaatgattcagcctcattgatgttggcttcatggaaagggtagtattcattttatttcaattcaataaatagttattaagcactctttgtgctgcaggggctatgtgaggcatatttgacctggataaagtgcgtaagaagagatgatgagattaggaaaaacggtcgttgtcaaggtcagctttatggtcagtgttaatttccaccttggttttggctactcttgagcaactgtttattgttgttctctgcttttcttgctaagatatctcaagtgtatctgaaagctcccgttacttgatctaatggaagagactgttttcctctttcaggttgaagtctttccctttctgtctgtgttctggtttctgggctgttcctttaatacacacagtagttaataaataacccacggctgccaggccctccttgcctggtctgttttgccatcagaaggtaagctcacgggcctgtcaccattctgggtctgtacaccccacctttgtacaagaatgtgggatcaataacatagtttgatgtcatcaggggaatttccatgtttgtgtcttgcctccacttccatatgcactgctttgtatttctttttatttatttcttctgccatcatacagccaggctacaagcaagattaaattaaatgttcattccagtgtcaggaataccaatatatctatattcgtatactttctatggtcatgactttctttaataattcgtacaattttaatatttttgaatagaggcaactcttggcattccccctgtgattgtgataataatgtgaatgtgtgaagtaaccagaataaggaacactttttaaatgctactctgatacattacagggtcagtatttttttttttttttttttttgagacggagtctcactctgtagcccaggctggagtgcagtggggcgatctcagctcactgccagctctgcctcccgggttcacgccattctcctgcctcagtctcccgagtagctgggactacaggtgcccgctaccacgcctggctaattttttgtatttttagtagagacggggtttcaccttgttagccaggatggtctcgatctcctgaccttgtgatctgcccgcctcggcctcccaaagtgctgggattacaggcgtgagccacagcgcccggcccagcctcagtatttttaattaaaaaatgtataactctgtcatcattacaagtaatataataatgcaaaaacaaaagtcttgtcttttccgtggacagttacccagcacatcagaaagtcgggttaatgcagcattcagccaacaagcaggaaggggcatggagctctgtgtgtgcctcactctgcttcctcagatggtgccttggctaaagaagaatagcataacatagtttaaaacacaagtttgttgactgcttaaaatgtttgtagaacttgttgtgggagcagaaaataacgagcagcctccatcaggggattggtagcagtgccctggcttgatcaggctttgtaagcatggcgtgaagcattgtgggaaatcctatcctgtgctaagcatttgagccaatggccctgtcctgcactgatcaaagtactcccatttcctcaagttgtaccctccactaaacaagttatgtccatccttaaggaacattcttggtgtctcacttaatatccccatggtggtctgaaaatttcctctctagaaattattcttctatttttcaggagtttgatagtcaggtaattttttctcccatattatcagtttcttaatttatatttatccttacatgtcatttccaagcacttctttttctttctttttttccctgtctttgctcacatcctttctattttgccaagggcttgcttcttccaagcctttttatcctctcctcccgtgatcagtacccaagtttgcagcaaggttccttgttgttttatgggttggtgtttttgcttaggaaatcctcatgttttaggctgcaccctcaatctgtaatctgaaggtcagattacagtttaattcttcttgaagccctcatcaagtttcaaagagaagccttgttatttgccctttgtaagaaggaacaccttgaaaggccatgggtctgtcttctcatcctagaggccaaggggcactgggactggagtggcagggaggccatgagccccctccccaggtgtaagactcccagtctggcactgcacctctgagggcatctgcatgtggtggtccctgctagtggcttccagaagtaccttctggcattggctcctgaggtcatcacccttgttgatgacagctgtcggcaacttgccttactgaagcctttcatcctccctcccaccggcagcaacttccagggtccttgatgcatctccaacacgcttcctacaataatgtgtagccgtaggaaagtacagactttggggtcacactagcctggtttaaaatcccatcaccctttcccagctgtggtactttgggcttgttgtctaatctctgagtttcagtaaatctgtaagataaggattataacatctttcttatagatttgttgtaaatattaaatgaaatacatagaatgattcatatgtggctagtagatagtaggtctaaataaaagacagatgttattattattccagggataaattggtagctttgcagtttggtgttagttttagcacttcctatgaagacaaaaaaaaaagcacttgctcttaaaagtttctttcaagctgtttatttgaagctccccaaagtcaagcaccacccagcatcacacacccttcactccctcttcctctacttcaatgaaggccactagtttctgaaactgtcgtgacagtaaccaactctcctttgccctaatggcttcttcccaagatctaccttacagagctcagtacaaccttaaggttctgcctgaatttatgaggtatttagcaaaaatctcacatgtgcctgaatattttactgttgacatcttagcagtgccctgtcccccttggaggaccgaggaacccaaaaacgtcaagtctcagacagaagctcaaactagacataaaaatgaaattcttatagaaattctgggttttacttctgtgcaatcattgttactatgcaaccatgcttgaacgataactacccttttcaagcaaaatagaaaagtttctgccttcaggccacacgaccttttagagacaaaacaagtgcaaacaaaaccgtgtgcaatgttttttccatgaatgtgatgttgaaaatgtacctgaggcttaggtgtggcatgactcgctatgtaacacagaagaaaactggatttaaaaactggaatttcttggctgcccattcagacacgacccactacataccatttccccccttgcttagatttccctacagaaaagagaaaaactgtggagaaaatggaaaacaaagccataggagaaaagagctgaaaacacttcatgtaaatgtgcatgctgaaagtagagagcaagcaaggattttaaaatgcggtgcctgaatttgagtagttaggactaaacacagaagtgttgatgaactctaaggctaaactcttggatatttagcaacacgccagggctactttatcagctgaacaaagattccaagaactctgaggggaaagaaaaaagaaccctgtaactcagcggtctccagcctttttggtaacagggaactggtttcatggaagacagtttttccacggactggaggatgggggagatggttttgagatgaaactgttccacctcagatcatcaggcattagttagaatctcataaagagcacgcagcctagatctctcacatgcacagttagttcataataagattcgcactcctatgagaacctaatgccactgctgatctgacaggaggtggatctcaggaggtaatgtgagtgttggggagcagccataaatacagatgaagctttgctcacttgcccactgctcacctcctgctgtgcggcctagttcctaacaggccacggaccagtactggattggggacccctgctctaactgatgcaacacctacagcccacctacaccaagtacaaggctccatttggtctgcatatagaatctctgggatgctagggtgtgcttcactcattctgagttgattcctaggttcttggactaaagtgggcaagtgttatgaagggaactaacagagcaaacagtggaaggaccacattcatgtggatcacgctttccacattaggaccaatttcactgcccattctacttgtttctagttttcctcttttaatttgagcagtgtcacaagcgcacatagctaacaatgttttttttctcttccaaattctaataataaaattgttattggcttttgatcttaatcattaaaataaaaataaaatgtgcaaggaaacttgcagtaagtttccttgttgtttcatgggtggattttttttcttaggaaatcctcatattttaggctataccctcaatttgtaatctggaggtcagattacaatttaattcttcttgaatttcattgatgataaaatcaccagtaaaaatgattgagccctagccttcttctcagcaccatgcatttatagagataaatgagatctcacctctcaccactggtagggatgggtaaagataacattttgaggtggaagagagggagactaagagcgtttgtgcccacagccttgacttctttttttctatgtgaaaaaaaaatgctataaagacacatgcacatgtatgtttattccggcactgttcacaatagcaaagacttggaacaaacccaaatgtccatcagtgatagactggattaagaaaatgtggcacatatacaccatggaatactatgcagccataaaaacggatgagttcgtgttcgtgtcctttgtagggacatggatgaagctggaaaccaacattctcagcaaactatcgccaaggacagaaaaccaaacaccgcatgttctcactcataggtgggaattgaacaatgagaacacttggacacagggtggagaacatcacacaccagggcctgtcgtggggtggggagagtggggagggatagcattaggagatatacctcatgtaaatgacgagttaatgggtgcagcaaaccaacatggcacatgtatacatatgtaacaaacctccacgttgtgcacatgtaccctagaacttaaagtataataataaaaatttaaaaaaaagtgagaggcaggaggaggaagagcaaacctggaaaaaagcaagcaattttcaaaacaattgctctgcagaatgggcaaaggacaggacagtgaattaacaaccaaaaaaaaagccgattagtaaagtcctgtttcttggattaaatggttatctcatctttgttgttgccgttgtcatcatcatatctttaccattgtcactgtctccagaacaaattagacttgaactacacaaccttgacataattgagaagaatatccctttgagaaactgacagtaatttatgctagtttcacgtttgttgtgggatgttgtagggtggtcttatttattgtgtcctccctctcatttatgttcgtgtaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagaggtggggctaatgattactgagatgtaacacaattaactgatcatatttcccgccacaaatatgattctaattaatacttagaagtaaagctttaacgctacttttgatatgaaggtggcttaactccattttcgtaggaagggattctttctttaagtcatttttattttatttcatcaattgtagatgaatggggttccagagggttgaaatatccttgaagatggctggtttttgagtggaatagagctctcagggactttcataggacattgtctcatggcattttccatatttagggcttttcttatccacctcatgttggattatcccttggcactccattagatccgcattatgtgctcctagaagtccattatgataatcccacttatgaggaaggtgagtttattattcatatgttttacctatgatttttataaaaagttttgtaccttgtaagtctttaacagagttgaaacaaaatagcagccagtgttagaaggaattaacctatatatttgtcattcaaattaggatactttttaaagtgaaagtgggtactatttataattatactgtaacagcaggcattaaccagcaccaaaccaggtaaatgagcacacgcagtcactaatcttacaaaaaaaacacttgcatgctacctaccaggaagtagaataatagacttttcctttgtgatgtagattagtcccaatacatggtgtttatggaacattttctttctaactgcacgtaagaaaaagttaccatttattatactaaaaagtgtaagcattttgttgtgtggtaagcaaaccatagatgtactcaaaaagtacttatgcagtgacaccgtgtaatatgatattgaagtaaagaaatgtaaggatgtacattttgtttctgaaatcatttgtatgatattccaaatcctaacattgatagatttaacacgaaattatcaacagaagtaactccaagttattattttatattgactcatgcaatttttcagcaaatactgagctccaactatgtgccagatctgtgcttgaggatatagagtgagtgaaaaacagatgctgttctcacccttacagaaattatagcccaatgtgaaaaagaaacaatcaatttttcatagcaatcatatgaaattatatgtatgccaattggtccaaagaagatacctaacactatgagagtatttaattggtgacctaatccagccaggagtgtgtattggtggggatgggctaaaaagtcttcattaaagaatcaaactgttcatctgggtgactggagatgctgaagggttagggtgcagtgaagaaagatgctgatgaacctgcagaggaaggctgaagcagaccatctaagatcttgtaggacccattaaggatttttaccctgaagacaatgagaagcaattgaagagtttgatacagtggagtcaaatattgagatctgtattttgaaaagaccactctggctgcagcagcatgaataatagattttgaagagaggacacgtggtatgatatttaaagagtgatgtttctataaaagtaggtgtcaagctattctatttgtgagcaagccaataaagtatctttttttaccctaaagtaattaataggaaatagtttctctctgaattcactttaatttccacccaccaattatatcccatactctgaaccatgaatctatgttaaaagtttaaaactttcataaaccaagcaaaataacctattaataaattctaaaagttagattttccgtgaaatcatatgtgactataaaacataaaaattgtcatcacaataacaatgggattaattattgaatatgtcttatattgcaacttttaaaaattttttacatttttgattttaaattattaatagaataaatattctatacaatgtataatacttctccaattggaaattctatgtgaactacttcttccttttagtctttattacaaaagtagaaggcttaatttatttgccttctctgttgtcaattaagttgactttctcatagtttcaatgtaaaaatgaaacataagcttattttcctaacaggttaatagagaactcaggatttttagtactttctatttttattcatgtacataattagaccaaattttagattatagtaattttatttttataaatataacataatacgaatttgtttccagaaaagttttttaataatcattttatatgtgcttaagaaattattactttatttactagattatctattaatgctccaaacagctaatgcaactaatgaacctaactatacaaaatgcaactggaatttctacttatattttttccctgtcaaacttataaggaagtagatgccaaaaatataaaatacaaaacaaaattttgcaagatatgtccagagaaaattctaaggtcagtatagatattctacattatcatgcttatttgtatctgcactgataataacacaaaaggagaattgatttttatgatttatttgtttaacaattgattgaaaccctggtagatgtgtgaccactgtacgtgtgactagctgccatttattgagcacctcatttgtgccaaacactgttcttagaacttggtgtttaagccacacatcacacttatgaggtagtagtgctactattatggccattttccatactggaaaactgaagcacagattaggtaactttatgtcttcatctgttctgtgctgctataagagaataccacagactgggtaatttataatgaacagaaatttattcctcacagttctggatgctgagaagtacaagtacaaggtactggcatctgatgagggccttcttacgggtcataacatggcagtaggcttcacatggtggaagggtaaagacagcaagagagaacaaagccacttctgaaataatggcattaatcgattcacaggggccaagccctcatgacctagacacctcttaaagctctcaccattcaatatcatcacaatggccattaattttcaacaacattcaaacctactttttggaggagatagacatttaaccatagcatttgccccaggtgacataactcatatgcagcagagctgggatttgcatccaggttggtcagctccagagtcagtgtccttaattgtcacatcacagtgcttccttgtgatgaccctgaatatctgaagaagctggagtcaacaaacacatagcaaatattttatgttcacaattacaaactcatgaagcaggaaagtaaagcttggatttttttccaaggctgttagggaggttgagaggtaagaatttcctgggataattattgaaatacttaattttaacaacttattacatctgaaaaaaattaaaagtaatggatatcttctaagtatgtgtgtgtgtgtgtgtgtgtgtgtgtgtgtgtttgtgagtgaagggtatataacatgcaatgaggaatatttgatatagagaccttgtgtttaaaaatgattgactagaaatagattaagctgattgatttaaatgagacaagaaaggaaactgaggggaaggaatcaatctgttagttactgcagaaggaagtcaattaatttccaagttaatgaaatgaatttatgaaatgtttggggctcatactctccctccctgtaatgaatatttcataacgacaagtgtgtcttattcatctctcatccccacaatgcctaatggagtgccatttacataatggattcttaatgactgtgtgttgattgaatggctgttgaatgaagaagaaaatggtgacaaactttaaagaaataaagtgaatctttagtagtttttttcttcagcagatggtttctaaactaaggaggttttacctcaaagtaaatgttattgaacttcatctcgaaacaatataaaataaaagttttattaagttatttattctatattctaatgaatgactttagaatcttcattctgtcttcatgttagataattgtggaatataacagccagataacggaaacatttctcttgtagtatgctgtgtgagtccacaaaggttgcaggcaatatggctactcatcttttaactcttgtttgtgaaactgaatgttgtctgccactaatctctgcttgaatccctttccctcatgacagtttatggaaaataaataaacctatttcaacagaatatgaaaactttaaaaaattcaaaccaagaattttcttgggaatgaaaacattttaagaaccaaaaatcactttaattatgtgcttttgttctaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggtatgcagcatctgagtctgagctgctctctgcagattcatcaatgctcttagaaactgtggtgtgaaaaattccgcacatgtttattatcgattcctttcttgttgacacactgtgaaacccttatcgcaattttagtaggacttttgactgcttttttaaatcttgaagctacaggagtagaactctaaagacagaagtagttggcagggtgtttttcttcttactcctaccttttttgtttgttgcatgttgcatgctgtatatcatcttttacaatttcaacctttgtttgtgtagtctttttcttttctctagtttaccttttatccatattgatttttccatcatttattttcatttttctctgccttatagtttccttccctttcttcaccacagagcaaaaataactaatataaaaaaatatataggatagaagaaaagtatatttagtaatgacaattttcacttcaagttttttaatgaaaatatttcaacatggatcatactctttatgaattatatgatattgtggttgaggacagtatggcagactggtgaagtggaaagattatgctcttctgagttatttaggccatagttcataattcaaattgccatgacctcatttacaagctgtaggaccatgggcgattcatttaattccattgacccactttcgctttcttatctggaaaagtgggaataatatttccttttaagaatttgggttttcaggttactaacatactggaatctttttgctaagaatgtttattgcctcttatcctcctaaaagaaggaaaaaggaggataacatgtagaaatggtctgggaggccccttataagcatcagctcccctacttttctcccggcaaatgttgcttcacaaggagaacactgaacaatccgaattcaaactctttttcagttcaagcattcatttaaattgctttagctttttatctcagttgtccctccaagtgtgtttgaatgtaaactgtctgaacatgcattaatgtgggctaatcgggtcttcctcggtgtctcctgtaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccagtatgcatgtttttgttctttttcattgactgttatgaaagtcatgagacatatctgctgagatgtggcaaggtttctactagtgaaatgaatttttccttgcatctgtattcttaacaccacccactgtgggtgttgtacaacccagatggaatgtgtttgatctgttttccaaaattgaaactcatttttcttataattcccaggagcaattcaagttgttgactgaaaaataaaaacaaccccaaacaaaaatctcaggttctgaggactaaacattactctttttttatacttgacattccagttagtgattctttgggttgcaattcctgcagtggtaaaatagaggtgtctttatgctatgttgaagagataggatatttttagaagtttcattttagtaaaaaggaatgtaaggataattcttttatctgataaagctatgtgaatatagctaattaaactatgctgtgtgatccagcttgacataatacttggggttatggtgaaggagagaagagaatgaaggctttaaaaaggttataatgctttgttttctcaaatttttattccatgaccatcaagctcacttgtagtataattttctacccttattttacttttaaaagtcagatccctataccatttacgaaatgagagtaatggcaatatcttttctacgtgatgctggagacagggtttttagatgggatgaactgtcagggagaagacatggcacaataggatgtaaaaggaaagctgaaaaaacagaagaaagtgataaagaggaaagggatcttctttttactaatagctatcccttaaatccatagctttggatcttagaaattctttgatacatccggagagtagaaagaagtttgagaaatggtgatcttgtcaaggttcttaaggactacactctattttattatgatgtctctggggttttccaaacagtgttatctcagagtttcctaactgacgcaccatgattatggcataagtgcgatgagatactgttctctgggccctctgagtggcgtgcagggaggtcaaatttaagagcaaaagcccagagattacggcctcaggtctatgaatagcttcatctgcttaccttaaaggggaaacataaaaatgttatcattttccatatgtattgtaatgtacaaaaggatggaaaacactagaacaataaacttctattaatttgcctcacgattctattgtaaggaaataaaggcatgactagagacctttaaagaaaataatgtaaatgaagaggtgatcacaataactactatctatgtctgaggtttattaaatgttcatttgttgctaatgcctatgtgttatgtcatttaatctcctcgtaacagctgtgaaaaaaataaggactttttttttttgagatggagtctcactctgtcaccccggctggagtacagtggtgcgatctcggctcactgcaacctccacctcctgggttcaagcaattctctgcctcagcttcctgagaagctggaattaaaggtgcccgcaaccacgcctggctaatttttgtatttttagtagagacgcggtttcaccatcttggccaggctggtcttgaactcctgacctcgtgatccacctgccttgccctcccaaagtgctgggattacaggcgtgagccaccgtgccagggccaaaaataagaacaatttttatctttaggttttaaatgaacaaattgtgcctgggttatatgtagttcatccagctagaatgttgtggagtctggtggaaacacagagagtcctatttatttgcttgcttgttatatcagcaaacctagaattaaacagatcaggggtcttctgctgaatgaaattacttggcgcatccattcatacagcaaatattaactgttgacgtacaaatgtatttgataaataagccagcataaaacttcaatctgaaagcttttgcttttatgtttcagggagataacctaattactgagtgtcgctacaacacgaaagatagagctgagatgacttgggtaagaaaacttttattattattaaagttcatttatggagagaaagaaataaacttgattttagaagaaaaaggtaaaaaccatttccatttagaaagaaaagttctaaaaatcttgagtatcaagtatcataaaagtgacatcagagatgtttttagcattttctaagacttcaaattaactaatgatattatagtattaaataatacttggagtgtaattaattgactccttcatgaaaagctatccttagtcttttaatttttctcatctaatatttttaaaagaactgtggtcattaattgactgtctgcttgagtctggcttagataaatacagacttccaaatgaagaatgaatttcatgaccttgaggcctctgactcaaagagaaatctggtcccaacagatttactgggggaattccaccaagcattcaagaaatagataattcatgtcttactcaatctctttcaggaacactaaaagagggaacacctcccaccaagtcataaaatgtagttaacataatcttaaaactaaaacttcacaaggatagtataaaaggggccagtagtatgcacctgatggaaataacttggacaagagtttgacaaaccaaatccttttttatatacaaatctaatgataagaccaacttgagtttagctaaggaatataaaattgatttaaattagaaaatatatttattgaaagaaaaagatatataatcacctcaacagaggtagagaaagcattcattaaattcaagtttattgttgacaggggagacatttagcaagcctggaataacagggaattgtcttaactaggtagaagttagctatgaaaaagctatagcaaatattaaattaaatgaaataccgttttttttttcaagttaggaagaatataagggtatttgttatcactacttgtattcaacattgtactggaaaagaaatgaaaatgagatataaggatcagaaagaaagaagtgaagaagcaaaacacattactcacagatactgtaattttctgcatcaaaccctcctccaaattgatactatctaaaattaattgcatttgagtatataagaaattatctcaagaaaatacaatttaaaataaaaattaaacagaaataaaatctaacactagatgtgtttgatctctgtgaaaaaattataaatctttattgggaaacattaaaagaatgcctaaagacagtaagagataccgtgttcatggatagaaaggctcagtaaaataaagaaaatacttctattcatattggctcataaatttgatattattctagtaaaaaaatttcagagaaattttacgatttgaggttttggtattctagctaagaaatcttcaccagaccaaggctgcaaatattttcatgtattttttaatttatataaacattttgctgttttagctttcacatggagcaagttgattctaaaatttacacagaagagcaaaaggttaaaaataggcaggacaaaactgaaaagaacaagatagaaaacaatctactagataagaaggcttattttaaaactggcgattaatacaatatgctttgagtcccaagttagaagacttggagcagaagaggcatctcagaaacagacctacaaattctacagatggaaacttggtttatgatagacatagcatttagataaatggaaaaggataaactttttattaaaggatgctggcactaatggctatccatatgacataaataaaactgagtcttaatttcacacaatgcataaaaatcaatgccagatgtattaaatatttaaatgtgaacagcaaaaatttaaaaccgctggaagaaaaaatacctgaatatatcttcatgactttggagtagttaagaattttttaagcaaagcataaaagcacaaactgtaaattaaagattaacaaatttgactacgtcaaagcttttgcttaccaaaataaaacactatgaagaaactaagaagagttttaaactgggaaaaatatttgcaatacatagattaacaggacattagtatctagcttataaaacaaagtccataagtcagtaacagaagagaagcatacaataaaagaggataagacaaaagcatttcaaagaaataacaacccatataatagatactataaatatatgaaaagatgctcaattttgtttaaaaccaaatataaaccagagtgagatgttttgaactaaccagtttggcaaaattttaaatagcatttccgttatgctgaaactggaacacttatacactgttagtagtgacttaaatttgtaaaaccatcttggggaaaagtatggcattatctagtaaaattagagattcatatatactctactcaattccattcctatgtagatttaaccttggaattacttttgcagaatgtgtttcaggagagaaatatgtaaactattcatagtaacatataataatataggaaagaaaaaattctggaaatctctcaaatacccatcaaaaggagaacaaataaatgtggtattatttaatgaaacagtgtaaagttatgaaaattaatgaatgaaagctgcctatattaacttgagtgtatctgaagaacaaataatgttgattgaaaagagcaagcttgtagcagaatatatatagtgtgatattatgtatgtaaagttcaggaaaattaaacaatatattgtttagggatacatacttcaatatactgaatgtaaagtgtaatgaaaaacaacagaaagataaaatattaagatagtaatcacctttggttgaaatgggaagaagagggatagaagctggacacacatggagtagtcaatgtactggtgttggttttatttttttctcatgccttatgtataatttttgttgttgaaatattattttactaaagacataataaatgagttattattatagtgggtattttggtgcactgtcttgataccctcttcagggccaacacaaccaaacctcagccactgggaatgtcagatgataatatgatagctcacagctgtgtacctcactggacattccccttggtattagaaaataacttcttaaaattttactccctacagtaggagagccagcagtcaatgactagttgataagatgctgcaaaggcccagctttccttctacaatttggtacaactctgaacagccatcctaacttaaggataaattaaatacaatatttactgaggcatcaaatgcaacttcatttgcacatcagcatcttcctttgcctaatcctgccttgctcatcaagtgcaaaacatcatgtttttgcaattagtaaaatcattgtatattagcccctaggttaatttagaatataaacaatattaagtttttcacctttgttttcgaaagctggattttgctggatacagaattcttggttggcagttgctttgtttcctttgcaacacttgtgaatatataattcaatatctttttgttatttccatcatttatgatgaaatgtcagctgtcaattgtattcttgttcacctatatatgatgtgtcatttttctcttgctcctttcaagattttttcttatctttggttttcagcagtatgactgtgatgtgtctaggtatggctctttttgtatttacatttggtttttgttgagcttcttgggtctgtaagttaatgtttttcattaaattggggattatttcaggcattattcctttgaatattttttctacctttttgtcttcttcctctcattctagaactccagttacatgtatttaacatacatgaaaacatatatgttagacataaatgctagaacatttaatgttgtcccatagatctctgaagtattttcacttttctttagtcttttatctctctgttatttgaataggacaatttctattgattaatcttcaagttcactgatattttccttgctcatttgaaacttgctgttgagcttatcctgtgaagtttttatttcgttttggtacctctcagctctagaatttctatttttaaaattgttcttctttcctaatgtcattcctttttctgttcactcatttttgagacatttgcctttaactacttgagcatgtttttctttaactctttgaacactttgtaaaacggctttattgaacatatttttatctgttttcaagtcattgtctgataaatccagcacatcaatcttacaatccatttctactgacttttctccattgaaggtagataataatttcctgtttcttttcccacttaataatttttggttgaaattagacatattagataatatgttgtagtaactctggattctgttcttttgaaggtctttaatctttttccaaattttagtagataattaactacctagattcaaaatatgaaatctttctccccgtcgtatgcagctgctaatgtttatacacatgaagacaagattctagaaaattcaattaaatcagaaaaatttcctgcaaaaattcctgattgattggtattatgctaaccaaacatccttatgattctctgaaatgttcactgtgttgagaagtttacatcccatccgcagaatttattaggttatttaagaaaggcaaatttttaaagtggaaataattctattaatttttaattgtgtcactacctttctaaaaagccagttttttaacttttcagctttaagatgtattaaattttaatattggaaggaactgtatgacattaatgacttgtgtgctttaaatgtcaaagttggtagaacacatactttgctaaataaactatctgttttcagggaggactaagcaccaggagtgaaatgtgtctctcataccttctttattacccaagaattaatcttactcgatgtgcaagtattccagacattatggaacaacttcagttcattggggttaaggagatctacagaccagtcacgtaagtagtaaatgtattttatgatggggtaacgtatttcagagaaagatgggctttattgtcatactggatccattaccacattatagaaatttttatgcactgtttgttctatttgattacttttaactggggagaccaagtaacctttttgattactatgtccagagtccccaagaccaccctcaggttctgtgatttgcaaggagtacctacagtactcagcaaatagttgtattcatggaaaacatgaatatggtgaaagcatgcaaagcagaaagaacaaaaggaaaagctacatgaagcaaagtctagaggaaaccaggcgcaagcttccaagagccctcttccagtggagtcacacagaatgcaccaaattacaccatcatcaaattgtgacaacatgtatggaatgttgtctattggagaagctcatcacagattcagtgcccagagttttttggaggaactagtcatataggtggtctctgcctaccacttactaaaattccatacttccagatggaaagcagttgttcagcataaactgcattgtttgcacagtataggcacaatgagtcactcttatcattagagaaagtttatgtcaatataggaaatcgtttactatttaagtttccaggcacctgccaaggattatccttgcaagcaggcctttctgaggtgggcctattatgttaactctttaggtataattgttctctttcggtacaattataggagctatttaagatataataaacaagattcatattttccttgccctcttgagattgtattctggagtgagggagaggtaataaacaaaaaaagatattttaaatagtaatagatgttatgaagacaaaacagtgaaggaagtatgtagttgttgtcaacaggataaagaaagcctctctgggttggtgatatctgagcagcgacctccgtgataaggagccagctatagagatatgcaaattctgcacaggaaagagccagtgtaatgaatgaccctgtggttagtctgaacctaccgtgtttgtggagcagcaagagagtgcatttggctgcagaagagtgaagtatggtagagaataagtgaggacacatgagagcaggtgggaccagatgatttaggactttatgggcaacataaggccttggggctttaagtgcaaagggaagcaattaaaggatataaataaagtcaatttggctactatactgggaaaggactctaggagggctagactggaaggaatatcaatcaggaaactattgtgattgtctagttgagggatgaaggtcacttgtgccaaggtggtgacaccaagttgatgagacacattccattcaggttactttttgaaaggagcacccacaggcttgttgatcaatggcatctcatggaggcagtgagggatagagcagagtaaaggctcagtgatggtgtgaatggtgttaggggaacatgctgaggatgatattgagaattctgttttggatatattaaggttgatgtatctattcttactgatgtcagtgagaagaattagaatggctggtggaaatttggggatggctgaatttgttttaatatagagaagaattttctaatgatcactactattcaaaatgaaagggactgacgtaattatgtaattagagaaaatatacacatagaggttttgtttttgtttttgtttttgtttttttgagacagagtttcgctcttgtcacccaggctggagtgcagtgacgcgatctcagctcactgcaacctctgcctcctgggttcaagtgattctcctgcctcagcctcccaagtagctgggattacaggcgctcgccaccacgcccagctaatattttgtatttttagtagagacggggtttctccatgttgggcaggctggtctcgaactcctgacctcaggtgatccacccgcctcggcctcccaaagtgctgggattacaggcatgaaccaccatgcctagccacacatagagttttgagacatgtatttaaggagagagtgaaaaaacattcagtgaggatatggtaaaatgcagatgatgaaggagaatagaaatatggtcaagtttttgtgcctaaatattacaggattataaattatgaactgagacccactcctctttttgaattaaatttatgattcatagataggttttactgaatttttttgcaaacagcaaaatgaccactagaagaaatgcctatatctaataaaatacaaataacaaaatgcttacataaattggtttatagtttactaagtattttcatatgcatgattttataattcatttttacacaattccaacaggtagagcaagacatgcaatcccggttttataggggaggaaatagaaaccaagagattaagaaattattcaacattatatagtacataataaaagggagagttggggtttgcatctagtctctgatctctttctccccatacaacatgcacatataggccaatatataaatatacataaatatataacaagtaaataattacatatgtaaacaaattaaaacaacaaaaatccaagcatcacataaaatatcattttaaaaacactaggatgtagtcttggttttcaaatattgatgttatattgttccttacttagccttgagtagtctttttctcatttagaatattttttacatattgaatggaaattttctaatcgatggttaatttgagagaatgttaaaaacaaatggatattaaaagctgtatgtttgcaagatgatttaaatgcattctatggcctattttttttttttaagtttaaatggtatgaagcctctaaaaatgttcggctctcctgtttcccaatgagctccaccagtgtccatacctttggtctccctcaggaaatactcaagttgggttttcataatttggaaagacagggagaattgctttacagaacaaggctagttttgagatgtcattctcccctgccaaaaaaaagaaaaaagaaaaaaaaaaaggacaaaacccatttaacttcatggttaaatttattcctcaaaaatatgagcacaaaagagcctctatttaaaaatacatgtttagactttaaattagacattaaatctagttcatcaccacagtgacataagtgatagtgaaggccaaactaacaaggtgctggctcaaacatcagaacaaaaaatggcttaggtgctttttttctgttttgcttagaagaatattaccaattggtattcagcatataatactaaaaaggaatatcatataacatatgaacaaaactcttctattctgtgcttttcatataatgattaatcaggttctatattttattttaaacattctatagcaatcctaggaaggattgatagaaaaaatgagacaactatgtcttgtctcaattttattgtctgttctcgggggtgctatttctgtctgcctcctacagatctggcaagtcttaaggaaaaacaaaaaactcacaaagatcaaacaacaaaatagataatgagtttagataaattgtgtattccctgttgtaccataaatcaagactgaatatgcaggtctggtgagatgtaagtaatggatagttcctgtgttattggttctgttcctaaaaaagcatcaatagctgtttctcttcctctttgcagaaaaatcactttatgtttttcctatttaaaactcacacgtgcttattataaagagttcaggtaatgcagaacaagttgttataaagaaggcaaaagcaaccacctcaaattctactcaacataaacattgctaacatgttgaatgaatgttattataaacatcttaatatgtatatatttatataaaatgaattgattaaatactgttacaagattacaatttatgcactatttttgaaaaaccattgaattttaattttgttttaacttattagaaagaaactaaagtaaaactgaacatttgttgaagttcaaataaatgttgttggtgttgttttaagcacaagaaataatattttatgaagagggtctcgaatgttgacaaaatagatcataaaatcatcaagttgttagattcactgtatgtttcaattttaggtcatgaaagatggagacgtttatactttcatatttttcccacttctgctttctaaaccaccaagtatttattatttatattataattattatattttcaagatttttaatgtttacacttaattatgaaactataattcccagaatatttaacatgacttgattagataaatcaattcaatgataaccctaatctttatgatttctacattaatgagtttttaaatttgagtcattaggattttatcttcaagttgtttaatcagtaagggcttctgagtgccttatgcctcaagttctttcaatttgggaatttctactcttttatttggatagcagtttggctggatatgatattttagggtcatatttctttcccttgggagatctctctggacgaatggaggaatttttcctttacttgtaggattcataagttcaattgaatacactttagtgttgagcatctgaattaagttttcctggaacacaaagtgtttttatttatttatttattctaaacaaacaaacaaacaaaaaacgggatacatgtgcagaatgtgcagctttgttacataggtatacgagtgccatggtggtttgctgcacttattggcccatcttctatattccctcccttcaccccccatcccccaacaggccctggtgtgtgttgctcccctctctgtgtccgtgcgttctcattgttcaactcccacttacgagtgacagtatgtggtgtttggttttctgttcctgtgtcagttcactgaggacattggcttccatcttcatccatgtcccttcaaaggacatgatctcattcctttttgtggcatcatagtattccatagtgtatatgtaccacattttctgtatccagtctattactgatgggcatttgggttggttccatggctttgctattgtaaatagtgctgcaataaacatacaagtgcatgtgtctttatagtagaatgatttatattcttttgggtatataccaagaatgggatattgctgggtcaaatggtatttctggttctagatccttgaagaattgccatactgtcttccgtagtggtggaaataatttacattccgaccaacagtgtaaaagcattcctatttctccacagactcgccagcatctgttgttacctgactttttaataattgccattctgactggaatgagatggtatctctttgtggttttggtttgcatttctccgatgatcagtgatgttgagttttttcatatttcttggccacataaatgtcttcttttgagaagtgtctgttcatatcctttgctgactttttaatgggattgtttttttcttgtaaatttgtttaagttccttgtaagttctggatattagatctttgttggatgggtagattacaaaaattttctcccattctgtaggttgtctctttgatctgatgatagtttcttttgctgtgcagaagttctttagtttaattagatcccatttgtcaattttggcatttgttgcaattgcttttggcgtttttgtcatgaagtctttgcccatgcctatgtcctgaatggtattgcctaggttttcttctagggtttctatggtttgcagttttacacttaagtctttaatccatctgagttaatttgtgtataaggtgtaaggaaggggttcagttttggttttcagcctatggctaagcagttttcccagcaccatttagttaataggagatcctttccccattgcttgtttttgtcaagtttgttaatggttgtagatgtgtggtgttatttctgaggtctttgttctgctccatgtctgtttttgcaccagtatcatgctgttttagttactgtagccttgtagtatagtttgaagtcaggtagtgtgatgcctccagctttgttctttttgcttaggattgtcttagctatacagagtcttctttgattccatatgaaatttaaaatagttgttgctaattctgtaaagaatgtcaatggtagtttgatggaaatagcgttgaatctataaattacgttgggcagtatgaccattttcatgatattgattctacctatccatgaaaatggaatgtttttccatttatttttgtactcttttatttccttgagcagtggttgatagttctccttaaagaggtccttcacatcccttgttagctgtattcctaggtattttattctctttgtagcaattgtgaatggaagttcattcatgatttggctctctgcttgtctattgttggtgtaaaggaatgcttgtgatttttgcacattgattttgtatcctgagactttgctgaagatgcttatcagtttaagaagtcttggggctgagatgatggggttttctaaatataaaattatgtcatctgcaaacagagataatttgacttcctctcttcctatttaaatactctttgtttctttctattgcctgattgccctggccaaaatatccaatactatgttgaacaggagtggtgagagagggcatccttgtcttgtaccagttttcaaagggaatgcttccagcttttgcccattcaatatggtactggctgtggcattgacataaatagctcttattattttgagatatttccatcaataccttgtttattgagagttttcaacatgaagggatgttgaattttatcaaaggccttttgtgcgtctattgagataatcatgtggtttttgactttgattctgtttatgtgatggattatgtttattgatttgcatgggttgaacctgccttgtatcccagggatgaagccgacttgattgtggtggataagttttttgatgtgctgctggatttggtttgccagtattttattgtgtattttcgcatcgatgttcataaggaatattggcctgaagttttctttttttgttgtgtctcttcccggttttggtatcaagatgatgctggcttcataaaatgagttagggaggagtccctctttttcaattatttggaatagtttcagaaggaatggtaacagttcctctttgtatttctggtagaattcagctgtgaatccatctgttcctgggcttctttttgttagtaggctattaattactgcctcaacttcagaacttgttattggtctattcagggattcaacttcttcctggtttagtcttgggaaggtgtatgtgtccaggaacttacccatttcttctagattttctagtttatttgcatagaggtgtttatattctctgatggtagtttgtatttctgtggggccattggtgacatcccctttgtcatttttttattgtgtctatttgattcttctctcttttcctctttattttctagctagtgatctatctattttgttattttttttttttcaaaaaaccacttcctggattcattgatttttttgagagtttttcctgtttctatctccatcaattcttttctgattttagttatttcttgtcttctgctagcttttggattagttttctcttgcctctctatctcttttaactgtgatgttaaggtgttgatttgagatctttctagctttctgatgtggggatttagtgctataaatttccttcttgacactgctttagctgtgtcccagagattctggtacgttgtctctttgttctcattggtttcaaagaacttgatttctgtcttaatttcattatttactcaggagtcattcaggaccaggttgttcgatttccattaattgtatggttttgagtgagtttgttaatcctgagttctaatttgactgcactgtggtctgagagactgtttgtttaatgacttcagttcttttgcatttgccgagaagtgttttacttccaattatgtggtcgattttagaataagtgccatgtggcactgagaagaatgtatgttttgttgatttcaggtagacagttcggtagacgtctactaggtccacttgatccagagctgatttcaagtcctgaatatccttgttaattttctgtcttgtttttctgtctaatactgacattggggtgttaaagtctcccactattattgtgtgggagtctaagtctctttgtaggtctctaagaacttgttttatgaatctgggtgctcctgtattgagtgcatatatatttagaatagttagctcttcttgttgaatttttccccttaccattacgtaatgccattctttgtcttttttgatctctgttggtctaaagtctattttgtcagagactaggattgcaacccctgctttttttttctttcaatttgcttggtaaattttcttctatccctttattttgagcctatgtgtgtctctgcacgtgagatgcgtctcctgaatatagcacactgatgggtcttgactctatccagcttgccaatctgtgtcttttaattggggcctttagcccatttacatttaaggttagtattgttatgtgtgaatttgataatttgatcctgtcatcatgctgctatttgatgattttgcacactagttgatgcagtttcttcatagtgtcattggtctttacaatttggtatgtttttgcagtggctggtacgagtttttcctttccatatttagtgcttctttcaggagctcttccagggcaggcctggtagtatcaaaatccctcagcatttgcttgtctgaaaaggattttatttctccttcacttaaaaagcttagttttgctggatatgaaattctgggttgaaaattcttttctttaagaatgttgaatattggcccccaatctcttctggcttgtagagtttctgctgagaggtccactgttagtctgatgggcttccctttgtaggtgacctggcctttctctctggctgcccttaacagtttgtcctccattttgaccttggagaatctgattattatgtgtcttggggttgatcttctcgtggagtatcttaatggtgttctctgtatttcctgatttgcatgttggcctgtcttttaggttggggaagttctcccggataatatcccgaagcatgttttccagcttgtttccattttccccatctccttctggtactccaatgagtcataggttaggtctttttatgaagtcctatatttcttggaggctttgttcattccttttcattcttttttctctagtcttgtctgcatgccttatttcagcaaggtggccttcaaactctgatatcttttcttctgcttggttgattcggctgttgatatttgtgtatgcttcatgaaattctcgtgctgtatttttcagcttcatcaagtcattaatattcctctctaaactgattattcttgttagcagttcctcaaccttttatgaaggttcttagcttctttgcattgggttagaacatgcttctttagcccagcatagtttttattacccatcttctgaagcctgcttctgtcaattcatccatctgatcctccatctagttctgcacccttgatggagcgatgttgcaatcatttggaggagaagaggcactctgaccttttggattttcagcatatttttattgattctttctcatcttcatgagtttgtccagttttggtattcaaggctgctgacccttggatggggtttttgtgagtgctttttttgttgtcattgatgctgttgttgttgcttcctgcttgtttttctttcaacagtcaggtccctcttctgtagggctgctgcactttgctgggtgttcacttcaggccctattcatctgattatttcccacacctggagatgacactccaggaggctagagaacagcaaagatgagtgcctactccttcttctgggacctctgacctcaaggagcaccaacctgatgctagtaggattattcctgtacaacccctattgaagggtctcacccatttggctggcatagggaacaggactcattttacaaagcactttgtcccttggtggagggtgtgtgccttgttgggagaaaacccactcatctgggctgcctggattcctcagagctaccaggaggaaaggcgaagcctgctggtccacagaggctgcagccacccctccccttaggggcttaggactagggagatccagcttctgtccctgagcctctagttggagtcattggagttcctccagggaagccccacccagtgaggaaggatgggtcagggtcaagcctgaagaggcattctggtggaagactgccacagccagtgtgttgggctgtggggaacaagtcttgtgaccaagccatccagcctctctggctccagcaggggaaaagcacagtctggagctatagagatggatgctgcccttccctcgcccagggagcttagtacgttaggcagttgcgagtcctagtgctggctgctgctcctctcccaaggagctcaaacagcttagacagtaggcagctgcggtgctgatcgaccctgccctcgggagtttggtaggcttaagcagattccagttgagagactgttggctaagtttatgtttactccatagactctcaaaatgttcttaaaataatatatttttcattcttaccagtgatgtgtaagaactcctgttactcaatattcttggcagtattttgtattttcagtattttgcattttatccattttaatgtgtatctagtgatattttcttgtggctttattttccattttccttgtgactaatgatactgagcctctttcacatgtttattggttattgtaaagcaggttcgctgtgcaggttgtctgagtccagtaagaaaaatcatacttatacacaacaagttacattaaatgggtttattgcttacagataggcagcgaaaacaacagaatcctagaatttattgtaagccagttttccaaggctcaggaaatctgcctggaatagatggagcctctactgtacatgtcccagttgcatggcagctgaaagaccttgacaagcagcccattcttggttttatatcccagggcaatgtgagattcaaggctaaagcattgaaggactctctgtttccaggggagtctcttagttggcttggggtgggataacaaaatagcttagactgggtaatttataaactacagaaaattattgcttattgttgtgaagatggggaagtccaaaatcaaggcaccagcagtttcagtgtcttctgagggcttgctctccacttccaagatggcaccttcttgctgtgttctcacaagtagaaggtacaattggaaggttccctcaagtctcttttgtaagggtactaattccattcatgagcatggaaccctcttgacctaatcacctcctcaaggccccacctcttaatacactgcagtggagatgagatttcaacatgagttttggagggacatgaacattcaaaccctattgggggtactggaacagaacctgggctattccagtcagtcccttcctatctcaagattttctgtttccagcacattatatagttattcttgagaactacaagcaaaaatgagaatggattggattggtccagggccacccagagaattgtcctaaggttttatgtatatatgtatatatatatatatatatatatatatatatatatatatatatacacacacacacacacacacacacacacatgtgtgtgtatatatgtatatatgtgtatatatgtatgtatatatatatatatgtacatgtgtataaataaatgtgtgtgtgtgtgtgtgtgtgtgtgtatgtatacagtcagccctctgctttcccagatgcagaacatggattctgcatccatggattcaaccaacttcagataaaaaatgtttgaaaaaattgcatctatattgaacatgcacagaatatttttattgtcatcattccttaacaatacagcataataaccatctacatagcacttacattgtattaggtattataagtaatctggagataatttaaagtagctaggagcatgtgcataagttatatgtaactactacaccattttatataagtgtcttgaacatcacagattttgctatcctcagtcccccatggataccaaggggcaactgtgtatttctttttaattatttgttagaatttttgttcattgttcattgaattacttgttttcttattactgagttgtaagaattctttatactttggatgtaagttctctgttggatgcctgtttacagacaatttctcccagtctgtggcttgactttcattttataaaagctgtatttattgaagtttgtttcatcatttttttggtttgttttgtgcttttcatatcctgcttaaaaaatctttgcctactcaagggaagactttctcttgttttccccctgaaaagttcacagttttagcttttacatttaggtggatccattttgaacacatttttgtgtgtagtgtaaggtaaatccaacgttctttgtttttcatatagatatcaagttgtgcaagaaccatttgatgaaagaaaactacctttttactattgaattactttggaatatttgttggaaaatcatttgtccatatattggttctttctggattttctattctgtttcattgctctatatgtttagccttactctaaaaccacatttaattattatagttttataggaagtcttaaatgtaggtctccaaaactttgtcattttttcccaaaattattttgatagtctaggtttattctattttcatacatatatttaaatcaacttgtcaatttcatttttaaaaaggacctgctgggatttgattgggattatactgaatttctagacaatttgagagaattgataccttaacaatattgagtcttctaatctatgaacatggtatgcctcttcacttatttactgttctttcatttctctaagcacttttttgtggttttcaatatagaagttttgcgcatgttttgttaataatatgtttttttaagttttagttatccttgtctgctaattctttaatctctgtcatttcaagatcttggagtattgactgattttttcttctagtttagattcacatttacatacttgttgatgtgtttaataattttttgactagacatagacaacaggacattatgcacattctgttaattagtactaggttgtttttatttctttaaagaaccttgttagcgtgagtctagaatagatgtttactccgtgtagtcaacagagacattccactctggctagtttgagctcaaatgtctgctagctctatacaggctctgggaattgtttaggtcacaatcttctagttgttcattgcccagtcttgtggattttaccctaaatatagttggcttattgcttagttactgactcagaggatccttatacaaatttttcctctgcagtagtctaccttgaatatgtaagcttcttcagactcccttaactctggtcttcatctccttaacttattgagatcgtcattttctgtttcgaaattccctttcctgcattctggttcagagaatgcttctaggcagaaagctgggatgaacataatattcaaacaccttatttgtttccttccttttggggatcatagttctgtgctattttccaatgtccaaaccagctgtttcatatggtttgtcgaattttgagttttttacaggaagttagtgtcagttactccaacatggccaaaagtggaagtctgttaatgaatttttgttccttttgctagtttttgatcacatgtttacttgcttgatggatggagagtgtgtaatatagttcatttagctataagtacatggactttgtttcttggttaaatcttccatctctcttccttccttctccttctctaccccgagaaagacattagcaataaaacttttaaaacaggagtccagagaggctcagataagaaatgtaaccacagattatttttctccatctgcttttcaatttatatagaacagagggaccaagtataaaaatcattaaacttttaaaatttccattgatcagtttgaatttataagaataaatagctttatgttccacttaaaaatttaaaaaattactctaccatggtgtattgcagtcaactttgctatcttcttagaaaaacatgtctcagagtttagatggaatttacaaaggaaaattacccatcaatattaaagcataataataacactgttttttattgactacagtaatatatatatatatatatatatataataccattcgtttacatgtatgtatggagagacatttacacactgacaagatatgcagaaatgtaactttttatttctgtaacattcccaattatttccaactaatccctaatcccagtaaaagcagaaatacttgctactttaaggttacctggtttaaagcttagtctttttgaaaaaaagtattcaggataaatattcactttttctgtctgctcttttctctaggaaataatttggaagtgtgtaggataggctagaaaggttagagatgacaagtaggatgtttattagtataaagttattatagaacaggggcctaaaccaagttagtgggagtggaaaggagatgataaatatgagacaaagatgccatctcagaaaggttgatgaccacatccccaggtcacccagcctcagtcattctgtctccaacatacgcgccattgggcttggcctttctacatatctgttctaaaaactgacaaatggggttacacctcttctgtcactttatgttggacaatctcaataataggcaatttagtaaattattatagcagcaaagctttttaagatttcatctgtgtataatggtcacactattcactcttaacagcggggcaccagaggctttaggcaacctaagcaccatagtaaagctgtcgtgccaccttgtggtgtttcagatggttacagactgatgattttcccctagcatttatctggttataaaattgattttctctttttcaaattaggcattttatctttttgaaaagtaaattttatttttaataattgacttaaaatgatcaatagctgtagcttttagtgcttttaaaaggacattgtatgcaaatataataacttctttcaagtcaagtttttgcttgatactaattctggattgtgtctctacaaaattgtcacaatatgtttaattttcaaatgctatagattttaggccattgctaggtatgtttatgtaatgcaatgctgattgctcttactttatggggcttcactttaaggtctttgtataaaataatgcatttaaaactcaacaaagatatatattgattctaattaaaggaaattatgaaaaatgtaaagatctatatatattacctattttcctcattgtctcacttattagatatggaagaaatatttcaaatttagacataaaaaattatctttataactccaagaaattaataaggaacttttaatttacttaaaaagatgatattcaatgtgcctgagtgggttatgtatgttaagagagagagagagagagagagagggagagagaaatgacataaataaattttaaaaatatgaagattaatgtatattcttcagctgagattatttgataattatagaaattactgtaacatcttgggatgttatgagtgccagatactttctagtcaccatgataatttcctgcaaggtccatggattaatgtaaaattttgtgacatgccagcacttacacttttccctttttcaggaatcaataatataaaacttatatttaatgaaagacaacacctgaaaactatcttttcaagcaagttatgtcattcactttttcacttcactttttctgtcacttcttctgtctgctcatgtcattcttgtgatttctttttcctttcttgaatatttggcatgtgatttttggagtggcaggtgaaggcagagtgtattctatatagggtattttttttctcagtacatttttaaaatttcaacttttattttaggttcaagggatgcatgtttaggtttgttacaatggtatattgtgtgaaactgaggtttagagtatgaatgattccatcacccaggtagtgagccaggcacccaacaggtagttttttcattcttgtctccctctctccctctctctctagtagttcccagtgtctgtttttcccatctttatgtctatgtgtattcaatgattagatcccacttatatgtgagaacacgcggtttttggttttctgttcctgtgtaattcacttaggatgatggcctccagatgcacccatgctgctgcaaaggacatgatttctttctttttttgtgtggctacatagtattccatggtgtatatgtaccacattttctttatctagtccacctttgatggacaccttggttgattccatgtctttgctattgtgaatagtgctatgatgaacatacaaatgcatgtggtctttttggtagaactatttattttcctttgggtgtatagctagtaataggattactgggttgaatggtagttctgttttaagttctttgagaaatctacaaactgcttccacagttggctgaactaatttacatccccaccaacaatgtataagcattgtcttttctctgcaaccttgccaatatcagttgttgtttttttttgcattttaataatagcccttctgactggtgagatggtatctcactctggtttttatttgcatttttctgatgattattagtgatgtggagcattttttcatgttttttggccttatgtatgtcttcttttgagaaatgagtaaaatttttgaagcattgatcaaatcacattttttgttgtatttgtcttctcacttagctaagccaaaacagatcagccagcaggggtcaggcttttatagtgtatgggtttgaactttccatctctcacagtatcttttaggaacctgcaggtttcttgattacaccattagcattgtacttttcagaaatgaatgcttaccagttaattttttaactagaaccaaaccaaattaatgtagaattgtgagactctgtagaagctttctgagacaaaattatttgtttaaattttgaccgggcatggtggctcacacctataatcccagcactttgagtggtggaggtgggagggttgcttgcgcctgggagttccagaccaacctgggcaacatagcaagaccccatatctattaaaaaatataaaattaaaaataaaattaatgccaatctgctactaaaaaataaatatcattctttaaaaatcttttatttggtatttcttctagtaatcactgatgagctcatcaacattttgcattaggttatctatgtgtatgaaaatgaataagtgtgagatctattttaggatgctgaaaagtaaaggaaacatgtaatgcatttgttctgaatatgactaactgtgtcttttaaattcaggacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcggtaagctctttttaacctctgacaacccagatgacacattttatctgaatctattacaggaaaacctaaggagaagacaaatatccataaatccaggggtccagttgccttctaatgtctgataatttttgttcaatgattacttggattgactgaaaactcctcattctaccccctttcaagagaaaaattagttctaaaactaaggttgggatagagcaggaacaggccggaatgagtgctgcaaaaagcaatagagcctgctttgtattcttttccaaaggagtgcctggccctcttttctgtttcctccttaaccctaggtttctgactcccccagtgtgtgactcctttggtaaccactcctgccccctttatcccctgcagaagtgtgggcagctgagcggcctggtcactgtgctgccttaaatcagatgttcatttgcattgtttgtgcttccattttcagattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatcttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatcttgttttatgtcctgtcctcatctcttaagctaaatctgtttggatcatattaataaac

SEQ ID NO: 37308 - DNA, 17689 bp, Homo sapiens
caccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtagggattgggaaagggggacaggtctctctgtgtcataccactcacaacgggccgcgagttggtgtgggttccgaagaatcaggggtgaaaagaatgagagtaaagtttgtgctgtgtaatgaggagcttggaagcaattggatgcagggagactagaatccgcagagaatgcagaagccctgctcgtgacaggaagaaggacgctgggagcggaacacggggggattcctacttttccggcttgtctctgccatccaggcttaactgcgggttttgtgcggtgtgaaagggactggggctctgccctaccggtctcagccctggggcaggttagggatataaacttcaaaagtaggaggcaaggatatagcgtaaatttgggagactaaattgagtgaaactggaaggggctggtgagggaggggctgtaccttgcaacgagtgattctttcacaccccaaggtttcccaaagaatattgatggaaaccaggtacctgctgtggtttcataggaaaagctccgggacctcaagccattgcttgagtaggtcaacaaactgggaaaagaaagagtgaagggaattcactagggtgagggtggagagcagggctgacaggggaatcttggcagtataaagcgccagtggggagggagagtggagagccagcaggggactgagcagggagaagctgggatatgggccctccctaggaccgcgaggccgcggggcgggcccggtgcattctgtggatgaagatttggctgtctgagaggagcccggccccaaggggcaagggaaagggatgtgatgccaggagtgctggctgtataccaagtggattccttagatggctgataaccaagccgataggacaggagtgagagcagaggtagtgtcttgcagactccaacccaagccttgaggagggagcgggtgactgacaggctttggtttggcggcctcccctctcatctcagctattatgaccccttgtgggcgggcctgggaactacctatgcagcccagtgtggcggagattcagcactgggtgaggattggccgaatgttctaggaaatgaccgctgggtctaggggcgaccttcagggatctccaccctgctggagtttaccagatcacagatcagcaggctttctttttttttttttcccataaatgataatattttattatagaaaaagcatcccaaatacaggatttcgtaaacactggtaggtgaacaagtgcaattttagaagtaaatgcaaagtaaagaggcaaaacctacaagcattttgccttcagaagaagatgtagtgttctcctgcactagtgatcccacccagaacacaaatgtggctctgtctcccgtgaaagcatcagatttgctttctgagctcagtatgcccatttcaataattgcaaagtgatggcaagaagtggcgttgaacacatgactacagacccttgacttaaaatattgagacagggacttgctctgtcatccgggctggagtgcagtagcgtcatcacagctcactgcagcctcatcctcctgggctcaagcaatcatcctgcctcagcctcttgagtagctgggactacaggtgtgcactaccatgtccatgcctggctattttttttttttctttttgcgttgtccaggccagtctcaaactcctgacctgatcagcaggctttctgagcttgagtcctgtcctcgtgctggcttccttagttgtggtccatgttatgtgtccttgggagtttcagttgtcctgaaatcatcgttctgccacccagaaccagcctgctctgcccctgcaggagttaactacgcgctcagcagtggcacaggcacagttctggaatacatccataaccacaggaacaactgctgttctcaggagcattttttttttaaactgaaggagcgtttgtccttggtccagctgtccaggacaggaaggagttattccttggggactgattagctcatcgctctgcagcacgctgctgtgtagagagccttagctggattcggatggtgcgtgatactggcagtgactcttcttcctccctagattccctgccctcattctggtctctttatagcaacactgtaactcctgtcttctgcctggaaggcctgggatggcttgagcgctacactgggaggtagctaaaggcctcctgcgttctattttcagctcccctgccttgtgcgtgacctttttttgagcccccattttcccaacataggaatggtccctgctttctctcttcaacccagggatacagttttttggaagagagatatttggtccatgcagaacacatggatatcgctctcaaattctgcccatgttaagggaaccttataagtgagaccagatggaaatggaggtgaaaatgaacctgtctgtgtgaagtctggccaaagaacaaatagaactgtagtgggcttccagatgattcatttgtagattttttttaccctgtaagatttccttaggcttaacctttagctataactgccttacttaagtttcttccaggctctgttgagctcactgtcagatagcccctcctgccctctttcacacatcttgtccagggttagcgtgcccttgacaggcttactgtctccctccagggactcgtgggctcccggcgcatgagggcaccacagttcatgccttcacatcatagatgaagaaaccaagacccagaaaagataagggtcttagctaagaaaacataatctgatgcgactggttcccttagtggcctgactgtatgcatgagaatgccagggaggaggggagaagcacctacgggacacacagggaagggggctgggagccaggaaggctgggagctgggctgtgtggggagccagcagggtggtggctgggctggctgcctcctcctgctctgcccagcagggaggggcagtcgaggtgatgtggaggagttattattaggaatactgcagtgcggctgtgaatgaggagatgggacccagaggctgacacaggaaggaagatggagggaaggggaagaaagggcttcacccaaggcttcagaagctgcccactcagattttaattttcttgctgtcttcttggccccttcctaaccacctttcttgtgttgaagtttctctcttggtgcagttcccctcccttctcgggttgacagaagtgatgagctcacaggaacaggatttgagatgtgctgctacgccagctagactgcagggccctggaatgccgggcgggtcctaagcagcacgttgccctggcttccatctctgtgatggaatagaatatgcactgcctgccatggctgatgagacatgacaaagctggctctgggaagcatgccctacctaggaccctgccctgtggcccagggtgtcgtccggcccacttgcagtcttaatctctgaattctgggccctggaacaggctgtgtctagttctcatttgccgtactcaccgggcccctttacatactctactttctctttccctctgggtttgagtgctagtaaccccaggctcgtgtgtccactgctgtcatgctgctgtgggacttccggcctctgagccagtctggtcacctctctgtgactcccttagaggaggctctgggtgggtagtttctggagctagtggggaaggactttgagtgtctcctaccaggctcttgacccactctgttgatacactatgtgtcctgcagatgcttttacagggttaaatgataccacaagaggcagggcagcgggctcgacgagctctgttctggtgcgggcaggaggcgggagcccggatctgtgcgactgaaggtgggagactgggccgggtggacctggtggtctggtgtgggcaggaggtgggcaatgaggccagccggacagctggctgagctggggcctgagcagggatgggcatcacggaggaccggagcctcagcacttgcccaaacagagctcctggtgcacagcccggaggttccgggaaggcagctggcgagctcgacgcccatcaggaagcacagagccgcgtgacagctgcagttggtcaccagctggctggccaggcattcctgtgccctgctcctccccatccagggaaccagaactggggtctgaggcctgagccagagaggtggggacagggagccatgggggcagggaaggactctgtacctaagctctctccgcccttcccatgtctgtcaggtgggaagaggagtacacggtgcggatccagctgcaagaccgtgtaaatgagctccaggaggtgagggtggcgccccacttgctgctggtgcttccctgggtacccctgtctgcccatgaccctgctgccgtctccctgtccctccttggcatctttatcttcctcccacctcggcagtgccaccaacatcagggtttctcccaactgcaggaagcccaggaggctgatgcctgccaggaggagctggcactgaaggtggaacagttgaaggctgagctggtggtcttcaaggggctcatgagtaacgtgagtgcagccccaggcttcccgagggtcgaagtgaggcttctgaggccagaagagtaggcccttctagtgttggcctgttggcctcccgtccacggctcctccccttctctttgctttccttccctttttcccctagccacccctaactccagagaaagacaagcaacaaaagtctcggtgttgcgtcacagaggtggcgcagcttctgagggcctggggttgcagagcagttagtgagcagcttctggggtggaggctctgcagctggcgccggggcgctgggccgattcctcagcctctgaggcctcacctttggcgtggggaaataaacgcgtgcgctctgcaggagtattgtgagggtggtcatgtactcgggacagtgcccagcatgcagtgttagctggaagagtgttagctgttgcgattattatagtcctttctccactcttataattcccaggagtctctttctctctgggaatgtaagttctaggaggatgaggaccgctagtcgttccagtgagccccctgcatgtcccaggcactggccatgccctccagggcttccgtttggccagggagcagtggcccgagccgccccatgcccagcatattcacacagtgctgtggggaggccaccgctacccaggaagaggggtgcagtcagctcagggagactccacagaagaggcaccggtgcaatgtggtgggaaggatgaggaccttgccaggcctaattcgtccttgtctggagaactgggcgcctcctcactgttccctgggctccctggacagaacctgtcggagctggacaccaagatccaggagaaagccatgaaggtggatatggacatctgccgccgcatcgacatcaccgccaagctctgcgatgtggctcagcagcgcaactgcgaggacatgatccagatgttccaggtgaggacggagctgccctctgctctcaggggtgggtggggcaggtggatgcttccgtggcggctggcctggaacgcaggccctgcctcctgcttggggagccttacctggcaactggggccctcacggggctagactggggggtaaggagcagcatcaggaggggcatcgtggaagctgtctctaacgccgtctctcccttccccctctctctcctctgtctgcttcctctcctctcttcctctcatcttctctcttgcttcctccacagaagaagctggttagtttgatctcacgcaagcttattaatgtcccagtcccagtttctaagctgcctaggcctcctggccctcagtttgggcccgctgggctcttgagcacggatttttttctgccctttcccttttccttgctcttccccctttttctctctatctcttgttctcttgactgcatttctttctctcccttctcccccggctttccagatctggatgtgattcaggttctcttttgtacacattgcacactcatcctccttgcgtcctaaagcttttttttttttagttgagtcatttaatcaaaaagactttttttagaaaaaaatttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgtgagtccgcaggccgtgctcccgcagcaccgacgccacagcagcccaggaggccggagctccccagtcccccgccaggacgaggccccgcccgccctgacacccgggttccctgtctctaggagggagtatgattttgaggacgactgtgacagcctgacttgggaggagactgaggagaccctgctgctttgggaggatttctcaggctatgccatggcagctgcagaggcccagggagaggtaacctctgctcccggcctcagggccctctggctctgcctctccagcctgaagcccactcccccgctcctctccttgctctgtccccccatgtggctgtcatcctctacctgcgtctcccctcttcctttatccttttgcttttctttctccagtttctttaaccagacttcctctctctctctctccctgacttggccctttggaatgcgtcccatcccatccctccttggctggcctcccccgcttccctttctactccagcagcaggaagatagcctggagaaggtgattaaagatacggagtccctgttcaaaacccgggagaaggagtatcaggagaccattgaccagatagaggtaagggcaggagcggaagccaggggcgtggtgtcccagagggttttgagtggggctgcaggcgcagtggcctcatccctgctgcaggaccctagagaccaaggtcttgggaggaggagtgatctctcagctatagtcctcctggtgggctctgaagacctcaggctctggaaacagacagatatcggttcaaatctcagctctgttacttacaaccaccctgaacttgtaataagttacttgttccctctgagcccctcctttcctttcctttcctttcctttctttccttccttccttccttcctttctctctctctctctcttcccctccccctctatccctccctccctctctcccttgtctttctgtcctttcttttttgagacaaggtctcactctgtttcactctgttgcctaggctggagtgatcctcccaccccagccttctgagtagctgggcccacaggtgtgtgccaccatacccagctaatttttatttgtatttttttgtagagatggtgtctccctgtgtttcccaggcaggtcttaaactcttgggcttaagtgatcctcctgcctcggcctcccaaagtactagaattagagacatgagccatgtgtccagccctacacctgtttctttttctttctttctttctttctttctttttttgagacagggtcttgctctgtcactccaggcccactgcagccgtgatcttctggatccaagcaatcctcctacctcagcctcccaagtagctgggaccacaggcgtgtgctaccacgcccggctaattttttgattttttttacagagaacagggtgtcactatgttttccaggctgccctcaaacttctggattcaagcagtcctcctaactcggccccacaaagtgttgggattacaggcatgagccactgtgccgggcctttttatttgtaaaatgaggaatttaataatacctcacctatagggttgtttagaagatcagatgaaataatgcatatatagagcttagggcagtgtctggctcatagcgagtgtagcatagtggggactgttttattattattaacactatcagtgccatggcactcagagatggactgggactttcctgtttcttccactcagcctttgagataacagagaaatctccatgctttttcccaagccttgaagtaccttctagaggtacctagaggcaagtggagctggtgctttagctcaaactctaggctttaggagctgcaagaaggatttgtggaggccgggcgcggtggctcacgcctgtaatcccagcactttgggaggccgaggcgggaagatcacgaggtcaggagatcgagaccatcctggctaacacggtgaaaccccgtctctacgaaaaatacaaaaaaaaaaaattagctggccgtggtggcaggcacctgtagtcccagctactcgggaggctgaggcaggagaatggcgtgaacccgggaggcggagcttgcagtgagccgagatcgcaccactgcactccagcctgggcgacagagcaagactccgtctcaaaaatacaaacaaaggaagaaggatttgtggaaccacagaatggaggttgctgttgctgtgggaggagggatggacgggacccccgtgagctctcctggcctggtgaggtggtcctttcccgacgctctgactttgggagaggcatggagccttctctgcgtctcagcctctcttcaggcccacatgggagattcatacgtagtccccccttatcttcagggcatgtgttccaagacccacagtggatgcctgaaaccaaagatagcactgacctcctgatagcttgggtccagttgctgtcaactggaacgtgtttctgttcatgtctcccacccacacattcaatgccttttctatcttaactaagcacttagcgtgcgctgtggcggtaccttttgcagttcgaggtgtgacagcaaaactggcacaaatttctttttccttctttacaatttcacggatagaagattcattcttactgtagagcttaccaacctcagcatcggattctttttcttattaagttgaaaacttttaccttttcacttaaagggagcatattttggcttctctttcacatatccaaattgccagcatcactactcttgtgctttggggccattatgaagtaaaaataagggttccttgaacacgggcactgccataccacgacagtcaatctcatcactgagatggctcctaagtaactaatgggcaggcagtatagacagtgtggatccttgggacagagggagggttcatgtcctggtctggatagagtgaggtttttttttttttttccgagacggagtctcgctgtgtcacccaggctggagtgcagtggcttgaactcggctcactgcaagctccacctcctgggttcacgccattctcctgcctcagcctcctgagtagctgggactacaggcgcccgccatcacgcccggctaatttcttttgtattttttagtagagatggggtttcaccgtgttagccaggatgatctcgatctcctgacctcatgatccgcccacctcggcctcccaaagtgctgggattataggcgtgagccaccgcgcccggcagagagagtgagattttatcaggccactcagaacagcgtgcaatttaaaacttaggaattgtttatttctggaatatttcatttaatattttcagatcaaggttcaccttgggtacctgaagccgtggaaagtgaaaccagtggataaggagagagtgactttattcttttcatttatttatttatttatttatttttttgagacgtagtctcgctgtgtcgcccaggctggagtgcagtggcgcgatctcagctcactgcaagctccacctcccaggttcacgccattctcctgcctcagcctccagagtagctgggactacaggcgcctgccactacgcccggctaattttttgtattttttagtagagacggggtttcaccatgttagccaggatggtctcgatctcctgacctcgtgatccacccgcctcggccttccaaagtgctgggattacaggcgtgagccaccgcgcccggccttgactttattcttattgctgtcacattggaggtgtttgagaaggaagtcgagaaattattttcctatatactcattctcccaacacacatcaaactgtcctgctcctgcatcaaacctggttttcttggccaggtagatgaggtttcctggatttgtgctgctagctaaagacatggcaagggaaaccagtactccccaccctcccgtctaccgcggctcactgtttcctcctcctgcctgacctgattcttgtctccctcttttggatggtggatttaaggtttgtgttttcactgtgccttcaaccaactaggggcctttgtgcggccatcttcgtgagaagagatctcgggctgccatctctccctagtcttccctggacctcaagtgcccagtgtaaaacatgatctgaaagaacgaaaataatatcttaaatggaatcatgccttttaagctatttttggctgggcgtggtggctctcgcctgtaatcccagcactttgggaggccaacgcgggcagatcacttgaggtcaggagtgtgagaccagcctggccaccaacatgtgaaaccccgtctctactaaaaatacaaaaagtagccaggcattgtggtgggcacctgtaatcccagctacttgggaggctgaggcaggagaattgctggaatctgggaggtggaggctgcagtgagctgagattgtgccactgcaccacagcctgggtgacagagcaagattccatctcaggaaaaaaaaaaaaaaaagtattttcaaatcatctgactcctcctctctcccagtgcaatgactttaggcagcagtccccaacctttttggtaccagggactggtttgtggaagacagtttttccactgacccgggggaaatgattttgagatgattcaaacattacatttattgtgtactttattactatttttaaaaattattattattatttttagagacagagttttgctcttgttgcccaggctggagtgcaatggcgcaatcttggctcactgcagcctccgcctcccgggctcaagcaattctcctgcctcagcctcccaagtagctgggattacgggcatgtgccaccacgcctggctaattttgtatttttagtagagatggggtttctccatgttggtcaagctggtctcgaactcccgacctcaggtgatccaccacctcggcctcccaaagtgctgggattacaggcatgagccaccgcacccggcctgtgcactttatttctattattattacattataatatataatgaaataattatacatctcaccataatgtagaatcagtgggagccatgaacttgttttccgcaactagacggtcccatctgggggtgatgggagatagtgacagatcatcaggcattagattctcataaggagcacacagcctagatccctcgcatgcacagttcacgtaaggtagggttcaggatcctgtgagaatctaatgccgccgcggatctgacaggaggtggagctcaggctgtaatgccagtgatggggagcagctgtaaatacagatgaagcttcactcacttgcccactgctcacctcctgctatttggcctggttcctaacaggccacagacaggtactggtccgtggcctggggtttggggacttctgcattaggggaaccgttaggaggacttgctgacctcaggagtacccaaggtgcctttatctttgtgacctttgatctctcagggtcactaagatggagcaaggtaaagccaaggcccagagtggtgggcgggaggcagttcttccccaccgctcctcacctctctctgtctcctcccgtcccacccccaagtctgttcacacagcgagcctgcagttttcaaggtggcttgtcaaggacatctcctgacatgcacgttcacctcctgaccttgttcctgctgtaaatttgtgaattaagtggggacatagacatatgcagagactactggtggcagtactagccttgtatttcagtagaatatatttggttcatttccttcttcccagtctccctgagtgatggttccagaacccagctccctgcactccggttcttccaaggtggagaaattggggtgtaggcagctgatctgaacaagggctggtggcactgtattttccccctgggttgaacagtcaccgtgtcctgctcctcccactactgtggggccccagctgtggatccaagcctgccagggaagctgtccccactagggcttctcacccagccagccgccatctcaccccaaatgtcactgtcctgaccatctctgctgtctggccctgtaacctgtttccttctttctctaagttcccaccctctctgtccaatccacattatggcagctggtatcctccccgttctcttcactcaggcagtcacgaacgtcatctccaggaagtttcattttgcttccccttgcggcccctgccctttgtacccaaaacaaagagaggcagtcgactgtccctggcactgagtttgtgctgcctgggccctgcctctccgcctgcctcagagtgtgggctgcagaatgggcccggggagggagaccggatttctttgattctgagccccgtgttttccacgtgtgacatttctgaaatcaggacaggtctcagaatcaatggcacctccaatatgggagtcttccttttagtgtctgaaaatggcttttaggtgagaaaataaagtgataaggagagaatggtaagaggattgggcccctttcagcagttagccaggcttgtatgccacgggtcacagagagagttaattcccttcgaggtctgggtctgccaggatgaggaaaacctgtcgctaacccttacgggagctcacagtgcagtgaggggacagcccaggaccagcgcagtacaggggatgaggggtgagccgggccccataggaacctgtgtggccctgggagcctgtggatctgctccatcccgcccacactgactttcctcaccactcttatcagtcttaaaagaacacagcctgcagcagtacctttgcattcctccataggcaaagatttccaggaaaagcagaggaaacaatggtgtattcgctgccttctgccttggtctggtttattttaaaatctgagccttcagtaatggctgcctgggcccccggcccagccactgctcttggcgtgttggcctcctggcgggggcaacagaggcgctgtgaacgccacctgttaaccccgatggccctgcctgccccaccacagctggagttggccacggccaagaacgacatgaaccggcacctgcacgagtacatggagatgtgcagcatgaagcgcggcctggacgtgcagatggagacctgccgccggctcatcacccagtctggagaccggtaggcgcctcccctgggcatggggccttccagggggacacagcggggagaaaggttggaacacagccccagagaccctcaggcaatgactgggtcacatcttgctgtggggctgccctttgggagttacctggtggggctggcccagacccacagctctctcccttggcagttggatgagctatgtccattcatgacgggagggctgaaacctcccaaggccaccagctctggtggttcccctggttagaggcagtttaaaaactggcaaggaacagaagggttgtgggggcagatttttatctaaagtcagggccatgatttgtgcatttgaccctgtgtaagttacaccgcaacaagaaagtgaatttttaaaaatcacaaaaatactgcagatagacataaagccaaggccctagagtcagggtgctggaggctcagcagcttctctcctactgtgacttcagctatttcttttttttttttttttggctcactacaacctccgcctcccaggttcaagtgattatcttgcctcagcctccaaggcgcccgccaccacacctggctaatttttgcatttttagtagagatggggtttcaccatgttggccaggcttgccttgaactcctgacgtcgtgatccacccgcctctgcctcccaaagtgctggaattacaggcgtgagccatcatgcctgacctcagcctctgagttcccaagacacaggcggggcccatttccctgtcagggtgggtttggagagagttcagtccctgccgctccctcgccatcccgcggccccgccctcgcttccggtacttctcacgggctgccagagggtgaggcagcaggaggaggagtgccgtccgtcttcaggattcctgcctgccccaaggttgacaactggtgtttttttctagaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacgtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcatgcctgtagctgggactataggcatgtgccatgaagcctggctgatttttgtaattttagtagagacggagtttcaccatgttggccaggctggtctcaaactcctgacctcaggtgatacacccaccttggcctcccaaagtgctggggttacaggcgtgcgcgctctaccgaggtatgtacttttgtctccactaggtaagcacacgtgcaaagtgaggcccgggagtaactgcccaaagcaactgagccgttcagtggcagagccaggggtctggacctaggtcccagctacacgccttgcccctacccaagttcccctaaggacgatgatggaaataagtcaccctgacacatctcagttcatcttcctcaaaactatgcgaggtgggcatttttaccgatttttaaacattatatagtccttaccgccttgggcatggttttaggtacttggtttacctagatgaatcctgcttgaagaccttaggggctggccacgatgtcctcagataagacacgagggcacagaaagcaatagagcacgtgctcaagacctcacagctgcggaggccaagctggaattgcccgctgcagctcagctccaggctgagctccactaaccagtcagcgtcagagcccagtgcgagccctgacttcctccacctgtcagcctccctggggctgcccacagaatagcttcttccatgtttggccaacagcagatagcctaggactggagcgaggagaggaaaaggccttgttctctgaagtagtggtgccagcttcctgtagcactcaagacgtctgagcgggaagcaaatggttctcgaagcaagcaaggctgtttggaggccctaccctcagtctgaggagaacataccaggtccctccccagcaagaatgtctcaccttgacacaagcccagcttccctcccctctgccccagaccctagaataagacaggacaagt

SEQ ID NO: 37309 - DNA, 28640 bp, Homo sapiens
ccggctcgcggagagcgtagcgcggccttggtggcggaatggcgttgagtgacggcccggccccgccatctggttaaagggactcgttcaacacggaagtgtcccggggctgcattggtacggagccctggggcccagcaagggtgtgctcctgcgggactgatgcggggaccaccccggccctgccggcctccaagccgcgggagggcactgagcctgtgctggctgggcctggccgcctggttgctacacacccaacccccttcccgtccccatttgcagaagtggaatcaaaactggggcttgaccccggatcgatgactgggactcagcctacgcggacgccagcgcagcctgcggcggccgagccacctgccctcacagggcctggccgggtgcatcaggaacaggcggtcttaggtccctaaattcgaggccctgtaatgtgcctcatcttggggtccctgaatggggcccttgggcccccaaggaaaccctgagaccttcagaatggacagccttgtggaggcacaatttcattcacttgggcaaattgtgcgcactgaggcataggaaaacatgtaattttgtatttagatgtgttccaagtataaagtggcgtggctgacatttcatagagccttaaattgccttcaccaggcatgacctcagtttgtgttgagatacttggcaaagaaatgtattgcattgttgagtgattgcttattgcgttactgagtaattgtattggcgttcataaaagcatgggtgctcacaatagaaattgggaaggggagtagggaactgtatttgaaatcttctgatacacttaccaagaacaaatgtattgttcatttggaatttgatacggtctctaataattttctgtttcataatggtagtgccgcccccacccgcaaaacgtttcaaagggtcaagagaaaagaccaaatgcccttgtcaactggaatttatacgtctgtttcctgccaagtaattaaatcgtagattcataatctatgtaccgaataaatgtggaatgtttttgttttgttttgttttaatgtataagacttgggtcaaggtgaggagggaaagaaagggtttccttgaaagattcttgtgtttaattagaattaattgaaaccactgtgcttaaaacagagaatgatgttagaagaaagccttggaacgatgatcaacataagactacacagtatgtgggataaactattccaacttacagcatttttgttttttgtattgccagtgctacagctagaatgaagcacatcaacctatcatttgcagcgtgtggatttctgggcatttaccacttgggggcagcatctgcactttgcagacatggcaaaaaacttgtgaaggatgtcaaagccttcgctggggcgtctgcgggatcgttggttgcttctgttctgctaacagcaccagaaaaaatagaggtaattaagtagtaacttaggctgtgttcctcatcaagaaattaagacccaaaggcaaacaccagcattgactctactaagttaacactgcagagaaataatcgtttgcttggaaacagaaaggattaggacttttctcttaagatgtaattattagggatctgtgctctggttgtggaaaagattattttgggtgatagtgaaataaggaaataaaatgacttatattactcttgagtttttatttatccttaagattccagctctgttcctttcaagcaaaggatatttcttctttctatgatcatgagaagagcatggggcctgttttcaaggccttgaacatgtgggcaacaagtcttacctcactgctacttagaaatagatacataaattaaaatgtgggcatgcagtttctattaagtggaatggtataggaatttaattcttttttaattctcacagtaagaggaagctctgagttccaagcaatttatccagaagtaatacaaataattattcattaagtactttatttaatgcaatctatgttttaaaatctgttttctgctatccagacagtgatcaatcatttgctgactgtgagagctggattccgtagttggagaatattatatttgttaatcattacgtactctagcagctttgaacaataatgaaataacaatttaacaccctcatacccaagaatgaatttcagtcacatttaaaattccaaaactatgcaatgttaaacatcagaatctcatttcagatcttttgtgagctgcttatcaaagggaagctagatttgaggccaatcattcagaaatccacctatcttcctgtctttatatggttgatttacagggaactagaaaagtgatttaaaaactgcagagattaaacaggaccagaaccttaagccatgcaaggtataaatgaggtcggaaaattccccctaaactagcagattcataagctttgaattacaagctacctccttcccataactgtgtttcgtttttgaagcagagggctttcagggtgtcacttcttcctttttactgcagtcttttcttgagctgtggcaaatcctaagctttggagttatgtagacttggtttccaattatcagcaaattaaaaaatgtattgtatgatttagaattaacctgatttggaaatactgcactagtacagccatttatacttaactaaaattctgccatgttaagacattgaataatttacctgaattggagacttgatgtcatcatattctcagatcagtttacctgttgttatttattttttgcactaaatgagagactgggttgtgttgtctgatggtgctggtatgatgaaaaggtgtgtgtctttatctggtgctcccatgggaaggtagaaaataattttcttagtttccttagggcatcctcatttgttcttcttcaaaataatttttcagccaaagtaaccctttgacttaaggttattttagttcctttatttttagcatctgaaataatccacttgtaggatagccttgagttttttttagcaaatgtttctacctactcagattcgtgttcgctcggttctcgctgatgatataagttcctcaagctttttactgttgtgacaaatacgtgtgtaattaatcttctgagcttatgcatgaataattaagaggagcacctgatactgggcatattttaagtggtaggcaaatttagacattgatgtggaagagctcaatgctgcaagactttcctcagccctcacaatttgcgaggaagccatggtgctagactcagtggggaactcaaagatgaataagtccatctttaataagtttacagtctggtccgggctatggagagtattgaatataactaatattagtacaaagaaataggctagatgggcagtctagctcagtagaatgaacatacatttggtggggctacccccatttctcacccaggagcttcccacagcctatatcaattcaagctccctacaatccacctacctcatagcgcttagagtgatgtcacccaaaggcacatctgatcacctcattacccccggggcaggggctgtctgtggacttaggacaatgtgacccaggtttctcagcatgtatcacaaggccccatgtgacttagccctacttgtggctcgccatagggacacatttcagctctgtgcccctctcagaattgttcttgctgttgtttttactatcctctgctttcaccttcgtcctctgcccaactcctgtttatatttaagtcccagcctgggtgtcaaattggagggaaacctttggcaacccatgaggttggaggttgacacacactgtattcatttcccgttgctgatttgacaaaggaccttcagcgtagtggcttaaaacagcatgtgtttatcatcttccagctctggcggtcttaagtctaaaagggtctcactgagctaaaatcaaaatgtccatgctcactctctccagaggctccaggggagaatccatttccttaccttttccagtttctggagggtgcccagactccttggctcctgaccccttccttgatttctaaagccataagcacagcatcttcaaatctctccaactctgcctctcctacctccctccttcccttacaagaaaccttgtgatgatattgggcctacccaggtcatccaggattatctcctcatctcaaggtccttaactggatctacaaagtcccttttaacatagaaggtctcctagtcacaggttccagggactagaatgtggacatctttgtggggagaggagagactgctgcaataatatagccacttaactgaaattctgcaatgttaagacattgaatgatttacctgaatttgagacttgatgtcctcatattctcaaaacagtttacctgttgttatttattttttgcactaaatgagagccaaacacacccttgtgggggctcttatagccctctatgacctgctcttggaggcacttatgactctcatgagcacagggtctttgtatcttgtcctctccaagtcccagtgcctagccaagtacctggtgcccagttggttgccaaattaattcattatttaatacaaaatagacttagatgtaaattctggctctgagactcatttttaatgagatattgggatagacacttgaactctccaatcctccgttttcttgtctgtcaagtgggatggttatacccaccctgcagggtgatgtgaagatgaactgacagtgtcacctctgtggatcccagtccagggtagacatgagcatccctgaaagactttataaaataccagtgcccaagatgaatctccgaagactctgattcagtctgtgcaaaccatagacgtcactactcctatttctgtcactggtgctgtcatttgtaatcagctttgttgcacggttgtaatcaaactgctgctgagaccacaaaataggggtgggagagaaggttaattgcgctgaggaaaccttttgaagaatgtgctcaattaaaattcagattgagccttcaaggatttttcagatggggcaaaggccatttaaggtgctttacaaaggaaaaaacaaaaaaagattaggattcttgagagtgtataccttgcaaagggcctgagagtggtgggtgaggccccggccaggtggggaatttgcacacctttaataacatgacaccctacatttgctgttgggtctatagaatcccaagttttagaagtggaatgattgttttctttacaacacctagggtcacttcttaattttctttttttaggaatgtaaccaatttacctacaagtttgccgaagaaatcagaaggcagtctttcggggcagtaacgcccggttatgacttcatggcccgactaaggtatacagagtacattttgcccaaaagtacatgaagacagaatgttgacgactctctgtacaaactttggcaagctcagcattctctcttgtaaaatatttacagggagttcaataattaaaggtgagtaattcagattgctttttcttctttagaagtgggatggagtcgattcttcctcccagcgctcacgagctggcccagaaccgactgcacgtatccatcaccaacgccaaaaccagagaaaatcacttagtctccactttttcctccagggaggacctcattaaggtaacaaagccatgtttcctatttgaagaaatcagcaagtgctgatttcaatacttcatataaagtaatgagcattaccacgttctttagatcctgtgtctcttaccaggcccgatagatggttgagtgctcagtaaattacttgtttgatgaaagtattcgccaggatccctcctgaggccgccttatgatgcactgtgatccaaatgctccctgtacttgttcagtgttttcctgcaatgttcagatctcacgttgattatgtgaagcaagtcgctgatgcagtttagtagcaataataattcctgaaatttatgtggctaatactttggagtgtatgtagggtttttaacatgtactctcttattcagtccttcaagtccttctgtaaatcaagtagggtaggtgttattgtgacccttttatgtttttgtttttgttttgagatggagtctcgctcgtttgcctaggctggagtgcagtggtgcaatcttggctcattgcaacctctgcctcctagattcaagcaattctcctgcctcagcctcctgagtagctaggattacaggcacgtaccaccatgtccacctaatttttgtatttttagtagagacagggtttcactgtgttggccaggccagtcttgaactactgacctcaaatgatctgcccacctcagccccccaaagtgctggaattacaggcatgaaccaccacacctgatcccttttatgtttttaacagagaagtgaatggaaagattttatgtgatgtacgtacctatgtacccaagattatcctgcgtggcagtgggagctaattctggtacccaggtctcctaacttttcaatctaatgttccattttgtttcttccattttgttctgatgtctttctatccaaacacatttgaaagttggttggttgagaattcatcatctctgggaaatacttcagctggttgatttccaaataccaatgtgcctgctgtggtaatgcactgaatatttgtagggtggaaagggtgtacttctcttggaattttttcttgtttttccctctagtgcaaatcataacaagcttcaggtaatatggagaatgtatgttttcgaaagcagaaggtaatgggttgagagtaagtggtaagattccatatattcggatgctgtcatttgaaatacttaatgaaatgttgaattgacaagtaaaattactttgccacttaatagattagaatattttccctcgatatccctattacgtcattctctcacttacaagagtctatcttataaaaagacattattctataatcttattacaatattatgtagacttgacagtgtcaagggaagagctgggcaacccatgctaagtggtcctaagccatcaatgtccaatacagacagataaggcttgcggtgggcagacatgcatcctcttgtttacctaggaacagactgtgtgctcttgtgacataaaatgagggggattctgccccagatctctctcacggggtccatccctggtttttctgtctacaatgacagaactctcagcccctgatctccccacatccctcctgatttacatatcactctttagcatgctacctcttttactgctgtcctgttcagctttcattgtccatcctccttcaccagaatgtaagctccaagaggcaggggtttctctggtttgctcactgccgcagcccagtacctgccacactgccagccattgtgtaggcactccgtaatatgcgtgaaacgaatggatatgaaccaaggttgcatctgttacactggctcgatttaaaataaaagaaaagaaagaagctgggccctccatactgtatgacctgggcaaaatcacatagctggctggggcccagctgtgactgtggttcatgtgtctagcattcttccctaactatatataccccacactggataaaatgctcatcctccctatccatcccttttatgtggcagagagaagaatgacacccaaaactgtccttaccctaatccccagaacctgtccagatataaccttacctggcaaaagggattctgtagatgtgattaaattaaaggtctgagataggaggatgatcccatattatccaagtggacccaaactaagtacatgaatcttgaaaagtggacaccttttctggattctgtgtcatggctggtttggagatgtagcaaccacatgccagggaagcacagaggcttctcggaaagcaggtccccactgacagccagcaaagaaaagggggcatctgccctttaacctatggaactggattctcctaacacctgactgagcaaggagacacattctcccccagagcctccagaaagagatgcagccctgccgacacctggattttccccagtgggacccataccagactttggaccctcagactgtgtgacaatacatgtgtcttgtttgaaggggttaaatttgtagtaatttgttataacggcaatagcaaactattgctgttaagaaaacatgacgtttttctagttcctttgttttggataataactattcagagaatttgtgtaattacttgagttcattgaacagaagagaaattgttgacacaaatgtgtaatactttgtaaggagaatatggaataattgacatttattctaggttctacaagaaacattccacgtgtttaggaggatgttttaacatttttcagaactaaaaaggaaggatgaatagttccttgatagcagatggtgattatcaaactgtgaaacctatgcctggaatactcatgaagcatttaggggaaaagagtgagagtgcgggaagactagggatgatgtagcaaaggaagaagtgtgaagaggaagtaaagtaaaccccctgccaggtagggacatgatcaagtatatatgttccggtgaaagaagtggctggtgggagaatgttgtctgaggtggtgccatgggaggatggtgcttccgacctttttggttgggactggggaggctgcctgaaggtcaccccactccccttaggtggagacaggaggctctgaagccatgcattgaagcagctcgatgatgggtagctgtgggtctcccagggcttggcacacctcgctctgaacatacagcctggggtcttgatatggtttgcctgtgtccccacccaaatctcaccttgaattgtagttcccataattcccatgtattgtgggagggacccagtgggagataattgaattatggggatggttttccccatcccattctgttctcctggtagtgaataagtctcacaacatctgatggttttataaggggtttctgcttttgcttctctctcattctctctcttgcctgctgccatgtaaaacgtgcctttcaccttccaccacgattgtgaggcctccccagccacatggaattgtgaggccattaaacctctttttctttataatttacccagtctcgggtatgtctttatcagcagtgtgaaaatgaactaatacaggtctacttcccagtatctggatattctgtagatgggaggggatgggagacagagagaaagagagaggttgattaaaactcaagttagagtaaaagagcatgggagagcatgaaatactaaacactggtgattttcaccttctttaaactttgctccatgttgtattttctgtttttatcattaactcatttattctgctacttaatagttgaattttttaaaaaatgcctagtttttcattatccactagctgactgatgctgtttgttacagagtgcctatgtacctgaaaatccaactagaaacctgtagcttagaatatgtgagagtgtgtgcttgtgtgtttgtgtctgtgtgtgtattttgacgtgtttttgaatctcctcaagaatgattacttgttttatgagtgtcccggtgatcatgtctaggcctgtcgtttcctgacgttgtcctcttggactgattacttttgagtctcagttttctcatctctgaaatggagtaattcacacagtaatactaatgagtgttactgtacagaataaataagataaagcatgtgaaagtgtgttttaaatgataaagccctttatgcatgctgaatggagctaatatttcataaataatgaacgaataacataataacccacacacacccctgctcagcacccttgtatgaatctgtcatgaaattttaaagccatattaaatcacaactttcttttcttcaggctgaataggattactttttcttatcagtgttattctttaaccccttgcttattacctgtcttcatgaacaatgtgctaaccgatatctgtaatacttcaggaaatggttgctactgagttcttgctacctttaggcatctgattttacagctcatcattataagccttcttttttaaaataaataattttgtgtgatgattcatacttaatttatcttaatgagcttcacctttagtagcatggaaaaatcactcatttgatagctgcaatgctagttgattgttttcttgaaacccttgtggactgtgtggtccaactattcattttatttggggttgaatttccacagaattttgaatcttacgttcatgaggatttaactcagtcttttctactttataaactgttataagacaggtgcaggccttaaggcattcctttgttcagaatttattggtgccaaccattcccctcctcctttatagtaactgtactgacaaagggaaacacagatgatgtctgctcaactacttgaaggcagcctgcagaggggagacccctttatagagttaaccagagccccaggaggcccccctccaaaatcatgtctttatttcccgtctgagagatttatttccaggtgccacacccagaaaaatgttacccccaaggatgaccctttatgtctgtgggtcgccagcagatcaacaccaagctgagatcagttcctgcaaatgcagataatttagggaattgaaaagagtcatggaggggtggtacacatccacctaaccctgttgttggtgggctctgggacccttggcgagtctcaacttcttggagccttggtttcttcatctttaagatggagaccttcagaacaaggtcaaatgaagtatgtatgaaagtatttcatcagctcttaagtacacaccagatgtgcatggtcaccttcaagtgcctccactctccagacatccatcccttcatactgttcattatttagcatgattccttcctgattcctctcctggtgtgccgctctacacagtatcccccgagtgtcaagtgtgtgcattttgcataccaactcattcatttcgagttccagattttattgtgggctctttttctttagaagcatgcatgcaactaggaaatccaaacacattttaatgttagccttcagcaaagcctaactagggaggtgagcccctaggttaaaagaaagtcatatgcaacttccaaggctgagctgaaatgatgcataaattaacagtgcaatggcgtcgtagagttccactacttccctgaattggtacaaatcattgaattcttcatgtttaagactgatgcacaagtgttttccgaaagggtcttttgacacgtgtgaatgctctagggtagaggtacccaggaagcctttcctgcaccatagtgtccctggccgtcttgagaaaattctgccctgtctctgttgcagtgatgtcctgaatttctttgcatgtgtgagaatgctcttaacaagatcctctcacatttagccttgtgaaggtgaaataaaaactgaatttaagattggtcattatcttggaaaaactgaggaagataaatttgaatctgtctttgaatttgaactacagcagcaagttctgtataaacagttaattctcattaaagtccacagtaaactttaggcataaatgaaacttgctgagaatttaatccctaaggaagctaggccacataattttctaaatacctcttttctgtaaaatgcaaaatgaagagagtcaatcagaacgtgtcgggaatgcgcacctggcgatgttttatacagttgctacaggaagacactagctctcatttttatcattgtgtgtttagtaagaacacaaatcagtggtttcacatatgtccaacatttaaagtgctgtaccaagtgatagggtgtgaaaagtatacccctgctttccacatcagcgttctcaaccacaaacactgcactcctggcagtaagggcccagattattacccagatagttatgtattgtgacagctgtctgtcctttgtaggaatttgagcagcatccctggtctgtgttcagtagatgctagcaggacacacccccccccccaccctccaccccaggttatgacagacacattgctaaatgtccctagcgggtaaaatcacctccagttgagaacaagtgctgtagacgtgttgaggttcattggcgaggtgaatttcactgggaatattgtgaggtgagatacactaaaagcacatgtttaggcataatattttattacatgaccttagaatgtcagtctttatctcctttcttaggaaattctatttgcctgcaataaaatggcagtaagctgactacaaataagaaaagctgcttagctcttaactatctaaagctaatttcccaactaaacttggtttgatatacaaatcatcagtccatataaagggagagtcagctatgacaaaaacaaatacattgatttggagaagtgacaagtattttccagttcattgcacttttcatatcatttaggaggattcttactgttattatctgtaggaaagtaattggatagcatttttcatccaaatatctcaaaatagttgcaagcattaacttgtgaactctacattatactttgacacgggggaaaagaaaaaaaaaacataattctaaggttagtgatttttttgcagtccacatgtctctctgcagaatagtgaaataaatcattatatttatgtattgtctttggttctttaaagacctctaagtactgtaatttcacaatatgtacgctatctacaaattgctctagttattgctttgcagtgttgcatttgctgaataacttcattaaatagctacattgtgcttgcgaaacatacctagggtctgtgattatttttttaaaagcatagccaattgatgataaggtcaggtttagttagggtgaatgcagttaccttaaccgtaaacaacctttctctgaagccaatgatgtcattgctaccggtggactgagagggttggagttgaagatgcctgctttctgtcctctctctcctattgatttattaagcgatcttcaccaaatcacccaaggtgctactcactcctgctttgcctctttgtgaaagagacatgattgctctaatgtcacagtattgcattatgcgggccatttaaagttgagattttgagaagaatgtcacagtgcgggcatgtccacattgacattttgtagaaggttggcagaccttgcgtgaggttattattatgccttgtaataaataaataaacaagcacataaaaaataaatagaagtgcatgctttcctttgggaaacagtgctgcaaattagcatgctttcaatatttcaataaacaagcgattgagatagatgtgcatgaaattgaccaaaagatgaaaaaaagacccattgtgagaaatctgacgtgtatgttggctctggtaaaaatatacattttatattaaattgattctggggacagtctcaaccacgtattagcagagagacctttgagcaactttatctttttgagacagggtcgagaaataattaaatgagacactatatttgaggcaaggtctacttcatgaatgtatgacctgtgcatttgcacgtggctccactatccaaagggcctcaccattggtttaatgctctgctgtcaacatcttaatattctccatactttctgaacagggggccctgcatttatcttattttggacaggacccagaaattatataactgattctggcacctagcaccagcatggtgcaatagaaccctttcacacttggctatttcttaccttctttcctgctggagtccttgtgttgtgctgttacccttgaatttgccactgctgaaacctgaggccccagaagcttctgtgggcactcgtcaggagcctgttgctataggagctgttacaaccaggcctgtgcctttgcaaccaacatgccaccaacagcactgggcaaccttctttagtgccactattgaggtaggtggaggagtgttgggtccattcccatcacagagaagggagagagatacccaacagatgtttgttgagtactaactctgccaagggctggacataccaggagagacacaagtccctctcctttcagtgggttttttggtaatgaggaaacaggagacatgtccaaggaagaaccactgcataagaaagctatggaagttccctgtacctggtgcagaaataaacatggcaagagtggattccagctgtgtcgggtcacagctcaaaagaggattttcctatggaaattgttatgctggtgactgagtctgtaatttagttgcagttcagaataaataggcttttgagagctgacccaaaaaccatacctataacattgatttttggaggaaatgccttctgagttctaaataattgtaagtggatgatctgcaagtcagcatttgagccataatccatttctgaataatgtatgatgaaaaaaaactcatgaaatctttgacaacaaacagccagagtctttcacttatcagttgaaagattatagcttaaaaaatattcagtatctaatgctgtatgttttcaaatagaacactagtgatttggaaactacacggcaaaataaaacatttacatttcagaaaagctatcagagcccaacttcccatgatgtatggaatggtaatttcctaaatgacaatctttttcaactgtttaaatgggagataaagcataattgatgtcactgcttgccagggttccattacatatcctgaccacgtcattggaacataaaatatgccattccctttgcaaatcctggtgacataaatgagaacatctctgagctgcggactaatctctcctgtcataatcggagggctttgttcctccagaaagcaggagtgcaactgtaacatgatttttacagtatatgatggaacattacatataatttatctgtaacctttacatactcaggaacttagacttaccttaaatttcattttgtagtaacttgtgtgtctactattaaaatgctgatttttacctaggtgaagttgattgattcagagtatgtcaacttgtacctatctgtttagagtcttttccgatataaagtgttatcttttatgtaattacgtgcagtgctgcacttgaagtctgtggggcttatttattgagattttgctagtcaatactacatcaactgtattgtctgaatgttcatgcctgtaatcatgagctgcttctttattttatccatctaggtcctcctagccagcagttttgtgcccatttatgcaggactgaagctagtggaatacaaagggcaggtaagcttgttataactgaggaattaccctcctccctatattaatatgtttcttttgaaacatccaattttataattattctagtggcttcaaatcagtttatgtttttttcctcctaaatagctttgtttctctttaagagggaaagaatatacagggctagtgataacttatcatcaagatcttgtgaatgggaatgattgactgtgatgctcttattttcatcatatatatatattctgttgttgttagcagtgaacgattttttttccacctagtaaagtccatactcacagccccttctaagcagagttgtaccaccgtcagggtgagaaaaggctttagggctccacaccttgtcctcccccagacaatgcggcataggttccttccagcctgtcctcagcccctctgctaggggacgacccactcccctccaaggctctctacttacccagacacgttgatcactgcaaggccaaaacccattttgtttgaggagagtgctcctcacttggagctggcacttaagacaggatgccagttcttttagggaaatttagacatgggcttccacctgaagtctgcgctgactgtgacccagcttccttctgtgatctacacagagtttgttttgagtattcaccattcgacccaaggcagctcctccattgcatggacacaggttcaacatgagcattttattctcaaatatagtgtctatttcacatatgtcacagatacgtattttataaccaaatatagtatttggtttaatgtgtttatttaacgtatactggaaacatgcattttataattaatacagtagctattttacagacaccagagatatgtattttataatcaaatagagtatctgtttagcacataccagagatatgcattttgtaattaaatgcagtatctatttaacacataccagaaatacgcatcttataatcaaatggaatagctatttaacacatagcagagatatatattttgtaatcaaatagagtatctgtttagcacatacaccagagatatgtattttataatcagttatctaacaattactagagatatgtatcttttaatcaaatattatacctatttaacacattccagagatatatattttataattaaatagagtagatatctaactactagatatctaaatagagtagatatctatttataattaaatagagtaggtatctaacacataccagagatatgtattttataatcaaatagggtatctgtttagcacataccagagatatgtattttataatcagagtatctgcttaacacgtaccagagatatgtattttttaatcaaatatagtacctatttaacacatgccagagatatgttttataatcaaatagagtagatatttcatacatatcagagatatatattttataataaaagtatttagcatatatctaataaagtatctatttagcatatatcagagatcaagcatatattcaggatgaataaattacatttattttatatatatgtaatatatatttatttattaataaaagagtacatacaaagtgctttaaccatctttcattcattcattcacccactcaccttgagggcccagcaccaggcctgtgctcaaggaattgatggtctctcaacaaaagaactgagttttacaaaccctttggctaataggatcgaggcagtgtctctgttctgatctcatcggtcctcatcagtgtctttccttgagctttgctgagctttggaattttttcttttctctctagtgcaaatcataataggcttcaggtaatatggagaatgtatgttttgatagagcagaaggtaatgggttgagagtgagtggtaaaattccacatattcagatgctgtcatttgaaatacttaatgttgaattgacaagtaaaattactttgccacttaggagattagaatatttttcctctatgtccctattacgccagtctctcacttacaaattaagagtgtttctatcttagaaggagaggcaggtggtagaggctccaggttctcttccaatatacactttcttcttctttcttagtaacagaatcccaatttttatctgaacctgtggctgtgcagctaggttatacatcccagcttcccttgcagttaggtgtggccatttatttcattgttgggcaatgacatgtgagccgaataactgtgggacttacagtacaaggaaagttgtatatctttccatttttcctgttgcccagaacttagatgtgattactggagctccagcagctcttgttcatcatgaggtcaaggatcacaccctgaagatggccaaatagtgagctggaaatacccaggtcctaaatgatttgaggagtctaccttaccagcctgccctcgatattcctgttaccagaaaaaagaagtaaaactttttttttttttttgagatggagtctcactctgtcacccaggctggagtgcagtggcacgatctcagctcactgcaagctccacctcccgggttcacgccattctcctgcctcagcctcctgagtagctgggactacaggtgcatgccaccaagcccggctaattttttgtgtttttagtagagatggggtttcaccgtgttagccgggatggtctctatctcctgacctcgtgatccacccgccttggcttccgaaagtgctgggattacaggcgtgagccaccgtgcccagcctaaaacttttgttattattgtatacaccagaatccagtgctatctgctgtagggattcttacttccaattttacatgtgaggaaattgagatgtaaagacatcagtctacttcactgaagtcactgagcttggaaggggtcaacttccccaagatagtccttaatgtttctatctttgctatgcctcttactctgctttgccctttagttcttttcaaacaatgcgttccttgttttcttcctgtccagccgcagcgccatgttgtgggtgtgtgacaggaagactagcaatgtttaaaagggcatgaatgaggaatcagtttctagtgaactttccatgatgtgattaagtactttggacatggacatagagtgacagccacaattaaacagcagggaacgcacaggcccagaactgtgaggaagatggaaagcgacccacccaagccccttgaccctggacaatgtcccaggacagtgtcttgctgatcatgtggtgtctgtgcataggaggcacaccaataattacttgtagagttgaaccttatgtctcctgaaagcattcagttttcctctgttgtttaatggagtccacaataagggggcctcatgcacatgattgacagagagccacagcggccttgcattgtttataacaccagaaagggacaatttagaagtgccattctctgcttaacactaactctctttaagcctgatcacctcccacattctaatagggcttccatgccgagttgttttctagaatctttcctttccattttcagggaagcgtgaatgttgctttaaatgcagtgttttaatgtgggtataagctttttatgtgacttaaattacataaacatttcagttgtgctgaatacacctcttattttctagattttcatgttttcatacagctcaggttttgatgtatttgttgtctttagttgtttttctgaagtgacgaaagtggaggtggcagaaggggaaaaagggacttagcgttacttatatttgtggcactgagtcaggaaaggcagagaaagtgggactcagccaacaggggcagagtctagtctctccacttgtgacttttgttaaatacacagacctcctcatttctacattgcgggtattactggattttattaagatatatttgtggatccaatatgtgcattaaaaaatgtttttattaatcgcttagaagaatcataccttaataagacttaagattaatttcaaccacagcaaataccagtatgagtcctttcaaaaccctctaccagtgatttaaagtggaatgatgtctttgaaaattgctttttctttttaacttgggaaacatggcaaaaccctgtctctacaaaaaaaaaaaaacaaaaattagccaggcatagtggcatgtgcctatagtcccagctactttggaggccgaggtgggaggatcacctgagcctggggaggttgaggctacagtgagctatgatcacaccaccgtactccagcctgggcaacagagtgaaaccctgtttaaaaaaaaaaaagaaagaaagaaaactgctttttaaaaaatattattttaaaaagttctgtagctttctctggcttcatcttatgactattttgataccttatagtacatactcattaatagatttgtcagtgaatgaatggaaataaattgaagtttagtcctatatttttgactaatgatttttctttactacatatgaactctttccagtggtagaataaatccacaggaatgttcacacatttaggccatgttttcacagattcttgtcaatttggaataagaatgaaaattttcaagaggaattcttaactcatttgttttaagagatagaattagcattggcaggtgactaaaatatcagaataaaatcatctccagaactggcacatgcagatcagaagaaaagctgtagggttggctgggcacagtggctcacgcctgtaattctagcactttgggaggctgaggcgggcggatcacctgagatcaggagttcgagaccagcctggctaacgtggtgaaaccctgtttctactaaaaatacaaaaaattagccgggcatggtggcgcatgcctgtaattccagctactcgggaggctgaagcaggagaattgcttgaacccaggaggcagaggttgcagtgagcagagatcatgccatggcactccagcttgggcaacaagagtgaaactctgtctgaaaaaaaaaagaaaagaaaagctgtaggattttgcattgtttctttcatctgagttggaattcaagtaatattttgactgtgtagtattacaagatcgcttcttggccttttggttaagattaagtatatactattacaggaacgtgaaaatgcactgttgtattaccctagtccatgcggatatgggtcatttttcctttcattattgacacttgtgtgggaaagagaattgtggaatactccatgtaactgtgcttttatatgaggttgatactgtggtccttaggcttctatttcctcgtggcttagactttttacatggaaatgcagctctgtcactgtcatagcaaacagtggtagctggccttgccaccagctagatttggctggatggaaacctggatatcaatttctagttattctgaaatagacgctcttattcttcagtcactttttagatttttttgcactgtctgtttaatttttgaaacaacatgttagtcctctaggaaaaattttctgtatggtgtttatagatggtcaactgttaaccctttagagccttctcaaaagtagatatctggagtcatcatttttaatcatccttcacacatgcaaaaaccaagaaagcaatgcaccaagaatcaatgcttagtagaggttagtatggcaggtttctcaacctctcttttagaattgtatttttacttgtctttctttgattaaaaaatctcatctgtctcttcttcccaccgtaattggaagattctcacctgtgtctaaggaagtggatatctctttgtctctttccctctcccttctattttaggaattgctaatcaagagcattgttgggcattgctgtctgtaggctatctcatgaaagcaatgcagatatgtttgcaaataagaaattattgttcaaagcacatttacttctttctcacccctcagaaatcagttctaatttgccctgccccatcgagcatccctgaattttacagtgtgcgagaaaaaaaacctgaagtgaaaagacaactatcccttcttgcctgtatattctatagcaatagatgttttattctctgtaaagtatcagatagcaaatgctttcaacattgtctctgtcaacacacctactcaactgtgctgtagtagagggaagcagccgcaggcaatatctcaacaaaaggtcctggtcatgtgccaataaaattttatttactgaagcagatggtgggtcgtagtttaccaccccgtgaactatagcaaggaaacctgcaagcctcagtttcctcttctgtaacatgagggaactgaatatacaagcatgacctttctgccttacagggttcgcatattaaattatacatgtgaaatcacttttaaactactaggccctctgccatggtatttataataattatagatagcaacattcattcttccagcaaagtattttttattcacttgttttttgagcaaaatataccttaagaaaatggagcccttcatggaagttctatcaaaaacatatccccagcatctaccatacatccagacacacactagatgctcagggatcacttgctgaatgaataaactggccctttcagtacaggttaactcatcaggtcctttcttaagttttccacttgcgttatgtaatagcagttacttgaattcataaggcatgttctcaatagctacccataacacatgaatgtctaaagcgaagtttaacaagtactgccagatgaatattctagcctgtttaggtgtaatgggtagccttatctctttagaagtgattctattaattccagttttcagtgctataactttcagagaacaatcacagtagatgtctgccccacaattgggcatgagtttttttgttttgtttttggtttttctattgagcagttgcttatttctatgtcttaggactcaggcattgacttgaatgtggaacacatttagaatatggccaaagattagagaaaagagtagtaggtctagcagtgggactgagaggtggtcactgtacagcctgtaacgagtatgattttgaaactattttgccttggaatttttatgtacttgctctcccttttcctttgaggatgatggtgatatgtgatgaaaactgacaaacacacaggaaaactctaacggggtagaccagcagctatttttcttaaggacaattttggagtcacagaagctcatggaagtagctaccagcatgtaaaatgctgcccatgaagcaagaaggtgggaatgactcacagccatatgttgtgaacagccagagaattcatgggcagaagtgtttactatgcaagattttaaactatcagtagagcacaagatataaaatgtttctacttttaatttggaggttgaagaatatttgttgttgtgacggttgtttccagaaactgctggaatctgtatgcccgaatgaatgtgtgattgtcctaagtgatacagctcgtgagagcataaatcaggagtaagaggtaccacatttagcatatctgagcagtggggctatagcatcaagggttgtgaaggagccggtatcattgcaagtttaatcaagtgatttgataagctgctatacattttcccttgtcatttatctaatcagaataagctaacaagagtgaacaaaatttggaaaaaggattttcgattccctaaaacagcagtcattaaccccacagtaaattagaacactttttaatttactgagccagattgcccttcttttcattaagttgaataaatcagaagagctgttacttaaagttgcatatctttaatttttcttgatgaaacctgtatgaatttttacatcgttgatgacagcttctgttgacaatatgaaataattttggaagctgtctttcttttcccttctgggtattatcctattccagaatttgatatttacacctaaagcaatcagggaaaaaaagcaggttctgggacagaatcagatattttggagcctttttttttgcaaacctcccttttagatcatacagttacataaccagctatattttatgtatacatatgggtacatatataaacacacatacacaaacacatgtgtacatgcatatacacatacacatataaataagtatgtgtaatacacataacacataatatatcataatctttatatcttttaaaaataatgacaatatgcaaattatgcaggtcagttttattttaatccaatctacttatactctctcctccaccaaaatgcaattctctcaaaaggaattttcaacccatttttatcttttatttatttacttttatttcctttggaggagtttgtggctgtccagagcctttgtaaataatgtaataccactcattttgtcatcagctttagaaataaacacaattggccaggcgcagtgactcatgcctgtaatcccagcactttgggaggccgaggcgggcagatcacgaggtcaggagattgagaccatcctggctaacccggtgaaaccccgtctctactaaaaatacaaaaaattagccgggcatggtggcgggcgcctgtagtcccagctactcgggaggctgaggcaggagaatggcgtgaacctgggaggcggagcttgcagtgagctgagatcacaccactgcactccagcctgggcgacagagcgagactctgtctcaaataaataaataaataaataaataaataaataaataaataaacacaagaaggacatgaaaaagacacattggaagaaataaatgcatggttttaagtgagttgagaacattttattttggcctgtttctccctcctcttgccacctttatgttgaataacaaaggtttgttttatctgcattgcattttacacattgaagcaaaactcagtttacaaacttcactaaagattcctgcatacaggactttcaactgttaccagactttttgtttttttgtatattatctgaaggctatttttaataacagataaacttagacaatttgggtgttatttccatgtgtgttgtgtttattgagtgctatagctgatcatgtgaatacatcagatcatggctgcattgagactgtttggccttggaatagacagcagaaggaatattgtctgtgtggttcttcagtcaccatttctcattgtgcgcttctgtagagctaggggctgaggctgcacacaccttgagcacctcattgtccgtcctcattgccccaagactctttcattttcttccttgggaggcttctgtcctccgccttctccatcactcactcccctttgcggtgggcttgagagcactgagtgcctactgaggaatgtgtgctttgatgcagcactcccattccttatggcttcaggacatgccccttgcttcaagagcacaggaaccactttggaattagaagcatttctagttgctgtatttactttttaagtttgccacagaaaatgccagtttccaattcatataataaaaatggaacctcctctgctggtggatgttttgttcagcatccacagtaaatttgactttttagtttgattaaataatgaaccccaatctaattacacatggcttcttaagcatgcactgtagtcagtaagaattcaagtcttacagacaataatctagttaaattctgtccagagttgttcttatattggtaagtgatatgtgtaccaagatttgttttacccccagaacagatccccaatgggattagtcctcaaaaatagcaatttaaaagcatatccaaggcacacatattattagaagctgcttttctttgtgcaggatgtgttgttgacgtgtgctgacgtgagatgtttctttccacagaagtgggtggacggaggcctcaccaacgctcttcccatcctgcccgtcggccggacagtaaccatctcccccttcagtggacgactggacatctccccgcaggacaaagggcagctagatctgtatgttaatatcgccaagcaggatatcatggtgagtaattatgttcagtgatatttgaagagttctgatctactaaaaattcccacagaattcaacgtgtttcccaagcactggaagttcattgataattgtaggtaggagttgcatcttctccttagtgtgttgtttaatactttataacatgtatcagccataggaacggggctaatttttttatcttttgtagagacagggtttcactaggttgcccaggctggtctcaaactccctggctcaagtgattcttccaccttggcctcccaaagcactaggattacagacatgcaccacgcccacccatttttgctgcttattaactgtcactgctttttcttcacttcttttttacatcaataaacttggtaggatatcagagcaatttttttcttctttgagagagggtgttgctctgtcccctaggctggagtgcagcggcaagatcatgtctcactgcagccttgaccgcccaggctcaggtaatcctgccacctcagcctcccaagtacctgggactgcaggcgcgtgccaccacacccaactacttttttaaaaaaattatttgcagagacaaagtctcactgtgttgcctaggctggtcctgagctcctgggctcaagtgatccacctgcctcggcctctcaaagtgctgggattacaggcctcagccaccacgcctggcccagagcaattttaaataaaatcatttatttgcttagaaagatggaggtaatgaaatatataaaaatagtggagaaaaacttagggacccaaatgaataattgacataaaaatactgattcccttaatctagtctaatagttttccacatgggatgatattgtactagacatttttggttatcatgtcccagtggtgctactggcatctggtgggtagaggccaggaatggtgttaaacgtcctgcagtgcacatgactgtcccacagttaagacgtcgtggccccaaatgtcagcagtaccaaggctgagaaactctcctttagtgtatcagtggaggtaacttctgaagtttaaatttttcctactgattttttgttactgctaattgtatctgtgataagaaaacctagattataaaaatagtgtatatttacctgtactgcaatatcctacagcttaaattttggtctttttattctagttgtccctggcaaacctggtgagactcaaccaagccctttttcccccaagcaagaggaaaatggaatctttgtatcagtgtggttttgatgacactgttaagtttttacttaaagaaaattggtttgaataaaatgcataaaagtttataatgcaaaacacgttttagatagtttttgatggaagtttctaatcaaatcctttttagaaaatctatcatgactcaattgtattactccttgtaatatttgtgtttatttttaatatttgaattattacttagcacatggatataagaggcactttattagaatttgacaacgtcattaagaaggatacacttaggtgataaggaatcatttttggtgaactgttgtgtcctttaaaaaatggaggaggataggttctttgggtaaattgaggaacatggaaaatggagggccaccacttaggttccatggagaatatgtggcatgatcttgacgtgaagcatgggtgtttccgtgacttagctgtgtccctgtagctctggaactgaaggaactaggtaggagaggaaggatttgagaaataggcaactcatggttaaagacctttgatcaggactggaggaacaaaggtttgtgtattagtccattttcacactgctgagaaagacatacccaagactgggcaatttacaaaagaaaggtttaatgggctcacagttccacatgactgaggaggcctcacaattgtggtggaaggtgaaaggcatgtctcacatggcagcagacaagagaagaaaacttgtgcagggaaactcccctttataaaaccatcggatctcttgagactcgttcactatcatgagaatagcatgggaaagacctgcctccatgattcagttacctcccactgggtccctcccacaacgtgtggcaattgtgggagctacatacacttcaagatgagatttgggtggggacacagccaaaccataacagtttgctttccacaggtgtgtgcagttgctcccagtgcagttaggggcagatatccagaagcctaggagattttgaagaggcttatcccctctcatcttcctcccctaaaccccaccccagtttaggagattatcaagctggttgtcattcattctctctctctctctctctctctctctctctctctctctctctctctctctctcgccatacctctctgagtatttagctattgttctatatactggatacatctattatgggaacttaaatagataaaatactactaaacacaaagaaccaagtagcctagtaaataagaattaaatccagaataatcattcacttctcatttttaaatcacgttgtactgatcccaggttttttactttctgagtagttgtccatcactttgaggacttgtgtatgggcttgtaccaatttactgacactgtcttaaatcctaaatctgtttttatgaggttttgccaagcaagaactcttgattactaagaggcagttagagacaaaccaatttaattccatgtcttcaattgtcacgcatttcttcttttactctttgaaactattctttgagtcaattttatggttctcagaagccaaaatacacaacttttagcacataaacaccaacgatggcctctttttgaggagttatgcatagacccactctagagtaatgatggtccctgtggtatatactttctcctactctagcaaacatgtagtttaatcttaatgtgttgtttccataagtgacatgaagtggatagattctcaattgttatgtccacttattcactaggtaaattttcagttttaatacttttctccttaccccttcctttgatcatttcatgtgaatattctatttgtatgatacactgtatttcaataaattccttgttgatgtacccttaaattgaagaaatttaagctgcaaaaccaaatctcattgtataagacttttttgaagtatcttgtatcgactacatatgtatttgaccctgtgggaggatggtacttttctttttaacttttattttaag

SEQ ID NO: 37310 - DNA, 12424 bp, Homo sapiens
gccaagggcactattggccagttccgttcaacgaagtggttgctttttttagttccggcaatgagttgcgccggggcggcggcggctccccgcctttggcggctgcgcccgggggcccggcggtccctctcaggtaaaaggaggcgcgcagtcacagtcctgcgccggtctagcgagctagggaattttcgcttgaggtttgggtcgaagaggtcacgggggagaggttcgtaacgtcacaggcctgcgacggagcgcgactgcgtgacttcggcctccggggcgctggcgggcggggcggggtctgtagttagcggcgagagtgacaggaggacaggggttgtttcggcagtgacgcctggggagtgacgcaattgcacccctgtgcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgtgaacaggacctttaggtgatttgcatgcactgtaaactgtgaaagccatcagtgtagtggaaggagcatcgaatttagagtagagagacatggttttggaccctggttcctgctttccttgtttcatctgtgctgccttagaaaattgtcatgagcccgggcgcggtggctccggcctataatctcagcactttgggaggccgaggctggaggatcccctgaggtcaggagtttgagaccagcctggccaacatggtgaaaccccgcctctactaaaaatacaaaaatttgccaggcgtgatggcaggtgcctgtaatcccagctactcaggaggctgagacaggagaatcgcttgaacccgggaggcagagattgctttgaggcgagattgcaccactgcactgcaacctgggcgtcagagcgagactttgtctcccccgcgcaaaaaaaaaaaaaaaaaagaaatttcatgaagtcgttttctcaacgttaaattaccgtgtaccactttcgggatttttgcctaatggcagtactgcttgaacttttgattactagatgtgtttttttgtatagctatgtcccatttaaaaattaaattaatttccttgaaacaaaatccttatggtgaatgggaagccagtgccacttgccacaaatgggtgagtaatcattaaaaaaaaacaaacaaattaaaaagttatgaaattgtattaaatactgtctttctgttacaaaggggaaattagcaagtgttgggaaagtgttaaggctataccagctgtaaatggagttatcttccttaatgaaagagattgcaagagattttgaaagagtaccccttactacatggggttatttgctgcatatccataagccacttaatattttgtaggtaccacactggcatgtttcacactttgggaaaatatggacataaagtgatgcatttgagagctagcaccgagcctcaattttactttaaagtatatggtaatgcaggcaaaactccgagggttgttgaatgtgaattttaatgctgctctgttcagccagtgagcataacagaataagactcatttctgtttataaagttactttgcttcttatatcttattttatcctcataactcagtaagaaaagtttattattgtatgttttcccttaaaaaggaaagagcctgattattgcctttttttttttttttttttgaggcagagtcttgctttgtcgcccaggctggagtgcagtggcgcgatctcagctcactgcaacctccgcctcctgggttcaagtgattctcctgcctcagactcccgagtagctgaggctgcatgcatgcaccaccacgcctggctaatttttgaatttttggtagagacggggtttcgccatgatgaccaggctggtctcgaactcctgacctcaagtgattctccctccttggcttcccaaagtgctgggattacaggcgtgagtcgccgcacccagccaattttatatgtaagaaatgtcgatcctgattttcccaaggctagtgttagagatgggacacatgttttatgcttctttttttctttttttgagacagagtctcactctgtcaccgaggctggagtgtaatggtatgatcttagctcactgcagcctttgcctactgggttcaagtgattgttctgcctcagcctcctgagtagctgggactacaggcacgtgccacgatgcctggctaatttttatatttttggtagagatgggttttcaccattttggccaggctggtcttgaactcctggtctcaagcagtccacctgcctcagcttcccaaagtgctgggattacaggcatgagccaccacacccggcctatgcagtctctttagtcagatatgctcagtgagatggagaggatcatggcgaggagtagaccaaagctgggtcactatgcttcagaacttaggtccacgcttctttgttaaaagtgtgacatttacaaccccatctggtagaagatttcaagttcagagccaccccaaatttcaccaacccacctcactaccttgtgtccaaagcactcaagcctttgtcatgaaagaaccacatatgtatctaaaatgaattttttccacatattcgctggctgttgaagttagcctaagtgaaaagaagtttgcataaaagacatggtagtcacggctaagagccctaaaacattacaaagtgataccaatgctggctgggcatggtggctcacgcctgtaatcccagcactttgggaagccaaggtgggaggattgcttgagctcaggagttcgagaccagcctgggcaacatggtgaaaccccgtctctactaaaaatataaaaatgtagctgggcatggtggcacctgcctgtagtcctagctactctggagtcctagctgctctagaggctgaaaaaggagaattgcctgagtctgaaaggtggagtttgcggtgagccaagatcgcacctctgtctccagcctgggcgatacagtcagagtctgtctcaaaaaaaaaaaaaagtgataccagtgcagatcgaagctaccattacaaactaaatgacccttaggtcactattttccgtatctgcaaaatgaggtgaatacaccttacacacctaagaatgctgcaaaactcctctctggcagggaaaaaaaccttttgagttactctaatataaggctcagagaatataattaaggtgttaaggttaggagatttatttttaaagataaaatataatctgtcatgaagaatttacattttgaagatgagagttcatttgaattgattttggagcataatgaagtgaaatctaggctccaaggctagtctcaaaatcgaatgcccaacggtgtggggtttttaatttttttttctgtttttgtttgtttgtttgtttttgtttttagacagagtctcactctgttgcccaggctggagtgcagtggcacgatcttggctcacggcaatctctgcctcccggtttcaagctattctcctgcctcagcctcccgaggaggtgggattaaaggcacacgccaacacacccagctaaattttgtatttttggtagagatggggtttcaccatgttggcgaggctggtctcaaactcctgacctcaggtgatccattctccttggcttcccaaagtgttaggattacaggcatgagccaccgcgcccggacaggtgtggattttaagagaacttagtctgtggttctcagccttggctgaagagaagacttatgcacagagcttctaaacaatatcagttcagagagccccctcccagagattgactggggaagagcacggtgtttttgaaagctctgtatgggcctctcctgtacagcctgggctggggcgaagtgggccagagggttggtgaactggagaaccatgctcatctagaagcggttgccatgttaactgcctggtaagaaggtaggctcagcatttccagatcttcatacacttaaagtgaaaccagaaatccagatctttaggtaaaatcctctgttttaacactgtaggttaaacagagtccgtttatgggcacgcctggcccatggggaactgatttgtgacctccatcccaaagtgccctttctgctgtctgtaaaaggaacatctggattttacctgatcataacgaagaataaacacttgcatttcagcttatggaagaagaaccagtgtcagatttcgcagttcaggaatgactttagacaatatcagtcgggcagctgtggatcgaataatccgggtggatcatgcaggcgaatatggagcaaaccgcatctatgccgggcagatggctgtcctgggtcggaccagcgtcgggccagtcattcaggtgggtgcttcttcatctccctcaccctggtctactgaatgggcagatccaaaggacttcaagtaatgaatcatgggaggtcaagcgttccctagggagatgccattgtctccaggagagcgaaggttggttcttggtggagatggggagcaaaaagcatattgttctttttatggataaagcacagagagacatctagtacatagacaggtatgcggtatatctttggtatcagtactccatggcgggggcaggcagtaatgaaaaaaggttaagaatcgctcagcacagcagtcaactgtgctgaaatgttgcagccctgccccctaccgtgccagagaggtattgtatcccaagaggctatgggaggacctgaaatttgtagttacacagacctggttcacattttggctctctcccacctcctacctgtgcgaccttgaggatggcacaggacttctctgggtttccatttccgtatctgcaaaatggcctcataatggcctgggtttgggtaaggaaccgggtctggcccataaaggtcaagttagtacaagttaaatggcctgccctgaacccttgggcaagctacttagcctctctgtgcttcagtttgttgtgtatactggcgcagtcatagtgtgtccttcacagggattgtgtggattgaatgaattgcttgcatgaagctatttgatggcccctggcacttaggacgtgccatctaagtgttagctgcagctagcattctccctttttcctctgatgtaaataatattcagggccgggtgtggtggctcacgcctgtaatcccagcactttgggaggccgaggccaatggatcgcttgagcccaggagtttgagaccagcttgggcaatgtgatgagactccgtctctacgaaaaatacaaaaattagctgggtgcaatggctcacacctgtaatcccagcactttgggaagctgtggcgggtggatcacctgaggttaggagtttgagatcagcctggccaacaaggcaaaaccctgtctctactaaaaatacaaaacaaatcagccaggcatggtggtgcatgcctgtagtcccagctgcttgggaggctgaggcaagagaatcacttgaacctgggaggcagaggttgcagggagctgagatcgcaccactgcactccagcctgggcaacagagtgagactccgtctcaaaaaaacaaaaaaaaccgcacacacaccacaaaattagccaggtgtagtggcatgtgactgtaatcccagctaatttgagaggccgaggtgggaggatcgcttgatcctggaggttgaggctgcggtgagccatgagcttgctactgcactacagtctgggtgacagagtgagaccctgtctggaaacaaacaaaccacaacaacaacaagatgatgctattctagtaatctggaaggaaattacacaacagccaatgttctgccttcctgattttgaaatgggttaaacatgtcatttcttatgtgtgtagacccttgtcatttactgggcacattgtgggcctgagagacttctgctgcaaccatggctcatggcagtcttaactggaattgagataatagactgttttgtattcttggtgctctcttctctttgtcacagattcctttagtctgatgttttactgtttccattgacgttttgaggggaatgggggagacagcagttccatcattttctccgtttctgctttgctccctgtatgccgcttggatgagtgggaggcctctatggaatgcttgcatgtctttatttttatgtttcttgcagaaaatgtgggatcaagaaaaggaccatttgaaaaagttcaatgagttgatggttacgttcagggtccggccaacagttctgatgcccttgtggaacgtgctggggtttgcactgggtacgtgtctctctagaagagcttatgcaagcttggggatctaggatgattaaatccttcaggtatcatgttcacaattcttgctgtgtcctcttatgacctcattctgtttacttcatatttttccgaggttaaattgactgcctttttttgtgtgtggttaaatttatttaagatagaatcttaatgtcagtactttaaaaaaaaaggccgggcgtgatggctcacacctgtaatcccagcactttgggaggccgaggcgggcagatcatgaggtcaggagttcgagaccagcctgaacaacatggtgaaacccccgactctattaaaaatacaaaaattagccgggcatggtggtgcgtgcctgtaatcccagctacttgggaggctgaggccagagaatcgcttgaacctgggagctggaggttgcagtgagccaagattggcccactgcactccagcgtgggtgacagagcgacactctgtctcaaaaaaaaaccaaaacaaaacaaaaaaaaacaaaccagagccagggtctcactctgttgcccaggctggagtacagtggtatagtcgtagctcactgaaacctcaaactcttgggttcaagtgatcctcccacctaagcctctgagcctgagtatcttggactactggcgcatgccaccacgcacagctctattttttttgtagagatggggtctcgttatgttacctaggctggtctcaaactgctggcctcaagccatcttccctctctggcctccccgaagtgctaggattacaggcgtgaggcactgcacctggcctaatgtcagtattataaatagaaaatacagtaaaaataaacaacagagaaaaaaagctagtagaattcagttgcagccaaatactgttccctgacaacgattctcaacctgagatctgttcactcttttaaaaaacggagaagaataaatggtataaaagatcaaagatatactcaccccaaatgctgacttctcttggccacggtcaggataaaacagcattgaaaagagaatggtttttcttaactgtgtaattccaggtttaacactgggatccagtgtctcctaaaacagtggttctccctcagggtgagtttgtccccctgatgaggacatgtggcaatacctagggacatttttttttttttttttttttgagatggagtcttgttctgtcacccacgctggagtgcagtggcgtgatcttggctcactgcaacctccacctcccggcttcaagcgattttcctgcctcagcctcccaagtagctgggattacaggcgcccaccaccacactgactaatttttgtatttttagtagagacggtttcaccatgttagccaggttggtctcgaactcctgacctcaggtgatccgcctcggcctcccaaagtgctgggactataggcgtgatccattgtgcccagccctcgggacagttttgattgtcaaaacttagttggcactgctggcatctagttggtagaggtcagagatgcagttaaatatcccaccatgcatgggacagcccctgtcacaaagaatgacccggcccgatgtctggtgcagaggttaagaagccctggccacagatggtctccattaccggtcatatctgtctcttacttttctggtctgggtttaacaatcccaggggcggggaccgccttgctcgggaaggaaggtgccatggcctgcaccgtggcggtggaagagagcatagcacatcactacaacaaccagatcaggacgctgatggaggaggaccctgaaaaatacgaggaacttcttcaggtatttatccgtgctctagaacggggctgctcaaggaggaaaatggcagatagcaattgggtaagaggaaaacatgttagagattgttaggggatgatgggggtttagaggctcaggtcagtgcctcagtttaaaggtgagcaaactgaggaacagagaggtgaacccgtctgccctggccatacagcacagacagagctgggactagaacccttgtctcctttgtcttttttctttttatttagagatgaggtcttgctccgttgcccaggccggagtacagtggcacagtcatagctcactgcatcttcaaactcttgggttcaagtgatcctcctgcctcagcctcccgagtagctatgggactacatacatagccaccactcacagctaattttttttttttttttttttttaagagatggggtctcactatgttttccaggctggtcttgaatttctgagctccagtagtcctctctcctcagcttcccaaagtgctagaattataggcatgaaccaccacatccggccagaacccttgtctcttgagccctgtcctgttcacttattttatttttaatttttaaaattttttgtaggcacagtctctctctatgttgtccagattggtcttgagctcctgggctcaagtgattcttctgcctcggcctcccaaagtgctgagattacaggtgtgagccacaccacctggtgctgttcactttttttttttttttttttttttttttgagatggagtctcactctgtccccaaggctggagtgcagtggtctccgcctgcattgcagcctccgcctcccgggttccagcgattctcctgcctcggcgtcccaggtagctgggattacagacatgcaccaccacgcccagctaatttttgtatttttagtagagacggggtttcaccatgttggccaggctggtctggaactcctgacctcaggtgatcctcctgccttggcctcctaaagtgctgggattgcaggcgtgagccaccgcgcccggcccacttctttatcattggtagattctgagcagatgctgtgagcaggaaccctttagattgaataaatgaatagatatcctgagataattttccacagcaaataagggaactgtttagttttttagagtctaaatctgaggttggcaaactatggcctgtggccagccacctgtttctttaaataaacttttattggaacacaagcacgtccatttgtttgcatgtctccggctgcttttctggttacagtggcagagttgggtagttgcaacaaagtatttactctctggccctttagaggaaaagctggcctccctgtcttaggccataataagaggctttagcctccaaaatgaaatggaacagcaggagagttggaaggctaacttgctttggtgtctttttatttaaccagctgataaagaaatttcgggatgaagagcttgagcaccatgacataggcctcgaccatgatgcagaattggtagggccctactgttacctgttctgctttgggactccttatttgggaggctgaaggggcaggaggtttctgttgccagaaaaatacattttaaagtgacagcgaaagggagagaaaaccaatgacgttgctttgacaaaaagcaagcaaacgcattattgctccagattgggaatctcctttcttgctttatgccttctccttttccccagaagcttttttttttttttcccagacacagtctcactctgtctcccatgctggagtgcagtggtgcagtcttagctcactgcagcctcctccttccaggttcaagcaattctgcctcagcctcccaagtagctgggatgacaggtgcatgccaccatgcctggctaatttttgtattttttatttttagtggagaccgagttttcactgtgttggccaggctggtctcgaactcctgacctcaggtgagctgcctgccttggtctcccaggagcttcatttcctttcctgtgagaatctggatgactccaatgctttggcagtagtagcagaggcattccgaccttttgaatagctttctttgaaactaaaataaattgttccttagatctatttcttatccagagaaatccaaagcctgccctgccagccctgaatcttacaaccgaaaatgagcacataacatgtttctttgtttgcttattgtttttaacaggctccagcctatgccgtcctgaagagcattatccaggccggatgcagagtggcgatatatttatcagaaagattataaagtgtgtccagttttgcctgtctataaaagatgatagtaatttaccaagtgacatttgcagagaaacaggtgtacagttatcgttgtacttttgtacaatgtgaattttgttaataaattataaggtttgtttttttttttttaaactctgcagtgttgatttttctctgggttgttttttctgccatgagaccaacaggtcaccagccttgttcaagttacagcaaacgaagctgggccttgtttggtctcatacttaattttcttttatatacatgtttttcttttacatgcatatatatatattttattttattttatgttttttggagacagggcctcgctcttttgtccaggccgggtcacaactcactgcagcctggacctcctagcctcaagcaatccacccacctcagccttccaagtagctgggactacaggtgtgcaccaccacagctggctaattctatttttttatagaggcgaagtctcactatgtcgccaggctggtctctaactcctgggctcagtgatcctcccgtttcgacttcccaaagtgctgggattacaggtgtgagccacttcaccaggcccattttctcctaaaacttcaaggacaaatcattaataatgtaacaggaatctttaggagaaaaaacaatttggtttactgataacaaaagataattggaaacatgagagtatttgagattggccaagcagaactatgaagtccatcaagtaagtcaaagatcatcgtttctgttttgaattgtgggtgataatgggtgggagagtgctacagtctgtatgtctgtgtctccctagaattcatacgatgaaatcttcactctcaagttgatagaaggtggggcccttgggaagtgtgaggtcatgagagtggagccctcatgaatgggatcagtgccttatgaaaggccctagagagatacctcatcctctccacagtgtgagacttcaaggggaagtatgagacttctctgaggaagcagacccttcacaagcaaaatcagccagcactttgatcacggacttcccagcctctaggactgtgagcaataaatgtttgatgtttataagccacccagactgtggtattttgttatagcagcctgaacagactaagacgggggtgttgcttccatcaaaggatgtactaagttgtggattatttgtgaaattgaattacaaccttttccttaaggtcttttaccacctcccccccaaaaaaatcccccaaaactgattcagattttcatactttaatgaaatattttataatttgcaaatttttaagtaatttatgaaaaacctagatcagtggatctcctctctggctgcccattagaatgtcctgtggagattaaacttttttttttcagtttatggaccaagagttttgatttatttagggtggagttcaggatcagaatggtttcagaagctcccaggtgattccggagtgagttggagctgcaagcccctgagctagattataagatgcttctgggaaagaaccacattttaggaatttgcttcccacccagtgccctgcatttaatcagcacctgatgacttggcaggacttgccccaccagggtctggctttgaagggtagtggacaccaggatcctttggattaatcctctgccacctctctcttttcctcaaccgagagtgaatttatgtaattgagtgaaagtctacgaatcataattgtaataaattaaggctgggcatttgtttgaaattagataggataaagccaaaggtttgaacaagttgtggatggtttgtaaaaattaatcttacaaaataaatgctgtgtgtgaacacgttgattaaattc

SEQ ID NO: 37311 - DNA, 23048 bp, Homo sapiens
cctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacagtaagtccaaattctcgctggggtgtctgctctggagggtctgaactggagctgggagctctgcagaggggggcctagtgctggccacacagcagggtgccccaggattcaccagcaccaaggctcaggatgtgcgatgctcctccgttggggctggggaggtgggtggggaaggagatagagccattctgttaagagccggcgcttctgggaggccaggagccctggagctgagtggcttgctgaattcacatcacatccttgactgattttaatttggaattacattgtgctgtccagggaaacatatgtattcttgcacatgcgatcgtatcagtaactgtaagcatctgggtgccataaaggggaaggccggctctgtcaggagcccttacggttctcagtgtggagacctcatcttctccctgcttttcacaactcattgtgacacgtctccgtttcagtttttccagttcttgggaagaagaatacctgccccaaattaatgtctgtcaagctttttgaagcccaggcaggagacagcttcttgctgcctgggccctttggtctaccccacccacgtgacccacgagacccacgtgagctgtgtgtgtggaaggaagagggtatgcacgaatgttcccagggccgtgtactttagggtgacatgcagtcttgtgcagtagacagattcatgtgctcaaaatgggcgccctccaggccggtgggcacggggagagcgggttttggctgtggatgcgtagaggaggctggcgccctttgtgtctgcgtgtcacgggagagcgggtggaggggtggcagtgggtgcatggtgggggggggggatatgtctgggagcctgccgtcccaggaggctctgtctgcatggaggagccgggcggcttctgggcgagatgtctgtgtgtgttggtacacgtgtggaagtcatatgtgtttactgaaggggattttaaaaacctcaatacaagagagagaaatttggcagatgttgagaaactgacagcccaggaaagaggaatgtgagccactcgtgggccgtagactccgggagcagctctgtttgcttttcctaccagcaggtgtcctcgccgccctgactacctcagcccaggcccacctgggaggtgggcagctcctggagtggggtggagggcatgggatggagctggcaggcaggggagggtggtcagcagagcacacagcaaggggtgaaaggaacctggctggagagaaggaacaggagtgggtaccgatgggtggaccagctctggctggaggtgcaaaggccccgttcacggctccacgccaggcagaggagcctgtggttactggcgaggggttcccgctccagcttcctgtggctgcctggagcgcctttcttcaggatgtggctgccatgtggggcggaggctggaggccgatgcagagctactactccctgcccagggtctctgggtggggctggctcagagacccacagttcccagaggcacctagcagctcgatggccaaggctccaactccctgggaacccaccaacgcgggagatagtgaccacaagcatcagaggaaggtcgaaatctgaggccggcaggagaggtgtgaggagagtccagggcaagagggcaggactcagaccttcatggtctgggtcagcaggaggagtccaagggaggaagcattctgagtcaccaggacccccccatcccggaatcctgagctgagaatgaatgagccacgtggaggcaaggccatgcaggtgcaagtggacactgattttgtgcagactcaaagcacaaatagcagatgtccttgggaaaagcccgggcagggccccatagatgctgggcagcttccaggctgcagtaccaagaccttacaactgcaacagatgggtggatgtggggttatggagcaatggtctggcctggggcaacccagcacagtgagcaggatgctgttcaggatgctggggaggagccaacgtgcgatgctatgaggctcacaggtacaaaccggaagcaggcagactctgcagctgttggaggtgacttggaggctgagcagacggacctgggcccgccctgcagctggtcgggtgctgagcccaccccagagaggcagacacacaaggcacactaactataaagaaggcagtgggcaggtgctgagcaggagcagagagccatcatcaggggcttgcaaggcggcggggcggggtgggggaaggaagcctgtctttaactcatgagggcagacaggggtgacaccaggtctgtggtggggcacagcagggtctcaatgccagagcctctgctgggaggtcatgagatcacgttctgttccatatttcctcacttctggccacttccctgacccagtgaacatgcattcaaaggaaagtgacagtaggagccagggcaaggagatagaggtccctggagaggaaaatgaaagaggaaatactttttagtagtgcaggagaaagggcaccaaggtgagagcagagaggaaggccttttcctaaataaccttttctccctgttttacagataaggaaactgagacctggattgcttaagtaatttgtccaaaaagagcagggaccctaacctagacattctgtgtgcaggacgcatgtagttaagcactcatttatatgtaaaatacacgttgtaagtgttacctttaacctcctttaacctttagggttcagtagaactttgatttataacataaatgaatcatgtgttggaccaagcaggagaggtcagagttattatcttagtaacccaggtggcagattgcacaatgataactggatttgttcttccttagctctgcatttttttttttttttttttgcccgggagattcatactgccacaaatgttctccctaatttaatgaaggagttttctttatttaatgaagagtctcaagcaggttaagcaaccgcagctacgtaaaagtgacctctctgagcctcagtttccccagctgtaaagttagagatgatttccaaactccttttcagctgaaagaattttataattccatctgggatgaatcagcagagcctctattggggagtatgggcaagactctgtaatcctttttctaattctccaggattttactgtcgggagggagtagagagtttctctgaccccatgtgatgggaaaggacacagcttttttacttccgttgtcatccctcttacaaaggtatcaccaatgtaggtgtcattttatcttctggcttgtaattatctgtctctgttcggagacttgttgttttcagccaagggcagcgctaagacaaccagcaaacccagagtttctcagcaaagagaaaactctatattttagtctttgttctctagctgctaagtgtagattttgtttattctgagaattattctgaaaatcatttgctccaagggccaatgccctctgcacagtagaggtcagcacttctccaagtgtggtccagaggaagctggaggtaaatgtagattccctggtcccacccacccttatagaatcagaatcttgagggggtggagtcttggggaacctgtattttcgacaagctccttatggattcttaagcacattgaagcttaagagtcagtgaactagggcgaaacttttcttagagggatggcaaacacaagtgcctacagagacccggcaggaaatgcaaatgatctggaagaaaagccacggcgtcatgataaactgcaccaggacacttggtcttggggtcaagaagaaagtagggtgtgtgagacagggagagggaggggacctggagcccacgtgcccagccaaagcagcagccagcctcagttcttgctgggttttgcattgaggactgtgggtccagcttgattagttcttcccgtgtcccagaaaagcagaaaatctggatctttctgtgaagtgttccaatttttaacatgggcttaaaatgtttatgggcttctaactcaaaatttttaaaggtgttccatcagcgaaacaacatgtctaattcatttaacggttaatcaatagaaagctcacaccattaaagcagtggtttctcaaacttccagaacatctagaagccatggtgccctttgcaacacattataatctgtggttctcaaccctggctgcacgttagaatcatctggagatcttgaaaaaaatatgccgtggaccccactcactccagtgtagtcagaactgctggggaatgggtccaggaatcatttgtttttaaagctttccaggtgattctaatgtgcagccagggtagagaagtacagccacactgataaatatagtcccttcactagaaccagcagaaatgatatatacaagcaaaggcacacctagccacccaggtgtctgaacacattttaaaaggcagttaactaaacatggtcagctatttcctggtttttccatgcatactgtacatgaatattctttgcttatgttttgccccgttaaacaaaatagagaaaatggcattcaccaatatatattttttctgtgcaatggaaaaagttgctcaagatttaatttgtaaaggtgggaccccctagtccagctctcaataatactagtgttctgtgaggcatggcttaagaaccacaaactcgtttgcagtgggtcattgtctgaggcataggttgacactctaggcccatttagtggaatcttgccatattttgttgatgaaaccatcttcaccagatgatctcccagatccctcccagcttgaagagtctctgcttcaataaatgaggtatgttcagaagacctgggttcaaaccccacctccaccaccttctagttatgtgaccttgggaaagacatttaactttttgaggctcagttttctcatttgtcaagtgataaattttacatgttttcattcttctcaggggttgttagaaggtcacatgaagtaataaaaactcgacaaaacaaggtggtgctattacattttgcttatttatgtatacgatgattcattccacagattacttaaaacatcattattcagtgaatttgattgtcaagaagattgtatgtacattttctttgatctcccaggcaattcttttttttaattaattttaattttaatttttttgacagagtctcactctgtcacccagcctggagtgcactggtgcaatctcggctcactgtagcttctgccttctgggttcaagtgattctcatgcctcagcctcccgagtagctggggttacaggtgcccaccaccacacccagctaatttttgtatttggagtagagatggggttttgccatgttggccaggctggtctcgaactcctgacctccagtgatccacctgcctcggcctcccaaagtgctgggattacaggcatgagccactgttctcggcctttaaaatttttaattttaaataatagggataggtcctccctatgttgtccaggctgatcttgaactcctgggctcaagcaatcctcccgcctcagcctcccgagtagctgaaataacagacatgtgctaccatgcccagctaattttcgtattttttatagagatggggtttcaccatgttggccaggctggtctcaaacacctgagctcaagcaatccacccacctcagcctcccaaggtgctggctgggattacaggcgtgagccaccatgcctggctgccaattcttcttcttcttcttctttttttttttttttttgagatggagtctcactctgttgcccaggctggagtgcagtgacacaatctcagctcactgcaacctcgacctcccaggttcaagtgactctcctgcctcagcctcctgaatagctaggattacaagcatgcaccatcatgcctggctaatttttgtatttttagtagagacggggtttcaccttgttgcccaggtgccaattcttttttaatcactagcaattgtgtcctaagctttgcttgctagtgtcaagttgcttgtgtcagctaacttctgagtgactctggccaagaccctctagacagccatttcttcctctgaagagggttgcgccacatgactcctgatgtcccttctaatcatgggaaatctatatatcccagtaatagaaaaatgacctttcccacctctttcttgaaaccttaaaattctccccaggatgtgttcatcctggggagcagattatgattgataggctggaagaaaccaaagaggacggccactagggtgtcctgagaactctcttagctcataactttccccatctcctggcttcccactgccttgacccactctgactgtctcaccagcaagtgccattttccatctcccttcttttttttctgagatggagtctcactctgttgcccaggttggagtgcaatggcaccacctcagctcattgcaacctctgcctcctgggttcaagcgattctcctgcctcaacctcctcagtagctgggattacaggcacgcaccaccaggcctggctaattttcatatttttagtagagacagggtttcaccatgttggtcaggctggtctcaaactcctgatgtcgtgatctgcccacctcggcttcccgaagtgctgggattacaggcgtgagccaccgtgcccggccccatctcccttctttttacagcaaggtgcatgttgcactgacttaccctttattcctcttgtagtcactggagctgtgttatttatttactttattaatttatttatttacttgaaacagagtctccctctgttgcccaggctggagtgcagtggcacaatcctggctcactgcaatctggacctcccgagctcaagtgatcctcccagcaggtgctattgtaactgaagccatatcaataacagctccttcaaaacccagctctgttgtccttgatagggttgccaatgcaagtagcttatccacattcagagtattacaaacttgtaaacttacacattacttaactatcactgatttctctccttggttctatctgaaatggtttagggaatcgttggcagtatctgttctttcaaagccaattattaatcagggcttcattagacagcattcacacatttgttttcctaacatctgttccattaattttctaagaaccagcgtcaggcccaccagatggcaatttccagaaacactcactcatcctttcctgaagatcagtagcgcatttgcttgtttccaggcctctgatccttcctgccttgtctgtgacttcctcaacaacccctcggggtgattataagctcattccagccatgtccattatgtgtggaatctgggtctatgagcttgaatttcaacttcgggctattgttaccatttgtgcagaaagtttttctctgggtgttaatactgctcagaccttgaggctgtcaagtgtacaggagcagagaaaagacaggctctttctctttctctggctcagaggggtgggaaagagcattcgctgcccacatcttgtggacagggatgaagaggccagcaggtgacagcgtctggcatagcacgtgctgtcaaggaaagagaaaggagccaatggtgacacaccagcttggtcagaggaagcatctgtgtttctgccaggctcatgatgtgggctctttgctatataagccctgctttattgggtctaaaacacaaggttgagatgtcactgcactgctcaaacactttcagtgactccctactgttaatgggttaaaatttaaccttttagtctgacaggtggaccccaatctatcatcttgccctttctcacctggctcccacctgctgtttcgggcccctcttactcatttgcatttcctcccctccctgcctttgcttccagcagtcactccatgtaacatttctttcctccccatcctcaaatcctctcaattttcaccccttccgtgaagtgctccttgccatttccctcctttgatttcctgcagcaactcctggacttctctgaaaaccactggtttcctgtcgctcccctcacctgtgctcctgcattgtgacatcttccggggcactctgtcctattatttctctctagtcctgttatttgggcccatgtattaatacccccccttagatattaacccataagcctgaggctgcacttttttgaattttgaaatcagaccttggccttgaccttgagcagcaggatataaataactcttacatgcttagcgttccaataatggaacaccaggcataaatgggttttaatccccttgaaggcaggggttgtgtctactcatgttttgcttcccaaggttagcactatgcttggcatatagtagctgctcaatacatctttgataaatgaatgaatgcccagatgaacaaacacacgaataaatcaactagctgtaagatatgtaaactactaggtgctgatatctttctagaatcagtattttctcaaaaagtaggaaaaacgggttggaaaacttaccagaactgagatgtcaaggcagtgggaggagggggcaattagatttgactggccagtctagtgccatgttgtggagctctgaggccacactgctccttgctcaggactgtgtgtgattctagggccaccaagaatcttcctcgtatctccaccttgcggtctgaggcctcaagcctctagggaggtggcaggcgggacggtggccacttggtgcctgtccgttggcagcacactgttcctgcatgtctcgctcatgctgtgccctctgctctgctttatctcctagacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccaggtaactcctctctcagagcagaaaccacaccgacgggaaagctggttcctttgccatatcagggcaccactgggtgcagcgtttggcagacctgggtttgaatcctggcttctctgagccttcgtttccgtatctgtgtctgtcattaaaacacttaagagttagctaaggtgctcgagggccatggcattcaggaaccactggtttcctatcgctccctcacctgtgctctgcattgtgacatcttctggggcactctgtcctggtctcgggtactcactcctttctctgccctgtagatccttcggccagatgagcacattgccaaacagcgctatatcggtggcaagaatctgcccacacggggcactgccgagtggctgtcctttgatgtcactgacactgtgcgtgagtggctgttgagaagaggtaggtggacccttcagataagcatttcagaatgaacctcaggtcccttagtcctccatgaaatggagggaagaggacagaattaagggagtcagagatctgggttcaaaccctagctttgccactgagtatcctccattcattcactcaactaatgtttattaaatgctcactgtaagacaggccctggggatgcagccacagggataggaactatgagaaatagaaagagggcaatgtgacaatgagtgggtggagtccaacagggaaggtctctatgatgaagaaattcatgcattgacatctgaatgataaggatttagcccatgaagatcagaataagggatgtgctaagcaaaggcaacagggaggcccaggccctcaagtggaaataagcttgatttgttctagcagcagcagcaaacagatcggtgtggctggagcatggtgagctggggaggggaagaggaggggaggtggtcagggaggttgctggggccatataatttattattactattattattattattattattattattattattattattattatttcttgagactgagtctcgctctgttgcctaagctggagtgcagtggtgcgatctctgctcactgcacctccaccatctgggttcaagcgattctcacgtctcagtctcctgaatagctgggactacaggtgcacgctgccacacctggctaatttttttgtatttttagtaaagatggggtttcaccatgttggccaggctggtctcgaactcctgacctcaagtgatccgcccactttggcttccaaaagtgctgggattatagatgtgagccagcatgcccagccaatttaatttagaacatcatcaggtcatggcgaggtttcaggacttattccaggtgtgatgagaagtgtgggagtgctataaccagagctggggatactcaagatacccaggaattccttcctgtccctctactgggtgtgaagtcaagagcctaggagaacccacgtggatctgccaacggcagctctgttgggaattctgactcagacagctacagggaggaggggctgggtgaggtgatttgattgacatctttaaaagatccctctagtttccaggaggtcaagggaagaggcaggaaaatgagttaggagccacggcggcagcccagatgagagcaatatctaggccgagactagggcggtagcagtggatatgacgatcagatggatttgttctgtattttgaaggtagccagtagcacaggctgattaggtatgggatgtgaggacacaagagcattccagataacttctaaattttttcgacatccaggtggtatcacttattgaaatagggggcctaggagaagaacaggttctgttctgcccagttaagtttaaaaggccgggtcgtcatgcaagtagagctatcctggaggcatatcaaacttcacatgtcccaaatatcttacccacacactgccttcacctggaaaatcaggcaatggttcctcctctatgtatgcctcacagagctgttttaaggatcaaatgtatttgagagaacttcatggtttttaccatgttttacaagagtaagcttttcttattttagataaggaaacaggccgagagaagttaagtgacttgaccgaggtcgtccagtctggattagaactttggtgtctcatgacaccatcctctgtgtttctttcccttttcttggctggtactgcctggtctgatgctcagtgggttggggtcacagatggcagtcccatctgttccttctcttcctcttgggcaaggttttctcctgtcatcagctgctataaagccacagaccatccacatattgatgcccagagtccctgaggcaggtggatccttctaagtccttggtgttttaggcaactaagagttaaagctcaaaggcagagcttacaaactatttggcctgcacattgttttcgatttgactagtcatcaacagttttgggtgttttaagtcaggagatttcacataaaacctggacttcttgctgtttttgaaaaatcgaaagatttcctgataaccatccgtcagagatgagtaccggccaccccttgagatggggtatgcatcctcagtccccgcagcccccaccattccctattgttccccaagagtgaggctggcagttcctgtttagcatcatgtgctggctcgattttctcacttacgtgacctgcctgggctcggtagccatcgagtttgcattgcttgatgccacggagcccaggcaagtcacataaatgagaaaattccccatccaaggggaattatccagtggctgagttggcagatggtgggctgaagatcctgccccagtcccaagggtacccaggaatttcatcctgtccctcctactgagcatgaaggcaagagcctaggagaacccacgtggatctgccgacagcagctctgttgggaattctgactcagacggctacagaaaggaggggctggggaaattaatctcttaacttccctgtctgattttgatcagctccacctggatttctttgaagccctgggcacttgaaggagttcttattttcacagctgcagaactcaatgagaagtttgcattgagaatgatttccatcctcctgagacatcaaaaagataatttcgtaataaaacctatgggtcccccacccaccacccccacagctgccaattctgaggttagttcttcattggaaccttcagttcacacttaggcagatactgcccacctttcccacaggggaatcatcacacaggtttgtacttacagagagcccatgagtctcttcagagttcatggcttcaaaccaggcaacaaaggactccaaattggagcagttggcggtgtagattgatgagaaaactgagtcacacatgtggtcttggattcattcagcaaacatctgagagcccttgtgcaccaggtacccaggctgcattctgggtcgcagagtgggttggagtccacaagggccgctggggacccaggtctcatacccttgtgctattgctcatatagtctgcagcacctagctaggcagggccaggcctcccctagtaggctggggagggagcctctcagcatcatggctcaggaaaggtgggacactgggaaacaaccatcttgcatgttggtgaatgtgtgggcatcttccttggtggtctctgttgccccctctttacccctccttgtctctaacaagagtttgggatctggcatcaagctgtcagtgcttgaatcctggcactactatccactggttggatatcttgggcaagctgtttaatctccctaagcctcagtgttcttatctgtacaatgggggataatagttcttgctctatgggattattatagagatagaataagttagtgattgttgtcatcatctctaagtcctctatctggatacagcctgttggccaagccaggccaccctcttgtgcttacatcctggaccctcactctccccaacacagctgtctgcaccttgactttctaactcacagaatcatggaactcactcactccaggtctcttccagcctgccttgaaccagcttgaccaggaggtacactgtgttgttaggtagcccatttcagctactttggctcctccttccagctgccttaacccagggagagggcaatcctcatacctccctctccattcacttctcctccagctgggtctcagctgccttgttttattggtctgccttccctcactgagcgaacctgctggaacagagatcttcaagctcagcaggcgcagtgtgcctcagaggttgccctgacttagggtagagcagatctggttaggctctggagtttatggaagaaaggagctgggttttaaccagtaggactgggatgtccaagccaacctaatgttgatgggaatctccagtcttgtaggcttgtatccttctgtctatgagaaggttgctgggccaggttggactttttggggtttgccctgatggcacaatttcaggaagactccaggttgtctccaaggccagatgctcacacacatggtgtgtggcctcagggagcagcaaatcaatcaactcatcgagaggctgaccctgaatccagagaggtccatcccccatgacctctcctacacctggccacaactggctgctatcccaggatcaacagagcttcccaaattaagtcttacccaccagaattgacatgataccagatcctacctggttttctgtgtaaaactacttgtctcagtgcagacttttcattttctttctttttccttcacttcactcaacctcatttactgagttcctgcttccttgattttggttgccaaaacatgtgatcccacaactactaggcgaatgggctggagttgcccttcacgcaccagaatgtcaggcaccaaaccctggcacctccaggcttcatcatgctcactgtctccgtgctcaagtcatctggaccctcagccatagttctctatcatctcctctgtgctgttttctaagttcacaactgtcttcccaagctgttcatcttggtgagcaatccacattccaacttcccatcatggtgaacaaggattcccaaagaagaaatgtccaagtaatttttacctcgttgtgtccttgttccttaggaaaaatatggcccagtgtaaccgtgatcttcatcttatctcttctagaatctgccactttgtctaggcccacagtcatggccctggtagaaatgcttgcatcttccactgagacggattctgcttcctgtttgcaagtgaccttgcctctagcattggttcctgacttgaatctttttgccagcattacatcctgtggctttttgaatttgtggccttttgaatcacagtctctgtgctcggagactctttagttactccctgtccgtagtctcttccagtccctctgcctcttgccctgatccttctgcagtagattggctcaacgatcccctctcccaaaaaccatgtagatggcatgagtttttgctttccttactgtatctgtgtacttttgcctccaagtaggtaggtgacaattttctcttaataccatcctttcaaagggaatgattattccacttctgtttcatgatggccactagtgtatgcccccatttggtgattcataatacaacaggaatacctggaatgtggcaacgtgcgcttgaaggtccactctgagctctggaggcactttctgtctcctgtgaccctcaatagaactcagttcctatgagtccctataggagcagaggccctggctcacccttgcatgggtggtgggcacacttccccatcacacagaggtgcttttctcactaattctgtcttattttgcagagtccaacttaggtctagaaatcagcattcactgtccatgtcacacctttcagcccaatggagatatcctggaaaacattcacgaggtgatggaaatcaaattcaaaggtaacaaaatgaatgtgtatggtaggatgggtgagtgggggggaagttaatgggacaggatagtgcaggagacccttaccagacctcaagaaaagaaaccaagctccttcagagagatagccgactattttgtacttgagtaattctgctttgccccaaaagcaatgagtgtaactttcagtttatagcttagagaatgcattagcctctggaagacaacacgtactggtaagtggtgaaactgtgtaggcaagccatctagcctctggtcctagtgaaatgggatgagagttcctctttcacagtgttgtcaggcaattaaatgagataatgaataaggaacacagtgccagaaatgctcaacagataggacttgtcttcctcctccctaaaagaaattaagtttggctgtcctgaacatgagtgcccagacaactgagctttccagatgtgcagggcctacctgaccttgcccaggggtcctctgggtttggatgattgcttcgagcctcagggtgtttgtccccggggtgtttgggtagagatggcgaagtcgttgagagtcatttctggttttccattatgtttgcaaggaactcagccttgatgatctctggagttcagggaagttctcttttcctttcatattcccattttgggtaactgcggaacgcctgaggtcagaggcttgtctgggaaaaggtgcaggcctcttttggctcagcgctggacagtgatcttaccccacatgggctctattttacagccttttcttaaagccaaagatttgacactgtaaccacagaaccttagagcccagaggacctttggagtccttacctacaggccagcttaggatgaaaccttcccatttcagtgaatacttatcttgttcataaagattttcagaaaaagggatttgtgatccaggtctctcatttatcttacagatctggtgccccttcctgagacccgagccactcctgtagctatgtaaattaattcctcatgttcctgtcctcagtgaggatggacaacagttggcagctgtccttcgcaaaatcgatctccatttagttgagactctttctaagtcagtctccagtcttttccttttttttcagatgaaacgggttgatgaatttagattttctttccagagcttatttgctatttatcatatgcttcattatctcatctgaattttatagtgaaaacacttcaaagactctaagtgcaatgtgaatgttaacaattatacagtcttgtttctttggctcccattcaggctatcttaagttgtgacaccttaaatttttggtaggacttctgcgttatcttggtccattcacattttaagaggaaactcacaccccaagattctaagtctagaatctaaagtgacaatccagggctgggtgcagtggctcacacctgtaatcttagcactctgggaggccgaggtgggcggatcacttgaggtcaggagttcgagaccagcctggccaacatggtgaaaccctgtctctactaaaaatacaaaaatagctgggcatggtggcatgcacctgtaatcccagctacttgggaggctgaggcaggagaatctcttgaaccccggaggcagaggttgcagtgagccaagatggggccactgcactccagcctggccaacagagcgagactctgtctcaaaacaaacaaacaaacaaataaacaagccgacaacccggagatatgtgttaggtacccacttagtaacagggatgcttcataggtccatgaagattcctaggaatctcagcaagggctttctgccccttggaagatttctatacaagggtatggggatctgaacacggggcatctttcagtgggcatccttacaataataatgagttcttttgatactggcttctccatctgctcttcccctttctgcacctggacatcagaattaagctgcacttgtcccccacacctccctcgcagactgcactgcccctcctcctgggcagtgatggggcgtgtggaggaggcagcctccaagggctctgctctcttcagacaggagattgtcactttccttcccttcttcaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccggtgagactgggcccacatgggaaccaacatctactgcctgcctactgcccaatggctaggtcaggccccagagccaagccacactcaacagagggtccctgatgctattcacaaacatctccaggaagaagactgaaaatctctcacagagattttctctgtgaaatctctttctgttttcctgggagtcccactgtttttccataggctaactctggaaggagctggctgaagtaaatgaggaaaactctgtgaggaggagtgttgctaaaatagtttggattggagaggcttggtcaaagcctctccatgatttccatgttttaagcacttgtagagtgtatgtgtgagattaatgtaggagtttccattaaagaagtgctcagttagttccctatgaagggtccaaggatgctactggatggaggcaaatagaatggtctccatttgaacggaaagttggagctagagaaattaacaaatgaattcagaaattactgggtagccacaatagagagatagaaaagacccagcttctcttactcaggagcagtttcactgctcatttataaagggaggataaagtatgcatgccaactactaaaagggagaagatgatcacgcccatgagagggtccgaaggattaagtgctttaactgggagcaatgagttcacctatggacacaggaaaggcttcagaagggtgtggaatttgagcagaggcttcaaggatgaggtttggggatgaagggatccaggaggggaagcactgcaggtaaaggaaggagcatgagtgagtgagtccatctggcctcagaggatgccgaaatgaagctggggagaacgaattgggaaatatttagatctggaaaccatgtcttatgaggatggttgggcttgggaaactagggatgttcagttgggggaacagctcaacagcaaggtataggagaggcaaggtagttgccacaaaggctggcatgtagatttatttattccatcagttaggaacaaatcagttaggaacgaatcagttatcagttaggaacgaatcagttaggaacgaatgatcttggccagtgactttaatcatagtgatttcttgttcacaagaggcctgtagcagcagggttagggtgggctggctgcttaatgatgccaccgaagactcaggctttctctctttccagtctgccatgcttagtatgttggcttttcatccttttccttatggtcacaagtgattgctagggcttcaggcaccttgtccacatttaagacaagaaggaatgagggaaggggaagagccagaagctttcttcttccatctgtcacttttataaataatcgaatatctttgccagaacttgcccttaccccctgcatacttctccttgtctgatgggtcattactgggtcacatgaccaccgctactctcaagggaggacaggaaaaggagcatctggtgttttcgactctgtaatgggatgtcacaagggagaagggagttaggaatggttattgaatagataaccaatggtgtctgccatggttcacccttggaacccacaagaagccagattttggctaatagctgcctttggaagtagcaagttctaagtctcagcagatattaaagcagaggctagctgtccacttggcaagcggtattattgccaaatgatctctgtaggcaacagaattgaaggggcctgataatcacatttgggtgatctgttgaaccacggttctaatagaaggatatgccttatttggctaaatggcctttggattgagtctcagcagtcacctactatagtagtcaagctgcataaacttagaattgatttctgtctgggtgcacattaggagggtaaaaataaaaccaacctcaacaaagctgagttggctaataacattcagtgcttggttttatgtggagcgcttcatagcactgctttgtattgtgatagaaaagggtgcagggccacctttgcctctttactcttcctcatgcagcatttatctctgtttcttacatccttgggatcctggtctttaacacatgaatgtgcctttctggtttcttctgccccatgcccttgaacctgggattccattgatcagagccacctatgatggcatgaaaggactccaagggagaatatgagagcattcatgaagtttcttttattggtggttttaagttgattttctataaatgttttttgttgtagcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtatggagcaggctcatgccatctgaggcactggggctgaccgaccagaccacttgttaaaaagaatgagtgaaggattgaatgttgagtgagcaaatgatggtctggggtgagtaaaattcctctggtgaaggttctgatcttggcaccctgactcagttctactcagtcacattctgcccttttaaattcctaccatagtttcaaccagctttttaatttgctttgtccaaagctctctgtaccgtagaaattaattaactgccacgtgttaccctatgtcagagatatgtgcatgtggctggcaaggaacactgaagtagaaaggcttctatcagaactctgatcattccagcctctcgaatgtagaaaacttactctgaaagacaacaacaaggatggacaagaagctaatttgaaatgctaggaacagaaagtgagatagccgagagtccacaacccctgaaactagtctgtctttcccttgaggggaatcaaaaatagggcagtaatttgtgaagcatgtttccttctagctcattgtttctgcatcctgtctggggccctgcacgctgcacttactaaatggctcaaggcaatgttttgtgagaacatttctcaccgaagtgatcagttccagctaggaagagcaatgtaagtgttttcttaaaagccaagataggccgggcacggtggctcacgcctgtaatcccagcactctgggaggccaaggcgggtggatcacaaggtcaggagttcgagaccagcctggccaacatggtgaaaccctgtctctaccaaaaatgtaaaaaattagccgggtgtggtggcacgcgcttgtaatcccagctacttgggaggctgaggcaggagaatcgcttgaacccaggaggcggaagttgcagtgagccaagattgcaccactgcacttcagcctgggtgaaagagtgagactctgactcaaaaaaaaaaaaaaaaaaaaaaaaaaaaagccaagataattcgttatcagtgtagtaactgtcatatgcttcaactcatcaccccaaacaagtgcagttgttctgcttctgtcattgtggatgaacagcaactacacaactactcactcacccaaaccaggttccaacagtttttttttttttcttttttttgagacagactcactctgtggctcaggctggagtgcggtggcactatttctgcttactgcaacctctgcttcctggattcaggtgatcctcccacctcagcctcccaagtagctgggattacaggcgcctgccaccacagccagctaatttttttgtatttttagtagagatggggtttcaccatgctggccaggctggtctcaaactcctgacctgaagtgatctgcctgcctctgcctcccaagtcctgggactacagctgtgagccactgcacccggcccccaacagttcctcttaaagagcacccgtggccattctagcacttgctcagcttctgggactgcccctggaactgggcgacttcctgggttccaggcctgagacttggccttccaacctctcactgacatgtcccttcccaggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtg

SEQ ID NO: 37312 - DNA, 76838 bp, Homo sapiens
cggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaatctagttctgggttcactgccttctcacttgtcccctcgcccctagtaactttctgttcctcaccatccgcagtggcacctccgatgctttcagccaggagaacctagggtttgtgtgctgtggggaccaggttgctcctagggtggacaaatagaaggagatggttttatcgccaccttggaatgtgtgtgtgttttcagacagactctcgctctgtcacccaggctggagtatgtaccatggtgcgatcatagctcattacagcctccaactccttcttcagtgtccagagtagcaggggctaatttttttttaattttttaattttttttttgagacagtctctgttgcctgggttggagtgcagtggcgcaatattggctcactacaacctctgcctcctgggttcaagtgattttcctgcctcagcctcctgagtagctggaattacaggcacctgccaccatgcccagctaattttttgtatttctagtagagacggcgtttcatcatattggcccggctggtctcaaactcctgacctcatgatttgcccaccttggcccccaaagtgctgggattacaggcatgagccaccgcgcccagcagcaggagctaatttttaagaattttttgtagcaacaagttgttgctatgttacccagctggtcctgagtcactggggttacaggtgtgtgtcaccatgccaggcttgcttcctcctccgttaagtggccatttttccacctcaaaaattggtttgggacacaaggaagaattggaaatgcttaagatgagaacaaaagttgagaccacccaacacagctgggaccttactgcccagtgctcccagtggtctgaccaaaaccccacaccagacagtacaaaggcccactcccgagctgccgcttacggcccagcgggaacagactgtattcttatctttcggcatttctctgcaaataaaaaggtgccactgcggtccggcctttgtgcacttgcccttgtgctgagcaaggcgggtggcctgttcttaccgctgggttctgctgcccccacccccatttcggtgactaaacctgcagctctgatcctgttcccaaaggggcaggaggccgggctcaccccaggcagcccctggcctccctgacggccccctcgggaggggttccgtgctttgatcgcctttccagcgccgatactgcagtagctgggcccggccgagagctcgcggtcacgaacaccggcagcctcttgcctacagtgtcccgcgctgtagaagagcctgccctggcgctgagctggtcgtggctgcttcagcagtgggcctgcgcctccttgtaggccagccctggcccagatccaggtgcctgccccggaagcgcgcggctgcccggggtgaagccggagggcggcgagcggctgtttcggccggtaggtggaggcgttgaccagcctctgggaacggggcgggacctagttgggggggctccgccccctccccaggaggcgagctcagcccgcgacctttatcccgcgcgttgcggtcaagatggcgctggtggcttctgtgcgagtcccggcgcgcgttctgctccgcgcgggtgcgaaacccggggtgggcagggatcgggccggggccggggccaggaccgggaactaacgggctcccccacgctgccttcgcaggggcccggctcccgggcgcggccctcgggcggacggagcgggcggccggcggcggagacggcgcgcggcgcttcgggagccagcgggtgctggtggagccggacgcgggcgcaggtgagcgggcggcgccgagggagggcgggcgtggggtcaggacccgcgggggtccgcgctcgcggggtgctgtcggagaaccacgtctgtcgacgctcggtttgtgtttagaacccaagtttcgaaacagaaccttgccgctctacctgggttcgttcgtcatgagataaaagtttctgtttttaaagttggcggaggccgggcgcggtggctcacgcctgtaatcctagcactttaagaggcagaggcgggcggatcacctgaggtcaggagttcgagatcagcctggccaacatgatgaaaccctatctgtactgaaaaatacaaaagaaaaaaattagctgggcgtggtggtgcgtgcctatgcctgggaggctgaggcagaagaatcgctggaatctgggaggtggaggctgcagtgagccgagattgtgccactgcactccagcttgggccacagagcaagattccgtctcaaaataaataaataaataaaaataaagttggcggggatatgagctgttatctaagttattcaattggaagtggaaaagaattggaatcttttggaataaaattacgtttgttaacactcccatgtggcacagaacctcgtacctacccgcccgtcagaacccttggtaaaacccactggaaaggatagaaaaagtacttttggaagagaagcctgtgcgctccctccagacaggaggccgagctgagggcaccgagagggcacgcctaggcgccagcagttctgcttccaggacatgctgacctggacctcccggtgcagcagtccctgctgtggctcctgagaggaggccctccccctccgcaagtaagtcacagcccctgccctccccaaccccccagactcagggctgtgcccaactttgcacagcttcaggactccaggctcctggtgcctctgaacttggttccgtcctctctgtctgggctgagggagctgcctgggctctctctacaaacttgagagggacaaactaagaccaacttcaaactgactttttttttttttttttttttttttggagatgtagtcttgctctccagtcgccagactggagtgcagtggcgcaatctccgatcactgcaacctgtgcctcctgggttcaagcgattctccctcctcagcctcccaaatagctgggattacagggacccaccactatgcccactaatttttgtaaaaactgagtttctgaagggatcatttctgtagcatatttgaatatatctcaacaaaatgcaaaaaaaaaaattattatttttttttttttgagacagaggctccctctgtcacccaggctggcgtgcaatggcgcggttccggctcactgcaatctcagtcaggcctgactttctgactccaaactctactttgtctttttttttttttttttttttttttttttgagacggagtcttgctctgtcgccaggctggagtgcagtggcacgatctccgctcactgcaagctccgcctcccgggttcacaccattcttctacctcagccgcccaagtagctgggactacaggcgcccgccaccacgcccggctaattttttttttttggtatttttagtggagacggggtttcaccatgttagccaggatggtcttgatctcctgacctcgtgatccacccgcctcggcctcccaaagtgctgggattacaggcgtgagccaccgcgcccggcttacgttgtctttttatatggtaaagtggggaggcactcgagtaaaaaaattgtcattgtacgaacacttttccttttttaccggaggtaatgtgtgtgtgtgtgtacataaaaatctttaaaatatgcctcacatttaccattctagccattttgcaatgtacaaccccgtggccgtaagtatattcacaatgtgtagtccacactacccattccaataccttaagataacatgtttttgagtccgggcccggtggctcccacctgtaatcccagcactttgggaggccagggtgcgcggatcacgaggtcaggagattgagaccattctggctaacacggtgaaaccccatctctactaaaaaatacaaaaaaaaattagccgggcgtggtggcgggcacctgtagtcccagctacttgggaggctgaggcaggagaatggtgtgaaccccggaggtggagcttgcagtaagccgagatcgcgccactgcactccagcctgggcaacagagcaagaatctgtctcaaaaataaattaattaattaaataaaataaataaataaataaataggaatgacaaccacatggatgaaccttgaacacatgatactaagtggacaaagccgacaacaaagcccggcggtatcccagtgatatggaatatggctggagcaggaaaaccgcagacacagaacgcagactggcggcttccaggggctaggggtgggatgaggagcaactgctcatggggacagggattccttttgggacaatgaaaaggttctggaactaggcagcggcgatagttgcacaacacagtcagtatactgaattgtgtaagtgcctgacttgtttacttaaaaatggctaatttaggctgggcacagtggctcatacctataatcacatcactttgggaggccgaggcaggaggatcacctgaggtcagaagttcatgaccagcctggccaacctggtgaaaccccgtctctactaaaaatgcaaaaattagccaggcatggtggtgtgtcctgtaatcccagcttctcaggaggctgaggcagaagaatggcttgaacccaggaggcagaggttgcagtgagccgagatagcgctgctgcactccagcctgggcaacagagcgaggctcttgtctcaaaaaaaaaataaagatagaaaatggttaatttggccgggcatggtggctcacacctgtaatcccagcactttgggaggccgaggcgaggtgttcacgaagtcaagagatcgagaccatcctggccaaccaacatggtgaaaccccatctctactaaaaatacaaaaattagctgggcatagtggcgcatacctgtagtcccagctactcaggaggctgaggcaggagaatcgcttgaacccgggaggtggacgttgtagtgagctgagatcgcgccactgcactccagcctgggcgacgagcgagactctgtctcagaaaaaaatgatagagagagaaagagagaatggttgatttaaaaagcatgcagtttatatagaataaataaaattgttaatttatgttatatcgatcttacttcaatgtaaaaaaccaagggctcactcctgtaatctagcactttgggagcctgaggcagaaggaccacttaagctcaggagttcaagaccagcctgggcaacaaaataagacctcgtctgtactaaaaaataaaaaagattaactgggtgtggtggcgcttgcctataatcccagctactcagcaggctgagttgggaggatcgctggagcccaggaggtcaaagctgcagtaaccagagatcacacccctgcactcctaggtgatagagtgagaccctgtctcaaaaataataataataaaaaaataacccccaggccgggcgctgtggcttacgcctgtaatcctggcactttgggaggccgaggcgagcggatcacctgaggttgggagttcaagaccagcctgaccagcatggagaaaaccccgtccctactaaaaatacaaaattagctggatgtagcggcacgcacctgtaatcctagctactcgggaggctgaggcagtcgaatcgcttgaacccaagaggcagaggttgcggtgagccaagatcgctccattgcacttgaacctgggcaacaagagcaaaactccgtctcaaaaaagtaaataaaaataggaccaggcgcgggggctcacgcctgtaatcccagcactttgggaggccgacgtgggcagatcgcgaggtcaagagatcgagcccatcctggctaacacggtgaaaccctgtctctacttaaaagaaaaaaattatccgggcgtggtggtgggcacctgtagtcccagctactcaggaggctgaggcaggagaatggtgtgaacccggaaggcagagcttgcagtgagctgagatcgcgccactgcactccagcctgggtgacagagcgagactctgtctctaaataaataaattaataaataaaacccccaaaatgcacagctatcatggcttagttgagggtgcaggctggtcaggctgcttttccagtgccaggtgtgagctttctcttctcattctttaaattaggggtcgctgtgatgaaattcaagaaccccccagtgaacagcctgagcctggagtttctgacggagctggtcatcagcctggagaagctggagaatgacaagagcttccgcggtgtcattctgacctcggtaggtgctagttcagctccctaccccagcccgagttcttggcctgagttctctgatgtgagcccaggcctgttgcacatggaagaggcagagcctgccaacgtgtggcacaggccagccggcagccccaccaccctggactccaggcgccttcacgggaggcttccaggagcaccgtctgggtgtgccccagcagggacccaaactgccatgggcctcaagcagatcattcccaaaggtgaaggtggaccagtctcagagacagccttcccaggagacagctttcccaagagacgcccttcccgggagacagccttcccaagaggcagccctcctgggagaccgccttcctgggagacagccttccctgcccgggccgtcgtccaggcggacactggggagagctgtgggcagcgagtgagggagagccatgcatctatggggtcaccttggaccctaagcacacctggtggtgggttcctggagtgctccccactaggatcacttgggtgccctgagccagtcctgcgaacaatacccatgctctctgatcctctgtgggccagtcttcagggcgagttctcaagggtgaacctctttggtctgagttcttgtgcaggggactctaaatgttgcctgagtgctggcgaacgctaggcgtgtcatctgtgggaacggtgtcattaccaacatcgccgaggggcagtaagcagtgtcaggcccaggaggatgggacccttgaggagaagcgggcattggctgaggtgaggggagtgaggggtcctcggaggctggcgtggctttacagggcctggcctagaactcctgacctcaagtgatctgcccacctcggcctcccaaagtgctggccacgtccagccttatatatttattgagacagaatctccctctcttgcccaggctggagtacagtgacgtgatcttggcttactacaacctccgcctcctgggttcaagcgattcttgaatcttgaaaatttttaaaatttttgggagagacagtgcctttattgcccacgttggtcttgaactcctgggctcaagcactcctcccacctcggctccccagtgtgctaggattacaggtgcgagccattgcacctggttaatttttttgcttaatttttacttttttgtacaggcggggtcttgctatgttgcccaggctggtcttgaactcctggcctcaagcagttctccaatcttggcctcccaaagctctgggattacaggcatgagccaccacgccaggcctgggttttgagtaacggaagtagaacgcgttttgtagaaacaaaggaccggcctacccattctgtgcggcaccagctcacacctgtttgggaacagcggagctgcgttgcccacccgcaccgttcctggctttttcacatcgcctgaggatgtggaggccatcccatctgtcccagccgcctcctcctcgcacacattaggtggctgtcgccctccttcctgcagacagggcggggtaaacatccacccagctctgcttgtgtgagtcagggtgagctgggttcagctgcaggaacaagttcacccacagccttggggggtctggccctcgggaggaaaacgtgccgtgttgtgcagaggggaaggtacccttgtcatttgctcagggggctgtgaccatgcagggtccccagggtgggttctccactcctccccgagcccgcctccctggccggcagccctgactgggagtctgaggctcctgtgctggcgcccgctactccagccgtgggagggtcccttccacctgtgctcacccctcgcccttccttggtagctgctgagaaacccacacattccagatcattctcccaccctagcacttcctggtccacacgggggtccctggcttgcttggccctttgcgggtaaatgattcagaacgtgcagctcctctggattctcaggagtcttcaccacacctctgggttcttctgcccgagccaggcgtgcagagccagagggccggcgcacttatgtccctgagaggtgcctggcgctgcctgtcctctcctatccagtttgaagcgggaaagggaagaatgttctgggaagtacagggaagccaggtccaggagaagccttggccgagtccctggagcgcctagtcctggctctgtggggcagcacccacaccctgagcgtgacctggccctgctgtgcgtcgtgcacctgggctccccagccctcctgctgtgatgccagctgggaggtggactctgatgggcatgtggccccggctccccctgcaggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacgtgagtgtccccactcccaggtggcctcgctggctgttctgggccagcgccagggggtgggacagacactgtcctgcccttggaatctctcacaggggaaggggacggttggagaggccctgagatgtgcacaggtgagcgccatcgcagaccacggggcgtgttgagaaaggtgggcctcgggtgagggccctggcctgggtcaatcagacaagacccagaaaagagccagtgggtagggaccagggcctggggttgatgccagcctgggtggaggctgtgtgggtgagtgggtgatcggacccacattttggaaacatcactccatcccttctgggggaaggccagggaagccgagaacaacacgggggcttaacctcaggaaccagggtgtcctgcggggtggctgtgacaagccgggtgtgggccggagcctggtggaggggagggctggtgtgagaggaagcctcaagggtgcacggccatgcagacaggatgggtcctgcgcggggcagtgggtacctgcagtgaccacagggtgagtgtggggttcccaggacatcctggttgcgctagctgctggggtggtatcggggcccccttggggcatgacagttatgactaaatgcttgtgtggcattttagcattgagtaaaagcactgagaggacaagcgacttgctcccctaactgaatggtttttaaaagtgatttatctgttgccgaagaactaatgaccctcggctgaggacgagcctcagaccctccttgccgagcgctaaggggccagttccttcctcatccatttcccagtgcacacccagcccagcccagaccattgtgggtgttgaaccctgcgggggtcggggtgcgccaagggcacaggccctccttccttggacctggccctctggaatgtggttgggaccagcagcacctaagagccctgtccggcctctccctgcagggagcctgccccgctggaggctgcctggtggccctgacctgtgactaccgcatcctggcggacaaccccaggtactgcataggactcaatgagacccagctgggcatcatcgcccctttctggtaaggccctgggctgcagccacgctccatgcttgttgtggagggaacagacccgcctggggccatgtggtgagtgggtgtctgcatttccaggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccaggtgaggcacggggcatggcgggcgcccgatgatgctggggagaccagaaggttctccacccaaaggttttctgtggacatcgtgacttcgggagactgttgataatcacagccatgtgggtgtcaggaggctgctgtaacaacgcagcacagaccgggtggcccagaccgcagaagctcatctcacggtgctggagaccagaggtgcaaaatcaaagtgtgggcaggactgcacttcctccctgcgttccagggaggctccttcctgccccgcccacttctgctggctccaggcctccctgggcttgtgggcgcctcgctctaatctctgcctccatccttacgcagctttctcccctgtgtttctgtgggtctcaggtctctctctcccttctcaggacacctgccatgtgatttaggacctaccttaaatccaagatgatcccaacttaattacatctgcagagactctttccaaataaggtcacacttccaagttccagagcagtggttagggcttggacctatcttttggggcacacttttcaacctactacaaagacaattgtccacttcatagaaaaagagctggtcatatcagcgatggtatagaccagggcccagcaaattctgtctctaaagggccaggtggcttgtgggctctgtaggtaagacctttgtagcagaaagcagccacagaggagacgtaaactgacaggtatagctgtgttccggcaaagctttatggacagtgggccaggtgcggtggctcacgcctgtaatctcagcactttgggaggctgaggcaggcagatcacttgagatcaggagttcaagaccagcctggccaacatggtgaaaccccatctctactaaaaatacagaaatgggccaggcgcggtggctcacacctgtaatcccaacattttaagaggccgaggcgggcggatcacaaggtcaggagatcaagaccatcctggctaacacggtgaaaccctgtctctactaaaaatacaaaaattagccaggtgtggcggcgggcgcctgtagtcccagctactcgagaggctgaggcaggaggatggcgtgaacccgggaggcggagcttgcagtgagctgagatcgcaccactgtactctagcctgagcaacagagagcaggactctgtctcaaaaaaaaaaaaaaaaaatgagccgggcgtgatggcacgtgcctgtaattccagctactgggaggttgaggcaggagaatcgcttgaacttgggaggcagaggttgcagtgagccaagatcatgccattgtaccccagcctgggtgacagagtgagactctgtctcaaaaacaacaaaaaaaattttatggacactgaaatttgagtttcacataattttcacatgtcacaaaatactaaccttcttttgattttcaactattcaaaaatgtaaaaaccagcccggcacagtggctgaagcctgtaatcccagcactttgagaggccaaggtgggcggatcacctgaggtcaggagttttagaccagcctggccaacatggcaaaaccccgtctctactaaaaatacaaaaattagccgggtgtgggggcaggtacctgtaatcccagctacttgggaaggctgaggccggagaatcacttgaacctgggaggcggaggttgcagtgagccaagatcatgctactgcgctccagccaggacgacagagtgagactcctctcaaaaaaagtaaaaactattcatagcttcagggccttgagaagccagatttgccaaccctgatacaaatgactgaaggctgtgctgccatttcctgtgctgtaagacagtatttaatatagtgccatggaaatttttttatttttattttatttattttttttgagatggagtctccctcttgctcaggctggagtgcagtggtgcgatctcagctcactgcaacctccacctcctgggttcgtgccattctcctgcctcagcctcctgcgtcgtggaaatattcttcataatatagttgagtgaaaatgacacgttaagtcgctgggcgcggtggctcacacctgcaatcccggcactttgggaggccaaggagggtggatcacctgaggtcaggagttcgagatcagcctgaccaacatggtgaaaccccttctctactaaaaatacaaaaattagccgggcatggtaatgctcctgtaatcccagctactcaggaggctgaggcaggagaagtgcttgaacttgggaggcggaggttgcagtgagccaaggtcacgccactgtagtccagcctgggtggcagagacagactccatctcaaaaataaataaataaataatacaaaattagccaggatgtgtgtgcacgcctgtagtcccagctactcaggaggctgaggtgagaggatcacctgagcccagggattcaaggctgcagtgagtcgtgatcactagtgcactccagtatgggcgacagagaatatcctgtctctttaaaaacaaaacaaaacaaaaaaaaattagggccgggcgtgctggctcatgcctggaatcccagcacttggggaggccgagatgggtggatcacctgaggtcaggagttcgggaccagcctggccaacatgaggaaatcccatctctactaaaaatacaaaattagccgggtgtggtggcacacggttgtaatcccagctactcaagaggctgaggcaggagaatcacttgaactcgggaggcggaggttgcagtgagccaagatcccaccattgcactccagcctgggcgacagagcaagactccgtctcaaaaaataaaaataaaaaataagttgggaatcaccccactgcccctgaaagtgggatttcagtggcacgtcccattctctttagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacatgggtgcctgtgcccgtcaggcaaggggagttggagggcagccttttgacttgggattgtgactggcaggggatgccattctggacctggtgaggttgccacggagtgtctctgttcccaaggcagaatcgtaagtcaagtccctggtcatccattctggcctttggactgcctgctcttaggtgtaaggccaggtggtcttggcccccatgacccacacagaactccccagggaaaagccctttggtcactgcccttactcatcaggatgaagagcgcacagtgaatcagagcaactgggggatcctgagccagcgggagtgggactctggaggcagctgtgctgccagggatccaaatgtcccttaagaaggattttgcaagaaccaaactcatccaaacccttgaaacaaaggtttttcctcccatgcgattcagaccaagttaccacatcttgctaagatgtgatgtttcaaaaaccagaaacctcatcgggccccagtcagtgacccagtggacccgtgggcctgccttttccctatcctaatgtgtccttgcccaggcacagggcagcagccttgaagggctgagccacggcgagctgggcggttctttgcacgggaccttagtcccaagccacctgcctgggcagggaggagtccagcccgcccactgctctcaggctctccaaaagctccagggctgctgactagctggggctggcctccccttgcagtgctgggtaagaccgggctcttgagacagacaagtgcctgggggcccctgcagggccctggaatgggggctgcggggtgggcctggggagagctgttctgagagccccgagggcccaggaggctggtgtgttggcgccatccctgtcccagctgtgctcacagtacaggctcctgggagtgtttgtagtttccacagaggatgagcaaggagcatccctgagctgccttctggggccagcaggctccgggggcagccacgtcccaccaggacatggggtgggcagcccaggccatggctgcccctaaggagctgaggctgggtcctaaggaaggacagaggcctgggagccaagctgtggggcccgaccgggagcagctcatttattgagcagacatctgccgggcagtgccccctgcacccctcatggggctcacaacaccccatgaggtcgctggatgcagcccgtcccacagatggggaacggaggtacagagcagcacatcacgtgtccatggcccctggtccacgcccagccgactctgccttggggcctcactgaagggtggctgccaccctgaaggggccactgttgggccattcctcagagccagggtctgcaggtggcatgccccagccaggcctcgagtcatcggtggaacttgagggtcacctccactggaaagtggtcgctgatggcaagagcctgtggggacagagtgagcctcaggggaaaagtgcaccccacccacagggatgggaggggccggtgaggcctgggtgcccacccctgctgctgcctgcggtggggcaggggcaggggccggggcagagggtgtcaccactggccctttgagggaaaggcaaggtaccctgcctgcccagagctccacatggggtgggccgggctctccagggtccttggaaacgagccctggtgcagggaggaagctgaggtggccctgccttgggcgctggaccctccctgctgcctgcgtgcgcccgggcggtggggacccaagaccagcaccgccccacggcccactcgcctgagtctggtccaggccgaattcctcctggaagtcgtgcacggtggccgactggggcttcaggctccggcgcaggcgggcgccacaggccacaatgcggtcgtaggcgcagtctgagttgcccaccgtggtgtcggcgctgtcagggatgagccacttgaagacctcactgctcctcagacggatggcggcccagtcctgcgcccgcacatagctgcagtcggcgttgaagtcgcccaggaacagcatgtcctgcgggcgccgcggagccgtgtctgagccgccgcaggagccgtcgaggtcccgccctcatgaaccagacccccggggcgcgcctgcagggaccccgggaccgaggggtgggcttacgtcggtgccccacttgtcgatcacgtccaggtacacgtcgtagagcgcgtcgatctccgccacggcttgatgcggcgccgcgtgcagcgggatcagcaccaggttctgtgctgctgcgggaaggggtgggggcgtcagagctcggcgggaggggaggggcggggcccgctcaccggtgccgggggccgagaacttgaccacgaagggctcgcggctgaagacgtcctcggggtctgggtacaggtaggtgtccacgaccgacaccgcgtctttcctaggagatggggaggacccgctgagcccccgacctgcggccccgcgcgcccctccctgcggcccgcccctcacctgtacacgaacaggtacatctccttgtactggtcccggcccaggggctggctgctcacaaagctgtactcgtgctcggacacgctgcggagacaggggcccgctcagggtcggggcgccgcgccggggcgagatcccggcggggggtcgcgacgaggggccctgcccaccacacctgttgatctgctccatgagcgcggacacggcgctgaggtctgggtctcgcacctcctgcaccagcgcgaggtcatagccagccaggatctggggaggagcggcgggtgcgggggtcagcgcggtcagcacccctaaacgccgccccgccccggcccgggccccaccttcgcgatgatgctgccgcaagcggggtccgacactttgctgtcaccgaagctctgaatgttgaaggctccgatgcgaagcgcggcggtcccggcggcttccagcgcccagagtgcggccagcagagcccggggcccgcccatggcgcggagcgagaggctgggagggacagacgctgccgcctacgcagacccgctgtcagacccaccgacccaccccttccctccgcggccgccccttgacggccagtgcgacgcggaatccgcccctgcgttctgcaggctcccagggcactgctgggctctcagggaccgctgccttctcactgcgcgggaagctgcagccggaatggagggtccggcccatccagccccagctcagggcagccgagagactcaccttggatgtgggtgcagaggcccgaggctcagagatcctagggggatggggatcccgggtccaggctgcgggcgtgtccgacacaggactgcactgactccctctggcagtagctctggcaccaaggcaggggccggtatttgaggtcctgggccagggaggggccgggctgcactgggtcccgccccctcgactcagctgggtgcctgatgaactcctggctttcattcccatggagacccccagggtaaggggtgggagacctgcctgagccggttctggtgccccagacctgtcccaaaaccgtcccagaagcccctgccagccccctaggagggaggtagacggtcagccacatcccggtgcggctgtgttcttgtcctcgcccctagaaattaggtcgcctagactctgcctccctgagcagaatcccttcagggaaagcaaggcagcgcaggtaggaccagccacactccctacccagcatctcctgctgctgctccacctgctcaccctgcggtggaggccgaggctcccagatctccctgtccccgtccctggtcctcccacccacccacaggcctcaggcagcgcagctgggggcacagctccagctgggcagggcaggaggctgttggtcaacatgccaatgacacccacacagcaccaaggcgccgccagggctggcagaagcccctgggtggggcggccaggcacgtgagtctaggagtggcctgggaggcaggtgctgctgcgggggcctgggcaaaggtggtggcaccagccgcggaggctgccactgccacaacatcacaagctgcaggttctcatgttttattgtaaagcaacaagaaactcttatgtacactgtccgtcttggggcgcctccatcctgtgccatcttctctaccaggccaggcaggcatgggtggggcgctcagagtcctctgccctgtccctgcccggccaggaccccgcagacctcatgctagacgatgaccgtctgcacctccagctggccctccggcgaggcgatgaccagctcgcctgcatgctccaggatctcgatgtcctctgatgacaccatggtcacagtggcctgttcagtgccacttgtccctgcccgggcggcaagcacagtgccctcgctgatggccgaggccagcgtcatggccacctgctctgtcaggctctcgggggtggcgatggtgatggtgtcggcggcagccgcctctgggcccagcgccgtctcctcgtccatggtgacgttctgcacgatgatctggtggccggcgctagcctggtgcacgatctgctgcaccaccttcatgatgtggctgtccacctgcagggccacggctcagcaagagcggctgtgccagggagcctccccgcccccgcctgccctacccctcacctctgtctgggtgccctcgatgatctccgtggcctcactggtctccgcatcgtccgcagtggcctgggcagatgggcagaaggacagaggtcagccttggctgcccctgggtcccagcacggccccagggccccacacccacctcgatgatatactcctgggtgtcagctaccacggacgagaactccaccaacactgtgtgcgggtcttccgtgaggacggtggtggctgccgcggggctgtcctcagacaccagcaactcctccacctccagcaggcagccccctgtgggtggggactcggtcagggctaggcaagccccggccccctcccctccccctcccacctccaccggcccagacctttggtgcgcaggtgccggttcagcgtgccgtgctcggcgaagccacggccgcacttgtagcacttgaacggcttctcgcctgtgtggtgtcgcacgtgccgcaccagtgagcccttctctcggaagccacggctgcagaactggcacacgtgcggcttctcctccaggtgtgtcctgaagtgcacctgctgtgcgttctgtggagacacctgtcagtgccagcctggccttggccacaacagactacagctctcccctcccgcctgtggcccaagggaggggctgggtcaagactgagcatggtggaggcagggaagggggtgcacctgggccacggccagggagcaggatggggggatcaggcgccagggtcctgcggccagagacccaccttagtcttgtagcgcttgccacacttgggacaagggtagggccgctcgtctgagtggacgcgccggtggccacgcacatgggcaatggtcttgtagagcttcccgcagtcgccacagcggaagcggcgctcacgcacgtgcacctcctggtgcttcttgagcaggtaggccttggggaaggccttgccacactgcgcgcaggcgaacggcctcggccctgcagccacacacagcatcaggccaagcccatcacccgcgggcccgccaggccgcctgccacctgcccacagatcccctggctccctgctgtctatggacccaccctggacacccagaagcaccccggccacctatagcccatccactgccatgggccacacacccacccatcacctaccggtgtggcccctcttgtgggcctccagggtggctgctgtcgggaaggtctcactgcactgaggacatgggtgggtcctgggcaccgctgaggcctcgctggccacctgctggggaaccacaggaaggtctccagcacccggggcaggctgtgccctggcagtaccaagaacacaaccatgggccccaccctggcaggctcccttgtggccccagggaaggcagtaaacagatcaatggacaaagtcactgcagaaagccacttcagggaggcgaaggccagcgtggggacagcccctgggatccagccctgggaggagcccgcaggtggtgctggcacctactgtctccagcggctgcacttccagtaccggcagctgcggggctgccactgccaggggctggggactggacccggcagcaggagctggctccagggcaccctcctccccagcagcgcgctcaaggacgatgccggagttctgcatggcctggtgcagcaggttctcacggctgccctcgctggagcaggggagctcctgggagacggggggctgcaggggaggcagagagaggaggctggccaggcagcctggcatccagcacccaccccatggggcagacgcacgccaggagccttgtgcaaaccctcagacccccatggcgctcccactggccctgctctccctgtgggaagcccagccctcgcctgcctggctcagacccctggagccagtgcccagaacaaagactggcaccgagcaggcagaagacagagcagccctccggggccccccgtcgcccccacctctggggccagggctttcatgcccagggacagctcctgcatctggacgtggacttcgtggatgacggtgcccttggcatctgtcaccaggtgaatcacgggtgaagtctctataggctcgcctgtcaccgatgatgtggctgtccccaagccggcagctccagctccagaaccttcaaggtggagtgagggagtgaagatccctcacacaccccagtggcggctgcgtccacagccagcccccaggaccaggcagctgcccgcaccatgctgacctgcacgtgcgtcctctttgctgacaaccacgtccttgctcacactgaagcggattttctctgtgcagggggtgagagacttgaggtgccgggtcagtgcacccgactcccggaagctctttccacacttggagcacttgtaggggcgctcatctgcagagagaacctagtcagccccgggcagccccagcaggctggcgacaaggtgacaaggcgaaggcaggcaggggcccccgcctcatcccccaaagctggggaatgcgaggctggggcaccccagggccaaccatcggggtgctaccgggctccagcccgaggtgcggccagctcacccgtgtgccgccggtggtgccggatgagtgagcccttggtgcggaaggaggccccacagagcttgcactcgtggtccttgcggctgctgtgagtgaccatgtgggccttgaggatgctgccctgtgggggagggcgtggcagctcagggccctcctgggggaacaggagggggcctgccacccacacactggctccccgcacgccggctcaccgtcttgaaggtcttgtggcacagcgcacacacatagcggccatccttgttcaccagtagcttcacctgggcctgctcaccctcccctgcgagccccagcccctgctggcgggggctgcccggggcctcggccatctcaccgtctcccagctccgcctcagcagccacgatgacctctttgatgtgcccaccacctaggagaagcatctgggcctaagccccaggacctgcccctgtccagagaccccagagactgctggctccaggggaggggacctgctgctctgagccacaccctggacccaacctgcactgagccctcaacacacaggtccgagcaacagccaaggtcccattcacctctccaggtcagagtgagaggtggagagacacctcccgactctgtcaggctgcccagagatgctccagggcccctaaatgtgtccacagggagacccaccatggagcacagatgccccatccccaaagccaggaggacgtgcgaatcctggtgacaaggtccttgggtgaagagacagccgcctgtcctgctcgctgccactgctcctgccactgctcccaccaacatagggaggatgtgcgtccggggccactcttccatcggaggagatgggctgggccactgcagcagggcaggcaggcctggccagagccccgtcccaaggcaggcttggcctgggagagtgaacgctctccagacacccgggacagcctgaggcgaggaagctgggcttttgcacttctggaggatgctgggaaaaatctgacaatgtgcaaagctaggttgtaaacacagttcaggttttctgctcataaagatgacaagtgggaaacagctgtgaagccactgcttagaaaccacctcagtccggctggcgtcttgttttgacaagctgttctcttgaaacacgacaaaagcgtggtgactcagaaacaattaagagcctctcctgcccgagcccttacacgctcgatgccccaggagtgatcttccaaaggacagaggcctctgatggggaggacctgggggaacatggctgctgcgaggccagaggagacgcgaactttttccgcgaagcggcaggagggcctggaggtgggttccaactgcccacacagctgaccgcacccctgcacccgcaaagacaggacctggcacgccccagcccttggccaccagcaggcaggaccctctgccatctccactagaggccaacaggagagctagcagccctggactaagcccaccgggcctgctgactggccaagggcacacacagagtacccaggatgcccgcaaaggggaaaatcccaggggtgccagagtggcaggggtgccaagaggggctgctgaagcacagggaggggtgctgagcctagggctggaggctgctagagtttaggtgggtggaaaggggcctggctggccagagacccagcccagagaccccgccagaacctaaggagttcatgctcccaggtgacgccaccatcccagaaaccaaacgccaggtcaaggccagagcccgccccacctcccacatgaacattccgagctctgagtggcattgatgagtgtcttggtcgcaggaatgccagggaaaggcagcacggaggtgagacaggtgccctggctgcctcctggagagcagcctgctcacaggtgcccttcccaggccccgggttggcctccgccacggctcctccaccccctcttcctgctgcagccagtccccagggctgcccaaggccaggttccgcctggtgcccaaacctacttcctgtccagctgcccactccccgcctgcctcagccccggtccagcaggctccccaggcagcagccatgccccgccccacctcccacagcatcaggtccctagacagctccttccctcgcgtctgcacacctagccactcgcccctgccgcacccccaaccccagcagcccctagctccctcaacctgcccaggccctggctgcctctgaatgcccccctgcacaagcatctgtccccgatgagagcctgcccatccagacctcgcaacagcccctcccacagcacatcagggagagagacatcttcacttaaaaagtagccatcaaagagtcctggcattgcacgctcataaaagccccatgaggaccagtgtagcaatcaccactcccacaccagagggagcactggggagggcaggccacggccagcagcaagtccgagcccagctagagaggcgggagagtcccgtccaccctgtacccaccctccagagccgctgctgggcgagtgggccattctggtgggtgcctggtggatgttgctgcctacgggcagggagcaggaaccagggggtggcagggaagtggggaagattctgggagggacacggcagagaccacccgggaaagctgacgggagagagcacagcccaatgactccctggtgcctgggtgtgcccccggccactgtggacacctgaggaaggcccagtgcccaacgcttcctcctcctgcaggctgtgcccgcagaaaggctgccacgaggccgcggcccctcccagccaggccctggtctcgggagagacgagcatacaggcagcaggggccccatcctctggccccaaccacgaaggtctatcaggccagcgattcatggaagtcggcttaccaacaaggtcagatgcgtggctgatgtctgctgccagagaggccgcctccaccacgatgtgggccacagtgatgggctcctctgggcctggtgctgccggcaccacctgccaaagggggaagaaaacaggggagtcgtctgtatgctccagagttagttctcagagaagaggcctgggctctgccagtgtaaagctgtggaggtgtgacttgtggtgctcaggcctgggtccacgtccttgggacggctggggtgggggctctcctcttccccaacacgaccaccggtcccagtccaatcccttcacccccgggccagggtcagcgccgtcactctcacacctctggccacgtgggctggacctggagcacagggcgcctgcagggagggagcagcaactctggcaggaagctgggccagtctgcaggaacaatggcacagtcccagcccgccacatccggcagagcggtgtgaggagagggccctggaggtgtgggccagaggccttcctggaggagggggcacctctgggaggagcaggtaaagagcacaggctcagagtggggtgtccagggtccagcatcatctgggccacggcccactggtggccagaggccactgaccactttctgagcctgctctcctgaccgtgcaatgcggatgacaagcgcccgctgcggcgtgtgcggggttcacaggcctgtgtatccagcccaagctgggcgtggggctcagcaaaggtggccatttgctgatgagatggcgggaccccccagggccacacttcacgtgtgaagtccctagggactgtgtgcacaggacagaagataagccaaagagacagaagctgccatggtaccccagagccaaaggagaccctccagctccaagaaagaagagatcccggcccccaacagcacgggcttcgaccagaggctgccaagaaggctgggccaccgcaggccctccaggacgccccagagcaccacaggctcacacacccggaccctcccacaccgcagccaggtgcctgccctctgcccgcccacgtggcccccggaaccggctgcacaggtccatcctgaagcgcggccacctcccccacctgtcaggtgaacccgggaggggatgggggagtgggtgagggctcacctcctggcccagcaacgctgtggtggcaggggtggcaggcagggcctccggaggggcccgctggcaggccttctgaatcttgtgctgaacaaaatcctccaaggcggtgaactctgcctggcagcggccgcatctgtgcacatcgtcctcatctgcaacgagcctgctgtcagcagggcctgggaaggcggaggctgggcagccagggctccgtctggcttttcctccagccctagaacagattcccccaggaggccatcagaagcagagctacttccccaggctgctgagaacacactcgggcccaaaacaaggtcatcccaaggtacagcccctatcctctgcaggtctgcaggggccagacccaccctcaggaggtcagcacccagcagagggtggccctgacagcacgcttaggctgcagggacctgctaaggctgccatgctcaaaacccacctcagcgactgacaggcgagaggcccagagaggggctgggaggcagagggactcctccatgctaatttggggacagtaaaggaccaggatttaagactgctggggccgggcatggtggctcacacttgtaatctcagcactttaaggggccaaggtgggaggatagcttgagcccaggagttcaagacgagcctggtcaacatagcaagacccatctctaccaaaaaaaaaaaaaaaaaagtttttaaaacattgttaaacatttaggctgggtgtggtggctcacacctgtaatcccaacactttgggaggctgagacaggtgtatcacctgaggtcaggagttcgagaccagcctgaccaatatggtgaaatcccatctctactaaaaatacaaaattagggcggtggctcatgcttgtaatcccagcactttgggaggctgaagcgggcggatcatgaggtcaggagattgagaccatcctggctaacaccgtgaaaccccgtctctactaaaaatgcaaaaaacttagccaggcatggtggcaggtgcctatagtcccagctactcgggaggctgaggcaggagaatggcatgaacccggcaggcagagcttgcagtgagccgagatcacaccactgcactccagcctgggcgaaagagcgagactccgtttcaaaaaaaacaatattagccaggcttggtggcgcatgcctgtaatcccagctattcgagaggctgaggcaggagaatcacttcaacctgggaggcgaaggttgcagtaagccaagatctccccattgcactccagccggggcaacagagagagactccatctcaaaaaacaaaaccaaaaaacaaacatttagccaagcgtggaagtgtggcggcatgcacctgtagtcccagctattcaggaggattgattgagcccaggggtggaggctgcagtaagccatgatcacaccactgcacttcagccagggcaacagggcaagaccctgccttaaaagaaacaaaaacaaaacaaacaaacaaaaactgcgggagtttgagcgtgccctggagcatgtgagtggccatctcctcatctgtaaaatgggctggggcccaggagactgatgcccactggctctggctgagaggcaaatgcagggagctgacccacaaccactctgctcactgacttgggactttactggttcccaaggttgagcccgtcaccattgctgtgccggaccccggtcgtgcagaagagaccaccccctcactgtgtgccaagcacctcactggggacgtcaccaaatcttgccagcaccctgtggaaatggagagaactattcccatcctaggaaaatgacctgaagttcaaggtcaccaaacggctgagtgtcagggacagtacctgtttacacaaagggataggagctgtttcttctgcttccataaaagcctgccagctctgaccattcaccttcagtccctcggcaggatcaaacccaggcctgatgcccgaaggagctgggcaaatgtttactgttgaatttgagggcggagaaagggccaaaccacagctatgactcgcctgcaggggccacccaacagagtcgtcctctcctgatggctcccagtcacaaaccaagctctaaggtgcccaccaccctcttccccttcccaccctactcctgtgtctcactcggctccagggcattgccactgaagaaccccctaccccagaaggggacacacccagcccatttcacaccagacaaggccacaagcaggcccagcaacctctaaagggactcctcgccatgagggcactgcccttctccaagctggaacgagaaggggcaaggaaaaaaggcagagactatgaatcctatggggacaaagacaagaccaccctcaacccaatcattaacaacctcccttcctgtctgacccaatctgcatcttttttttttttctttcaaggcggagtctcgctttgttgcccaggctggagtgcagtggggcgatctcagctcactgcaagctctgcctcctgggctcatgccattctcctgcctcagcctcctgagaagctgtgactacaggcgcctgccaccacggccagctaattttttgtatttttagtaagacagggtttcacctgttagccagggtggtctcgatctcctgacctcgggatccgcccgtctcagcctcccaaagtgctgggattacaggcgcgagccattgcgcccagccttttttttttttttttttttttcctaaacagagactgggaggagccgggcacggtggcgcacgactgtattcccagcactttgggaggctgaggcgggcagatcacctgaggtcgggagttcaagaccagcctggccaacatggagaaatccagtctctactaaaaatgcaaaattagccgggtgtgatgccgcgtgccgtaatcccagctactcaggaggccgagtcaggagaatagcttgaacccgggaggcggaggttgcggtgagccgagatcgcaccattgcactccagcctgggcaacaagagagaaacgccgtctcaaaaaaaaaaaaaaagaaaatagagacggggtcttactatgttgcccaggctggtctggaactccttgggctcaagtgatcctctcacctcagcctcccaaagtgttggggttacaggtatgagccacagtgcccagccatctgcagcctcataggacaagctcagagggtacagacccaagctccatctccaaaagctctcagtgcccccaggaatgagcccttagtgcatccccaacactgctctcggcacatgacacacaatcttttttctttttttgagacagtcttgctctgtcacccaggctggagagcagtggtgcgatctcggcttactgcgacctccgtctcctgggctcaagcaattctcctacctcaccttcccaagtagctgggattacagacgcgcaccaccacgcccagctaatttttgtatttttagtagagaaggggtttcaccatgttggccaggctggtctcgaactcctgacctcaggtgatccacccaccttggcctcccaaagtgctgggattacaggcgtgagccactgcgcctggccacaatctttattttaattcccatgatgcttctatgaggcagcagagcccggaagttaaaggggctgtgaaggccttcacagtgctgagatccaatccaacccttgctacttaactacctgggtgaccctggtcattttcttttcttttgagacggagtccggctctgccgcccaggctggagtgcagtggcgcggtctcggctcaccgcaagctccacctcccgagttcacgccattctccgcctcagcctccccactacaggcgcccgccaccacgcccggctaattttgtttttttgtatttttagtagagacgggtttcaccatgttggccaggatggtctccatctcctgacctcgtgacccgcccgtctcgacctcccaaagtgctgggattacaggcgtgagccaccgcacccagcccacccggtcactttcaggtctccaaccttcgattttcctcatccccaaaatgagaataacaataacatccacctgtcaggactggtttgagaatgaaaaaacctaaagcaggataagggcttgttacattactggcagaagccgccgccccattctgtaggggaaatagaggttcacagaggtagggtcacctacccaggatcaaagaactagaaagcggcaagtgtgggactggaaggggccacaggctggctgcagtgcaccagccctcttgcactaggctctgctgcctccctacggacaggcccagagcccagatcctggagaaaccgaggccccaccctcttggaaccaccaacagggccctagacgcccatcaggtgcaggaggaaggggcccagaggaggggagggccaggctcaggcatcggaggcagagaagggccgggacgccggcgtctgcgaatgtctacaccgggcgcccgggggctcagcaacccgcgagcacttgtggacgcacaccagagaggggggatgacaggcgccccgcaggagaggcccgtgagggtcgcagcaaacctgggggtttcgtggagggctgtgagggtcccgcgagatccgcgaggtgtctgggtctgggagggtcggtcgagcccgcagctcgggccatccgggcctctgccagcccgggatgaactgcccgcaccccggccgcaccctccgggtcggcccggttaccttcctcgctgaagggcgccgggaggccgaggaagccgctgggggccaaggccgccgccaccgccgcaactgcaccctcgcccgcttcccgcccggcttcggcctgggcttctgccgtatgagcggccgtcacccgcactgccatcgcgccctccatgtcgcaacgcgccgcaggaagatggcggatttacgaccatgtcgtcataacaacgggccgcgccgaggccagcgtgagggaacggcaagaggagggcggggcagaaccggagcggattgacggacaggcggggagccgggcctggatagcggtgtggccttaaagggcagaggcggggccgggcgcgctgagagcgaagatggggcgggactgtggggagggcgtggttacggtggagcagattgccagccagggggcggggcggcagaaggacctatgttcgaggctgcactcggatttgagagccagagaacgcgaggggcgagcggactggcggctgctaggcagccgcgccccagcgcttccgtacctaaggacaggtcgccccgcccgcggctgctgctgggaagccgccacagctccaaccaggggtgtggtgcctgctgcccactgaccgcctagggtgttagagcctcccaagatggttacccgggtcacgggaaaagaacacgggtcggggatggctcatgggtagctctgcgaagctgttttattcttttatatacttttaatttttttttctttcttttttgagacggagtctctttctatcgcccaggctggagtgcagtggcgcgatctcggctcactgcaagctctgcctcccgggttcacgccattctcctgcctcagcctcctgagtagctgggactacaggtgtccgccaccacgccaggctaattttttgtatttttagtagagacggggtttcaccgtgatagccaggatggtctcgatctcctgacctcgtgatccgcccgcctcggcctcccaaagtgctgggattacaggcgtgagccaccgtgcccagccactttttaaattttttaaaatttatttgcattatgtattttaaatagagacagggtcttgctgtttagactaggctggtctcaaactcctagcctcaaaccattttcccatttcggcctcccaaagtgctaggatgacaggcgtgagccacgactcccagccacgttgaatttttggttttggagatgggggttgtttttggtttttgtttgtttggggtgtttgtttttgagacagagtctcactctatcacctaggctggagtgcaatggcgcgatctcactgcagcctccgcctcctgggttcaaatgattgtcctgcctcagcctcccgagtagctgggactacaggagtgcaccaccatggccagctaatttttgtatttttagtagagacagggtttcaccatgttggcctagatggtctcaagctcttgacctcacgatctgcccgcctcggcctcccaaagtgctgggattacaagcatgagccaccgcgcccggcctgtttttgttttttgagatggagtctcgctctgtcacctaggctagaatgcaacggcacgatcttggttcactgcaatctccgcctcccaggttcaagcgattctcctgcctcagcctcctgagtagctgggactacaggcaactgccaccacacccggctaatttttttatatttttaggagagacggagtttcaccatgttggccatgctggttttgaactcctgacctcaggtgatccgtcccccttggcctcccaaagtgctgggatgacaggcatgagccaccgagcctggccagatttttttttgaaacagcaccttgctctgtcgcccaggctggagtgcagtgccgtgatctcagctcactgcagcctctacctcaaccacccaagtagctgggactacaggtgcccatcactagctaatttttgtatattttgtagagatgggtttttgccatgttgcctaggctgctatagaactcctgagttcaagcgatctgcctgcctcagccctcttacatacttttaaaaaattgtgggccaggcacagtggctcactcccgtaatcccagcactttgggaggctgaggtgggtggatcacctgacatcaggagttcaagaccaagcaggccaacatggcaaaattacgtctttactaaaaatacaaaaattatctgggtgtggtggtgcacgcgtgtaatcctagctactcaggaggctgaggcaggagaatcgtttgaacctgggaggcagaggtttcagtgagccgagatcgtgccactgtactccggcctgggcaacagagcaagattccgtctcaaaaaaaactgtggtaagtgcacataaaatttactattagcgacattcacagtgttgtgcaactatcacagctatgtgggtacagaacctttccggcaccctgaaaggaaacctgtgcctttgaagcagtgattccccatccgcccctccctgccagccctgggtagacgccagtctaccttctgcctccatgataaatttacctgttgtgaacatgtcctacaatatgtgactttcattgtttgttttttgagggtctcactctgtcatccaagctggagtgcagtggcatgatctcggctcactgccacctccgcctcccgggttcacgccattctcctgcctcagcctccggagtagctgggacgacagatgcccgccaccatgcctggctaatttttttgcatttttagtagagatggggtttcaccatgttagccaggatggtcttgatttcttgacctcgtgatacgtccgccttggcctcccaaagtgctgcgattacaggcgtgagccactgcgcctggccctgttttgtttgctttgagatagggtctcactctgtcacccaggctggagtgcattggtgtgatcctagcagcctccacctccaggctcaggtaaggtgatcggcagtcaggttggggtaacaatgggcccgctttctgcaagtaggttgctcaccactgcaaggttttgagcagagggaatgatggtgggtgttgcagaaacatccctctaactgctgcacagaaaaagggactttaggccgggcccagtgactcacgcctgtaatcccaacactttgggaggctgaggcgggcagatcacctgaggtcaggagttcaagacagcctgaccaatatggtgaaagcccgtctctagtaaaaatacaaaaattagccgggtgtggtgacggctgcctgtagtcccagctactcgggaggctgagacaggagaatggcctgaacccgggaagcggaggttgcagtgagccgagatctcgccactgcactccagcctgggtgacagatcgagactctgtctcaaaaaaaaaaaaaaaaaggggattttagggcttaagcagaagcaggaaggggctcagaaagccactgagagccagaatgggtggtctctgagtggggcaaacagaacgaagagcaggttggagcttttggagcttgagggttctggggagctgctggggaggaggaccaggagacaggtgggtgaggtgaagccatggaggaggtgagtgcagagccccaaaagacctccattcatggtgtgctgaggagtaactgagaagccggtatccaggggatttaggggtatggatgggatgattgtcccctctaaactcatgctgaaactttatccccaatgtaacagcattaagaggtgaggccttcagccgccccatccgggagggaggtgggggggtcagccccccgcccagccagccgccccgtccgggaggtgaggggcgcctctgcccggccacccctactgggaagtgaggaacccctctgcccggccaccaccccgtctgggaggtgtgcccaacagctcatttagaacgggccaggatgacaatggcggctttgtagaataggaaggcgggaaaggtggggaaaagattgagaaatcggatggttgccgtgtctgtgtagaaagaggtagacatgggagacttttcattttgttctgtactaagaaaaattcttctgccttgggatcctgttgatctgtgaccttatccccaaccctgtgctctctgaaacatgtgctgtgtccactcagggttgaatggattaagggcggtgcaagatgtgctttgttaaacagatgcttgaaggcagcatgctccttaagagtcatcaccactccctaatctcaagtacccagggacacaaacactgcggaaggctgcagggtcctctgcctaggaaaaccagagacctttgttcacttgtttatctgctgaccttccctccactattgtcctatgaccctgccaaatccccctctgtgagaaacacccaagaatgatcaataaaaataaaaataaaaataaaaataaaaataaaaaaagaggtgaggcctttaagaggcaaagggggccgggagcggtggctcacgcctgtaatcccagcactctgggaggccgaggcagacggatcatctgaggtcagaagtttgagaccagcctggccaacacagcagaaacccccatctctattaaaaatacaaaagttgggccgggcacggtggctcatgcctgtaatcccagcactttgggaggccgaggcggggggattaaaaggtcaggagttcaagaccatcctgaccaacatggtgaaaccccgtctctactaaaaatacaaaaattagccaggcctggtggcatgtgcctgtaatcccagctactcaggaggctgaggcaggagaatcgcttgaacctaggaggtggaggttgcagtgagtcgagatcatgccattgcactccagcctgggcaacagagcgagactctgtctcaaaaaaaaaaaaaaaaaaaaaaaaaagttgccgggcgcggtggctcacgcctgtaatcccagcactttgggaggccaaggagggcggatcacgaggtcagggtattgagaccatcctggctaacatggtgaaaccctgtctctactaaaaaaaaaaaaaaaaaatcagccgggtgtggtggcacacgcctgtagtcccagctactcgggagggcgagacaggagaatcgcttcaacccggaggcggaggttgcagtgagccgagatcgcgccactgcactccagcttgggcaacagagcgagactcggtctcaaaacgaacaaaaaaaaaatacaaaagttagccaggtgtggtgacacacacctataatcccagctactagggaggctgaggcaggagaattgcttgaacctggtggggcggaggttgcagtcagctgagatggcaccactgcccgccagcctgggtaacaaagtgagaccgtatctcaaaaagaaaagggcatcctgatcaggtgacctcaggccctgctttgcccagagcccaggccactggcaagcatgggagtggatagacccttggaaggcagagaggccaggcacaggcagcaagactagaccctccctttctccaaacggcctcctttcccatgcaggcctcagcctggctcaacagaataatgcctgtggacattccacagccagacccaaacaggaactacaaaatcctttttttttttttttttgagatcgagtctcactctgtcacccaggctggagtgcagtggtgcaaccttggctcactgcaacctccgcctcctgggttcaagcaattctgcctcagcctcccaagcgtgtgctaccacgcccggctaattttgtatttttagtagagatggggtttctccatgttagtaaggctggtctctaactcctgacctcaggttatctgccctcctcggcctcccaaagtgctgggattacaggcgtgagccaccgcgcctagcgggctacttatattttctattgcaatgtaaattgatgcaactctgttaaggtgaaatagtgtctgttctcgtgccactgaaagccatccccaggtcggcttgcagtacaagatccttacttggggagacactggggccatcccctcacagatagagactgaatgcctcctgtgtggggggcacccaaaggggtcctctagccccagatgcagggccacatcaccctgttcccaaagtcagtcctctcctataaagcgcactttcctcccagcctccgccaggaccttccccacaagtgaccatgcctcccctcctacctgcacacatacaggcatattctgaggacgttaagccgaccagatggggcagagctcagctttggggttgactgagtttaatcccaactcaaccttgtccagccggcgactctcggtggctcagtttggccatctataaatggagatgtgaataatccctgcctctcaggcctgtcctgtgactctgaggaggtaatgcagggaaggagcggtgcagcggcctaggtgctcacagagtgcccaggaagccaaggcagccgggcaagtgtgggagaagatggcccatggctgggtatcatcaacagttcccattccagccgttgtctcaaatcaactacctgttgctctgtggtaaaagcagagtgtgattcttgtcaaatccagttctgctcaaagtcaaagtcatcttttttttttttttttttttttttgataggagtcttgctctgttgcccaggctggagtgcagtggtgcaatctcggctcactgcagcctccgcctcccaggttcaagcgattctcctgcctcatcctctcaagtagctaagattacaggcatgtgccaccacatacggctaatttttgtacttttggcagagatggggtttcaccatattggccaggctggtctccaacttctgacctcaggtgatctgcccgcctcggcctcccaaagggctgggatcataggtgtgagccacagcacccagccaggatgaatttcacaaacattatgttaaaccgtagaagcaagagccagaagcacataccgtataatcccaagtataaagcagtccggaggcttggttgtgactctatggtgataggagtcagaaaagtagtcagcaatgtgctatctgctattgactggataggaacaagagggaacttcctggggtgttggaaatactttatactttggtctgggttatgtttacacaagcatatacatatgtaaaaaaatctgctgggtgcggcagctcacgcctgtaatcctagccctttgggaggccaagacaggaggatcactggaggccaggagttggagaccagcctggccaacatagtgggactccgtctctacaaaaaatttaaattaaaaaaaaaattaggcgtagtggcacacacctctggtcccaaatactttggaggcttaggtaggagcatcacatgagcctaggaggtcaaggatacagtgagctgtgataaggctacagtgagctgtgatctagccactccactccagcctgggggacagagcaagaccctgtcgcaaaatatatatatacatgtaaaaatgtaaaacttccggccgggcgccatggctcacgcctgtaatcccagcactttgggagaccaaggtgggcggatcacgagatcaagagatcaagaccatcctggctaacacggtgaaaccccgtctctactaaaaaatacaaaaaaattagccaggcgtggtggccggcgcctgtagtcccagctactcaggaggctgaggcagaagaatggcgtgaacccgggaggcggagcttgcagtgagccgagatcgcgccactgcactccagcctgggcaacagagcaagagactccgtctcaaaaaataataattaaaaaaataaaaggccgggcgcggtggctcacgcctgtaatccaagcactttgggaggccgaggcgggcggatcacgaggtcaggagatcgagaccatcctggctaacacggagaaaccccgtctctactaaaaatacaaaaaattagccgggcgtggtgccatgcgcctgtagtcccagctactcgggaggctgaggcaggagaatggcgtgaacccgggaggcggagcttgcagtgagccgagatggcgccaccgcactccagcctgggcgacagagcgagactccgtctcaaaaagtaaataaataagtaaataaaataataataaatgtaaaacttccatcgagctgcacggttttcatgccctttactgtaatgttttgcctcaattaaatacctaataattgatgacgatgacggcgagcaatcactgagtaccaggttctagacagtgtccttagaccctaatcccccagcctggtaatggctggttcgtgttacctccaaggaaccgggaacgcgtttttgcaaaggactgaggcgcgtactcacgcctgccggggaaggagccccgggctggctcgcgggactggccggtaagcgacccacgtggtggccccgtgtcccgagcgcgtccacggcacagaggcacgggcacggccgacgaaggtgccccggccccctcccgcggcgctcctgcgagagccccgcccatgcccgcgggagagaccggccaatggacagccggcctggcccgggtcactccgtgaagggcctcgtcacctaggctgaccactcgcttccaatgggtgagcggcccgcggcagcccgggaacagcggccttgcgcctgcgctgctctcccctctggcgcatttccgcagcgagcgcttcactccgaatgccggttggagccctgccagccaatcaccggggcgtcccaaggccggtagccaatgatcgcccctctccccgcgccgggcctcaccgattggcgctgagctcccgcagcccgcgggaggcgggggcggattggcgaaggtgcaggccaatgggcggcgggcgcgaggcgctgggccaatgagcgccccgggggcggggagggcgccgcggcgggcggctgcgaggagcggccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtccgtgcgccctggggcgggaggctggggggcgggcggcgggccccctccctgccctttgacccggtcccctgtgccccgcaggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcttggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccttacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaacccacactggctcaggtgtccttgctctcaccttgcattggcccgggtgatgccgtctcaccacgggtgggaggactcaaagtagatgggtaactggggttccaactccagagctggaatgccaactgcccactcccagcctggttcagaggaagatgttttgaagaatgagggaaagccaggcacaaagggaagccagggaagcaaagggccctggagtgaagctggtgggctgccgtgtcagagcgcccagggcagggagcagagctcagaagtaatgctggcccgggcgcagtggctcacacccgtaatcccaacgctttggaaggctgaggcaggtggattacttgagatcaggagttcaagaccagcctggccaaaatggtgaaaacccatctctactaaaaatacaaaaattagcgggacttggtggcatgtatctgtaatcccagctactagggaggctgaggcatgagaattgtgtgaacccgggaggcagaggttgcagtgagctgagatcacgccactgcactccagcctgggggacacagcgagactccgtctcaaaaaaaaaaaagttgggctaggcgggcccccgaggctggcctgactgtcccaggggcacaggctccagcaggctgcctgtctgtggtccaggcttcaggaacccccggtcttgggtgtgcgggggctgggaagtggctgggggtgcacagtcccacacctgtcattcactgaacaggcacgtattgacagcttgtggcgtgtcaggccctgtgcccaactctgggagtcaaggataacctgacagactcaggccactttaggaaaacgaaatccaccccaaccacacttagcgagtcaccctggccgggcctgggctgccctccagtcggtcagccggactggatttccacgcggccgagccctacgcctcccagaccctgagctccagtctgcacaggccaggtgtctggagccgggcctggtgacaggcatcccccaggtgggaggaggggctgtcctggctctgacctggatatcagatccagagctgagggggaggcgcagggtcaggaggggaggggttctgttctgagtttcccctggccaaggctgcagacaagggacgcagacaatcggcacattgtgagcaggggctgcaggatggaaccagcaagctgctgtgctgagcgccccaaacctgggcctacaggggtgagtgcctcccgttactcctgcagcaaggacccagggggtgccccaggccacccagcccctcccttccccagcccacttgctccctgatgtctaaccctcatgacccttctgaccctgatgcacgcccaggtgaagaccaagccctcctgcgggggctggagagccgtgagcctgctcctgctgctgctgctgctggtgctggccgctgtgggggttgtggctggagggcttcttggctctgctcagggccctcccaaggtgagcccctcctcagcaccagggacatggacagtggaaagggagaagggaagctggcatatcccagcctccagcagagcaagggtgcggagcaggcagtgacaccacctaggagcagacagccagaggaccaaggggtggaagggcccactcaggggtgtcaggagtcctgcagcccagagctggaggctgtgctggggttgcacagctgcccggctgaactccaactcccactgccagccaaggctgcagacgctgcgaatgaccctcccgagcccccacatgccccggcccaaccaaaccatcctggtggacgtggcccggaacgcggcgaccatcacagtgaccccacctcagagcaaccacagctgggcggtgctgttcgacgggcagagcgtgagtgggcagggaggggtcaccctggcaggtgtcggtctggggggccccgcctcacccccctgcctccccagggctgcatctgttaccgccctgaggagcaccaggtctgcttcctccgcctgatggaggacagtgatcgggagaccctgcggctgctggtggatacctccaaggtgagccgtcctgctgggcgcaggcccgggccaggggctagacaaagggtcctgtgtgcagcccagtacgggacaggctggagctgtggtttcagggaacaggaagctctctccgccctaagcccaggctgctgacaagagctgagggtggggacatcactgggggttggagggtacccggccctgccaagccaggagcagggagcagccctgtcccaccgcccaccagagccttctcaacaggtccaagaggcttgggtccccagccaggacacccaccacacccaggagctgctggcagtgcaggggagcctcgaagtggaccccgcccaggcgggggctttggtgcagcgcctgtgcatgaggacccccatctactgggcccggcgagcagagggtgagtcaggaccgctgtgggggaaggccaggccctcgggatggtttgaggagctgggggcggagcccttggagattcacggcaccctcgccacagggccccggagacagcggctgatttatctctgcatcgacatctgcttcccgagcaacatctgcgtgtcggtctgcttttattacctcccagactgagcccccgacctggcccagcctggcccgtccccaatccagtgggctggccaggccacctgcaccagggaggacagctgctggcagggactaataaacccttccacctggccatggtggtggtgttctctatggaccgaggccctgaaacgcgggcagggaggggcagagaacacactagcttgggggtgggcaccagcctcagacccctcagcagctttgggccctcggccgactttcccaggcagtgcaggctagcccagtccaggagtgtgcagcctggcttgggtcgagctctgtcacatctggataagcaactgggggctgagagtcccagggcagcctggcccagcaggtcaaggcgccacagggggccatcaggtccagctggcgcaggccggcaggggagggtctgctctgacctgggtgctgcatgggtccctccagctgccaccacctgcaccaggcagtcccgaggggtcacaggctagcccagcacactgtcattgaaggccaggcagacaacagccttctggtggccgccatactctctcttgatctctccagtctccacacaccagagccgggccaggttgtccgaggaagctggagggggagattgtgcagggctaagagcgcaggtgcaggccaagcaggcggccccagcagaggggaagctgcagccgaggtgggctggctctggaggccagcgccgggggccagggatgggggaggccagggcggggctcaccagtgacgatgtactgggagtcccccgagaaggcgcagccccacatccagccgcgggaggactccccggggttgccgctcttgatgctcagctccgtcatcagggagaagttggacgtcctccagatcttgcacgtctgatcagccgagcaggtggcgaggagcctagtgggtgggcatggggcgtgtccagcagcagccactccatccagcagcccctcccctctccagcccccagcccaggcaggtcccctcccgggccagcaggccctgcacgcacgtggagtcggggctgaagcgacactgcagggcgtagcgcgtgtgggcagggatcttagtcttggggatgagctgggtcacctcgtcaccaatgccccccgtcagattccagacatagcagtttccctagaggtcaggaggaccgtcacggagggcccaaggcctcaggtctgagacacagggaaggatgccctgggggccaacactgggggccaactgtgcatggggaccccgggtgaggggcaggcaggcccctctggtcctgcctgcagaaggcacctgggaagcctggccccaagcaagggccacacctggcaagccaagaacaggaggccacgcctggccaaggactcaaattctccttcctggaggatgccgatggccaacggaagtagacaggagaagggcaccagctagagagacagcatgacaaaggccagcagaagggaaatccgggggcaagaggtacaagtgatgcactgggattaaatgaagttaatgaaaaaaaatgaggctggagagaagagcaggggccacgccacagcagcctacgggcgaggccagcagccccgggtctcctcaggggaatgacgccacctggctgatactgaccaggcaccactagaagcatccaagagagaacgtgtcaggggccaggggaggtcagggagggggaaaggaagcctcagagagtgtgtcagccgtcaccagaaacaagggtgactgggaccaggaggcaacagagtgaaaagagggaagtggatcgacttgggagagactccagaaagcggagtgaccgacctgcagacaggactaagccatcgggagcgacactaaggcttctggctttgctggcaaggtgggtgttagtgcccgggatggggaaagcaggagggggccgctaagggacatccaggaataagcccacctgcagaggctgagggctgagtgccaagctgcccgcacccagcacctgccaccaggactcacggtgctattgacagctgccatgtagctggcgtcgggatcgatgtgggcggacgtgatggagacctcgggctcagggatcagctgctcgttgtggtctgttttcaagtcccagatgtggatagccccgctctggtcacccacgatgagctctgcctggggtgcaggggtggtgaggcagggcccaagcccagccctccaaagtcccagggtgcctggccccatgagcacccctcacctggttggggtgcaggcacacgcagttaatgggtgcgttcacctggaagatccgctggcactgcaggttccgggacctgcgggccgggccggggcacatgctgtccatctgggcttgttggtgccctacccagatggcctcggcctggccattcctcccctccctctgctgaaggacctgcctcttgggaaatacttgggacgcagggccctctgctccagcagggagcctaagccagtggctggtggaaggggaataacaagctggctccgggctcaaggcaggactcgcgctctgatgcaattcactctcctcctgtcctcacttctctcagtaagtcgcccacaggaagctccctgtctcagcctctgcttgaagagaacccaacctaaaacggtctcccagagcagcccaccccagccccgggcagcacgccccctccccaccgcacctgaggtcccagatcctggctgtgcagtcctcgccgcccgtgtacatccagcggccgtcttcgtggaagcccacagacgcgatgttcttgttgacgccgtcgtagctgatgatggggttagggttattggagttgagatcatacatgcggatgtgctggtaacctagggacacaggctgaactgaagcttggctgtgctgaggtcgacccaccagagctcaggagtttagagatcaaggatcacagatacctgcagcagcaatcatgctgcggtccggtgtgacctccaaggcattcacctgctgggactgttaaggaggatgacgggaaggtagccctgaggccagggccccccaggcctccaccatctggccttcacacaggctgtggtccccacacgaggcatccccccagcgccgccctgcccgccccgggtggaggatacggagtcctggtgctgcaccgtccgggtgcagatgccgctgtgggcctgccagaagcgcacggtgtggtcgtagcctgcagtggccaggatgaccgggtcactgcccaccgtgcctggggaggtgttcatggtgtggcctgcacgggccctagagctgaacggcaggggtcaaaggtcagagcatctgcagagaaggatgtgaagtacttagaagacactctctgtgctaagtagattatagacccacaaggcgctgccgaatggcgcttatcattcccattttagagttgggacaagaagcgcaggtaggttcagggacacgcgtcacacgcgtgatacctggctccggggctccagggcgcgtgctccatccccgccccacgcacacggcgggggcgccgtcccccccccacctccgcagccggcaggggggagtcacgcgcgggcgccactctgccgcaggggcgggctgcgcgtgcgcaaggcggcggatgggccggggaaagccgagcgctgcggctgcgcatgcgtagcaggccagcggcaggccctgatgggaaagggcgcagtctggctggacccccgagctcccctttcctccggtgaccgcccttgctccgtcctgctggccggcttcccctggccgtgctctcccagccacccagcagccggttcccggcccctggctcgcggcctccgtaccttacgggcggctccgcactccgccgtgtccaggacggcgaggggagccggagcgagtcgatcgaggccgagcgtagagttatcgatggctccctagggcgagaccatggcgcgggcgggggtgggtgggacgagaccaaagttctggggcggggggttcccgccgggaggaactcggagcggtccccgtgcgcggccgcgggcccggcgcgaggtggaaggaagctgcggctttctctccggcctcctgcccactggcacctgcccttctgacacggctgtccgtttcccgggctgtcgggtcgcgctgttccggtgccctccctgacccactactgcgccacgctgggctaggattggctgaaaattacaggacttgaattcagacaagtaacgaataattttttttttagtgtaagtatatccaggacattgcatgggaaatacttatgctaaaaaaattttattgggtatcctgtagttttacttgctagatctggcaccccagccccagcctgaccctcaggacatcccactgagcccagggtccccctcaaaaccacaggccctcattccagctctgtgagctccacgccggtgccctcacccttgagacaggctgtcgcatggttttttcctgctgctcttacagacctggctgcaccccttcctctggccgcagagggggtgcatcttgtcccttgaccaggccatagttcccatggagccttccttcctataccttcacctcctctccttcctgccggttagcctttaaaaaaacaccataaaacaatcccaaattatcttcttcaaagagcggtcctcaccatttttctagttccacgtcctcacctcccactcattccgcaaccccagtcatctgccttttacccccagctctctagctctccagtggaaattcctcaaggtcactgacaatctcactttgctaaatccagtggatacttttccttcttcccaccttttttttttttttctctcgagacagagtctcgctttctcgcccaggctggagtgcagtggtgcaatctcgactcactgcaaaacctctgcctcccaggttcaagcgattttcctgcctcagcctcccgagtagctgggattacaggcacgcaccaccacacctggctgatttttgtatttttagtggagacgggatttcaccatgttcgcaaggctggtctcaaactcctgacctcaagtgatccgcctacctcagcctcccaaagtgctgggattacaggcgtgagccactgcgcccggcctcttcccacttcttctttctttttttttttttttttattgagacggagtctcgctttgttgccaggctggagtgcagtggtgcgatctcggctctccacaatctccacctcccgggttcaagctattctcctgcctcagcctcccgggtagctgggattacaggtgcatgccaccacacccagttaatttttctatttttagtagagacagacttttcaccatgttggccaggatggtggatggtcttgatctcgtgacctcgtgatccgcccccctcagcctcccaaagtgctgggattacaggcgtgagccactgcgcccggccccctcccacttcttgacgcatctgagccatggttgacggcaccatgcctgaaaggctgccttctcctagctcctgtccccgacatttagtctctttccctgcctgcccgcaaggactcaggcccttcagcattcactctgtgcaccccacgagataccagggggctgatgactgctagctctggagcttccaatgctgtccctgtcctgggccccttccaccctgtctccagctctgatggcctcagctccctgttaagacactgtcccttgaatgccccgcagggtccaccatattccagggccaagacaacccatccctgagtagctccccttctgtgggcagtgcccaccttgtattacagctgggcaagatccgacacctcccctccctcacccttcccttcccttcagccaccgattttacctgtgatataccttcctgtcctttccactgccctggttctagctcaccacccccatcccccataaaagcctccttccttgccccagccactctggcccccttccaaactgtccaccacagtgcagaatggccttttatttatttatttatttatttatttatttatttatttatttttgagacggattttcactcttgttgcccaggctggagtgcaatggcgcgatctcgactcgctgcaacctccacctcctgggttcctcagtctcctgagtagctgggattacaggcatgcaccaccatcccagctaattttgtatttttagtagagacagggtttctccatgttggtcaggctggtcttgaattcctaacctcaagtgacccacccacctcagcttctcaaagtgctaggtttacaggcgtgagccatcgcgcccggccagagtggccttttaaaaacctcagtctgagcccagcacagtgattcatgcctgtaatcccagcactttcgaaggctgaggcaggaggatcactcgagcccagaagttcaagaccatcctgaacaatatagtgataccccatctctacaaaaaatttaaaaattagtcaggaatggtggtgcgtgcctgtggtcccagctttgggaggctgaggtggaaggatcactcgaggccaggaactcgaggctgcagtaagctgtggttgagccactgcactccaggctgggtgacagagcaagaccttttctcaaaacaaaacaaaaacccccagcaaaacctaggaatgacttgatcaccccattagaagccctcaggggtccctgtccctctccagactcctgggcctggccctggccctggcccatcctgtggcttccatctcctctccatgtgataccattaggctttgtgtccccacccaaatctcgtcttgaattgtaatccccataatccccatgtgtcaaaggagagaccaggtggaggtaactgaatcatgagggcaggttcccccatgccgttctcatgatagtgagtgagatctcaagagatctgatggttttataaggggttcctcctcctttgctccacttctccttcctgccgccttgcggagaaggtgccttgcttccgcttcgccttccgccatgattgtaactttcctgaggcctccccagccatgctgaactgtgagtcaactacacctctttcctttataaattatccagtctcaggtgttctttattgcagtatgaaaatggactaatactccatgggtcctgtactctggccaaaggagacatgttctcctcttttgttttcttttgttttgtttttcagacggaatctcacactgctgacggggatggagtgcaatggcgcaatctcggctcactgcaacctctgcctcctgggttcaagcaattctcctgcctcagactcctcccaagtagctgagattacaggcaccccgcaccacgcctggctacctttttgtatttataggagagacggggtttcaccatattggccaggctggtttcgaactcctgatctcgtgatctgccgcctcggcctcccaaagtgctaggattacaggcgtgagccacagcacctggccatgttctcccctttgagcccttgactgtgtctgggatgcttttccctctacgccttacctgccaaattcctggttttcagcatatctagtaacattttcttttggctgggcatggtagctcacacctgtaatcccagcactttgggggatcgaggtgggaggatcgcttgatcctaggagtttgaggctaacctgggcaagatggcaagatgacctcttctctgcaaaaaccttaaaaaaaattagctaagtgtaggccaggcgcggtggctcacgcctgtaatcccagcactttgggaggccgaggccagtggatcacgaggtcaagagattgagaccatcctggccaacatggtgaaaccccatctctactaaaaatacaaaaattagctgggcatggtggcacacgcctgtagtcccagctactcgggaggctgaggcaggagaatcgcttgaacctgggagtcagaggttgcagtgagccgagattgtaccactgcactccagcctggtgacagggtgaaactccatctaaaaaaaaaaaaaaaaaaaaaggaaagtaaagaaaactttttggccgggtgcagtggctcatgcctgtaatcccagcgctttgggaggccaaggcgggtggatcacgagttcaggagtttgagaccagcctggccaagatggtgaaacccagtctctactaaaagtacaaaaattagctgggtgaggtgccaggcacctgtaatcccaactactcaggaggctgaggcagaagaatcgcttgaaccttggaggcggagtttgcagtgagccaagatcgctccactgcactctagcctgggtgacagaacaagactccgtctcaagaaaagaaaagaaaagaaaaaactttctacagtgcactcaaactagaactcaggatgaagaaactcactcaaaaccactcaactgcatggaaactgaacaacctgctcctgaatgctgacaccacagcgtaaactttctgtttgtttgttttgtagagacggggtctcattgtcttgcctgggctggtcttgaactcctgggctgaagcaatacacccgcctctgtcctgagaggtgagtgattacaactctcaccacccaaagtgctgagattacaggcatgagccaccatgcccagccagtacattctttttctatggctaagtaatattccactgtatgactagagcacgttttatgtatcttctcgtccataggtggacatttggggtgtctcctcctttttggctgtcatgaatggggctgctgtgaatggttgtgtggttgtgtgccaatgtctgagaacgtgtttgcatctcttggtaaatacgcagagcggaattgctgggctataggagcattttacctgccttatgcatggagtcctcacaatgactccagtagggaagaatcaccctcattttggagatgagaaaactgaggctcagagatgcagaattgcatgtggagggcatagggctagaaggtggtggagcccagggtttgttcagctctaggccgggccccatcctgctggggctccacctgccactgatcatgccccttctggtgaggtgactactccccaggcagcccctgcaccccatagtcctcctcatcttcctctcgaagtagacaggggctctctaaccaggctctataccaggcttggggcagctttggggagtagaggtgagcatgtgggcttggatggctgggagaggaagcgccttcgaatcccagcagtgtctggagcagcatagacccgggagcagagagcaggagacagggtggggctgaggcaggctcagctaggtgcgtggggtcctacgtgtctcagggccctgcactgtttgccttttccgtggggcctctgggcggcacatgggggctgagggcaggggccagctctgggagcctgcatgtgtcccaagcctaggggaagctgacaaactggtcgtggccccaacccaacctgagtagctcctgcatttctgtggggcaggaggctgggacggtggtgtgtgggggtcgatcctcggtgatggtccgggccccagctcagtgctgtcagaggcggtgccacaagaatgagaggagccacagcagccagcccatgggagggcacgttcctcatgcccataccagagctttgggggcttgggggaccaccagggagcccctgagcagacacacagccagtgggcagaggaaggggctgcgggctggccggcacacaccgtacatctgggaaggaggccagcccaggctgcagtgaagcctccgccagctccattccaggctgagcctcagcaattctgctggctcagaggccccctcccaggatcatccttggaggcttgacttcctggagggctgcccgagtcccacacctctgcatcctcatcccccagccagagtggccacctgccctgcccccccatccccaggctgcagggaccccaggcagacacacatctgttttcatggggaccttcccgtcagccctaagctgcaggcggagctgctggcccatttcacagatgaggcagctgagcatcggggactcacccaaagttactggttacagcatcagatccaacgcttcccagtccctcctgggcttatcctcacctagcagaaggctctggtcccctcctgccacactgcaccccatggggtgaggaatctctgaggtcctgagcagcaatccacctggagcctaggtgccccttctagaccacactctgagcacgtaggaccctggagtttcctgcccaaacagccccaagcccacttccaggatcggcacagccctctgcccagtctgtcctcctgaaggtgggccacgcagcagggtgcccaccctagctctgaggagcgactaagggggtgcctgtttatggggtgtggacagtgctggagctgagcagagaacaggtgaggtagctacaaacgggggccagttcatcacccgaggaatctgagaattctcaattcgaacttgggctttcaggccatgatgaaggtatatttgtcaaggtaggagaatagaacatacttaacaggtgactggcgtgatttgtagcgtttaaatatttgaacatttggtgtgtgggcttctgtttgtgtgttaagcacaggtcagggtggtttgccttaacatgtccaaaacataaaagtaatagtaatgccagcagctatcttatttttatttttagttcttcctatgtgctcttcacactgcaaggtagcgtagatacaaagatgcacaaaacacagttgctgcacaggcagagaggcccaagaatatcacaatatctacagcagccatttttttgagcacttactaagtcctgccgtgaaatgctttgtggatagtatcacaatttatcctccagtaacctaaggggaggtagcatgcatatcctcattttacagaggggcacagacacttaggcagtgggctgggtgtggtagctcacgtctgcaatcccagcactttgggaggttgaggtgggaggactgcttgaggccaggagttcgagaccagtctaggtaacatactgagacctcatctctattaaaaatcaaaaaaaattagccgggcgctactcaggaggctgaggcgggaggactgcttgagcctgggatgttgaggctgcagtgagctatgatggcgtcactgcaccccagcctggacgacagagcgagaccctgtctcagaaaaaagaatgacaaagtgaccagctcatggtcacaaaccactaagagggggaataggacacatccagaggtgcgggtgcaaagcccagacttacaacctcaagactctgggaccccaggtgagccccttggcttctctgagcctcagtttcttcatctgtaaaatggggacagtgagtccaacctcatctaggaggtgaccagcacagtgcctgacccagcgggtactcaactggtcattggaaagggcaagaggaaaggccctagcatttggggacccctcccaggagtgctggaagaccaagggctgctacctgaacctaacaggagaccccacggagggaacgggaacggccagctgcccacaggatgccgggaccccggtgcctgtcaccttccctgtccctgctgtctgacctcctctgtccccctggacctgctcaatggtctggggccacacagagtggggtgccaggccatgcctcatagaatgggtgcgaccctccccaaattctccaaacggccttgcccgcttgggtgatgagggaaacggagcctgagtcgggactcagacccccactgatctgcctctagaatgctgcaggcctgacgggagagggcctgaggcgcagggtggcccaagccttcagccaggagctcagagggtcacaagtcggggcctccagcacccaggaagcaggactcgcctgcctgggctgcaggctggagagtgggcagacgtgggccgggggtcggttggtgccggcgggaggttccagcccctgtggatggagatggaggcgacccccagtcggtgcggggagtggggagttgagctccctcagtgggggtggtgggggctaccttggggtcaggcttcggactgaggctgggggaagctgtggcgcccgcattatttgcggagaggagcaggaggatgcttgggggttgggggtgcgggttccctgacaccgaattcattattgggagattcctcttcacaatccctcgacacctcccacgggaaccctgggccaggaacgcctgacagcctggcgggccggctccaggggcactggcgcccgggtctctcggcgcccggtccccgcccgcccgctgcctcggaaccgtcccccgcgggtcccgcagcctctggaagcctctctgggctcagccccgcgccgccgccgcgtcggggctcccagtgcacccccggcggccgcgtccccagcccggctagcagccccaggccgcccgcgtccgcagaggcctggcctgagcgcgctgcgcgcacgtggggagggggcgtcccggggcgggcgcggggagggcggagccacgggcccgggcgcgcggccggcgcgggctgacggaggtcggcggcccgggagcggaccccggcgtccgggaggcggcgccaggtgccgcgcccccgccccgcgcccgccgcgcgcccccgcccccgggccgccccccgcccgtgacgcgctccccgccccctccgcgccgggagcccgagcccaagccggagcccgaggagggcgaaggggcggcgggcggcgaggaggcggcgggggaggcggcgggggaggcggccggtgccgcggggccgccgccgcctctgagccgcgccgagctcacgagcgcagccgcgtcgctgcggccccggccgcgccatggggaaggagcaggagctggtgcaggcggtgaaggcggaggacgtagggaccgcgcagaggctgctgcagaggccgcggcccgggaaggccagtgagtgccgggggcgcggggcgcgggtgggagccccgggggcccctccccggcgcggagccccccacccggcgccgggcggggaggggacgttgtcgggtccccgggggcggggcggggccagcagcgcccagacccttggtccgtgccctccacccgctgcccccagcactggagatggggcggccccgagagccggccgccaccgtgagccccgcagcgggcacctggcggcacccgcctcccgggccgcgggcgttcgcatccctctctctctacctctgtccccctcccttcccaggctgcgggctgacagctggaggtctctgctggggccttcaaagggcgaggcggatgccccccccacccaccacacgcaccgggaagacagggagggggcccctgcggcgaggggcgacccgggaggtgacagtccctagcagaccccctcccgccccacgtttaataacacgctttgcagggaaggtgggggcaggaccacgctgggggtgtggctgccctggcatggccggtggggtgccatttactgatgggagagcagaggcccaaggtcgcccagcccagggcaggctggactccaggcagggccggcctgggcgcaagggcttggggccctgctcaggcaggctccagcagagccgggtctccagcttccctgctgggaaaggaggccatgagggagtgggggaccaccactggccatccccagcttgccctatggccggccccaggaaagggctgggagcttggagccctggtcccagcactcatcctggctcagcgcgtagcctccctgggggccgccggagatggatggatgggcgtgtggaccagccgcgtgtgcggctgcgcacgtatagccgtgtcagtgtgtcagggcacctgtgcgggcacggacagggctctgcaggtcggcacgtggggtctgggcgtcctccctcctccctccacccccacagactgtaagccagagagtccccctccccttcctccagggggatgccgagaactgggactggcttctgggagattgttgggggcacctaggagtcccaggaggaccccctcccccgtacttcaccagcagcccatgactggctagctcctgtccactctgtgcagtaagagagagggggcaccggtgccttgcaggctggccccgagctgatttcaggtccgggggctcagaaagggagagcttgtgggcagaggcagcctcagctgagcctggagagcaggtgtagggattgagggaaggcaaggtaaaggtttccacctagtggccgcatgaccttggacacagacaactccagctcagtggacctcagtctcctcgtctgtaggatgggatgtcagcctcacggtggggtcctaagaccagtgagcctgggcacttgcagcccaggcattcagtaagtgctcagtaaatgccagcaatgaccgcagtcttggacggcccagggccaggggctggggaagtgggggcttcagctctggggaggttcctcctcccttctattgtggccattctggggaggtgtgggggcttccactctcacctgggtctctgcctgtcttgcctggcctctgggacaggagagacacctgccctggccccggctcctgctctctgactcacaggggcgggtgtaataaatcagaggagaaatccctccatgaattagctccgtcgtcatggcaacgctggcctgctttggagtaagatgtattttgattcagtaaagtacagctgagtttgggccacgaggtggggggtgtccagcagtatcctccagggccccgtgagcccagggctgtccccatgagctttgcttccatggtcccctctggttgcccagtcccttccctccagcccctgctccagagtcaccccaggctcagccagcccccgactcgccctgccctgaagggagcctcccgtgcccgcacgcacacacttagcagctgtccttgaggggaagaggagcctgttctgggggagatgccggtgcaggggctggcctcctgctggccaggagggacccactcttccctctgacccggaccctatccatggaggccccctgtccatggaggcaggcccaagaatgccgtggaggacacccctgagcaccgagggccagctccccatccccctctcaccttctaatagcccactagtagctcccttctagcctgggatatggactggaccccagaggtggggacaggctcaggatagcagtgagagggctggtcgggggtaaggcctttactgtcatagagtcacagggcttagggacctcgtggagagggaggggggctcctggactttcatcctggccccggccccctccagccatgctctgctcctgcttcatccagagaacccgtttccaggtgaaaacagcccccagccccaggcccttctcagttctgggaccttcctgggtacccactgtccccccacaggaatgggggttagtgtgtcccaagacctcaagttgctgccatccaatttcagccagtttcccccttgaggagaccataagtggggagagggacgagatggctttagtaaggcacccctcctcacatgggggtggtccccttcctgagggagacaccctcccccactggcagatgttactttctgggctttgacctccagcctctccgagatttcagcccctgaaggtgtggctgggtgagaaggtggtttccacactggctgcctcagctgtgggagggaggacagggcctggcttggacagtcctggggacatgctgagggctgtccaccctggagctgggaagagtgggggtcagcgttctgtggggagaacctcctgagtgtggtcctggcggggatgcacgggacagtgacacctgcgctccctttagctaatggcaagggatggtggtaggccccacgacataattcccaggtccccatgcaaaatgtaaacgcagggccccttgctcaaaaataagaatttcaggccgggcatggtggctcatgcctgtcatcccagcactttgggaggctgaggcaggcggatcacctgaggtcgggagttcgagaccagcctgaccaacatggagaaaccccgtctctactaaaaatacaaaattagccaggagtggtggtgcgtgcctgtaatcccagctactctggaggctgaagcagaagaattgcttgaacccgggaggtggaggttgtggtgagccgagatcgcaccattgcactccagcctgggcaacaagaatgaaactccatctccaataaaaaaaaagaaaaagaatttcgagatggcgacaggagagcatccgcaggcatggggtccttctgagccaagcacaggccgcacacccattaagtcgcctcggcggccaggcagagtgtgggggatgaggagatcgatccagtccgcaactgagcacctcagctgcgcggggcaccattttagccaccgaggattcctccgtgagcagaacagatgacggcccttgtccccttggtgctggtagttgagtgatggagatgggtaggagcaagagcagaaggaggttgacgtggctggtggtgacgagggctgcagagccaggcacagcagctgcggggcgggcagggtcacttcggatggggagggcatgctgagtgagcagcctgtgggtaaggatctgaaaaatgtgagggaggctgtggggttaactagggaagaggaggccgcacgtgcacacagggcatgtggaaaggccttggacagggcagccgatatgttggaggaacgtctggaggcctgtgtagctgcagcaggaatgagggaagtaatgataactgagagcaaagcaggagccccacgtacggccactgtccagtctcagcctcccctcctagcacagccactgtccgttgtcggcctcccctcccagtgagaccagtgctgccagggggtcttcaggagaggcgtggcaagatctgattcatgttctctctcctttttttttttttgagacagggtcttgctctgtcacccaggttggaatgcagtgagtggtgcgaccccggctcactgcagcttcaacctcctgggctcaagcgatcctcccgcctcagcctcccaagtagcagggaccacaggcacacccctccgtgcccagctactttttttttcctttattttttgtagagacaaggtcttgctatgttggccaggctggtcttgaactcctggctgcaagtgatcctcccacctcagcctcccaatgtgctggggttacaggcgtgagccacggcacagagcctgactcatgttttcccagggaaccccgacggggtgggtgtggaggttggaccgagggatgtgggaagaccttagcgacaccagtggggaggggatggcacttatcctgccagagatgccggcctggaccaggttggtgacagtggctgtggggagaagggctagggttccaagtgtgctctggggatgtctgggaggcagagctgacggacaagctataggtgtgcaggaaaggccccaggcctggctccaaggttttggcctgggccatggtcaggaaggatggcattgccactaaccaagagggacactggtgccagcagtgtctgagcagagggggaggggccggtgaggctggagacgactttgcttgccagaagaaacccctggctggagagagctgggggtgggattcctgtacggctaatattagtaatcgccatgcaccgagtcctgacttgtgccaggccgcgcacgctttatgtctgggaatgctctcacacctccgggaggccctgttagcacccccggctccagctcagggagggcgccagcagccaaggacacaggctggtgagtggcagagcagagattcgaattcacagcagtctggctccttcggccagcctcgtgggtcatcaggggacccgcaccctgtgtccagtggctgggactgaggccggggcagcaggggctgctgtgggtcactgtgcaagccctgcagacagccctgtgcctcgactccctcaactcccctgccctcagctcctgcccccaccctgtcctgggcctggacaaaggggcttctgtcctgccagctcccctctcagagtgactgacccacaaatgggttatgtaaccacggcccagataggcgggggtttggcccaagtctgcttggactagagcccactgggagggcatcggtgggcttccctcctctggcagctggctgggggaggccaggatgcggggggccccaggaggacgctggggccctgaagggagggcgtgggcccctctggcctcaggtgctccgagtcgccagggagcaggcagccgttcgcgtgaggttgctcagaggtgccagcccactcgcctgcctcccacttctgctcatccacactggctgtggcccagggctggcagtgggggtgctgcacggtggagacgcagatcctcccccagagatacccccatttccgggtgttccagcctccctggccacccccggccccatctggatccttctgagagacagattgggccggctctctccctcccaccattggcaggtgctcagccagtgtcccgagggaggggtgtgcgtgcacatgtgtgtgcctgtgtgggtgcacagccttgcctcctatccccaggtggggacaaggactccaggccggagtccttagtactgtgaacccccacatctcagggcaatgggacaccaaggcccgagcagctggcacctggggcaggctgcggggcagagctgaacgcgtgagtgcacgagtggacgagtgagtgtctgcagactgagagcccagcagctttgtgcctgccggggagatggctggccccctctccctgccctcaggccgcctggaggggctggcacagcctcccctcactgagtctccttccatccccagagctcctgggttccaccaagaagatcaatgtcaacttccaggacccggatgggtgagttctgagccgggtggtgcctgcctggaagggagggtggctcctagagaggcctaggtgccgggggagggcagggtgccgggaaggccggggcgccagggcctctgctctatgtgtcctctgcacgtgccagcttctcggctctgcaccatgcggccctgaacggcaacacggaattgatcagcctgctgctggaggcccaggccgctgtggacatcaaggacaacaaaggcaagactagccgagggcctctggtgggggcaggggcgggggcagcgaggggggctccccagggcctgcatggatccttggctgaggtctcagcccagggtctcagtctgatttcaggcaggtcctcctgggatcagggtcctggaggccaggggtggggctggggtgaggggtcagctcctagcaccccccaaacccacagggttgggcttggggtcaggggtcagctcccagcattccccccacctcccagggttggccttgggggtcaagggtcagctcccagcattcccacctcccagggttgggcttggggtcagaggtcaactcccagcaaacccccgcccccaaccccaagggttgggcttggtgtcagaagtcagctcctagcgccctcccaccccccagggttggacttggggtcaggggtcaggtcccagcacccccctatcctccagggttgggtttggggtcaagggtcagctcccagcatcccctcgccccccaggcatgcggccgctgcactatgcggcctggcagggccggaaggagcccatgaagctggtgctgaaggcgggctcggccgtgaacatcccgtctgatgagggccacatccccctgcacctggcggcccagcatggtcactatgatgtggtgaggcccgagcgggggcggggcagcgggggcggggcagcgcggcctgaggatgtgcggacctgactgcgcccttggcccccagtctgagatgctgctacagcaccagtctaacccgtgcatggtggacaactcggggaagacgcccctggacctggcctgcgagttcggccgcgttggggtgagtctcctgtggagccctgtggggtggggctggggagccccacatcaggacccccctaccctgacccctccttcaaggtggtccagctgctcctcagcagcaatatgtgtgcggcgctgctggagccccggccgggagacgccaccgaccccaacggcaccagccctttgcacctcgcagctaaaaacggccacatcgacatcatcaggtagagccggtagcagggagggcctcagccttagggtccccagggttcagcagcagcctggggctcagggcaccagcttctggcttggggatagggcgggagcaggcagggtcccaggtccctggtcaggcctctggcatggcctccagggcccatgtacaggatgagctgcaggggctgggaagggggcttctgcgacgtctctgtcccagccccaccgctcctgggtgtgctcgaggaggtgctgaacttccctgagcctcactttcccatccgtaaagtggggttcacagcagcgcctacactagcatcagacaagataacagctgggaagtcttagcacagggagggcccttcaacagtgctcactgtgggctgggtgccccggcggctcacacttgtaatcccagcactttgggaggccaaggagggaggattgcttgaggccaggagttcgagaccagcctgggcaacatgtcaagaccccatctctacaaaaaatacaaaaactagccgggtgtgttggcacacacctgtagacccagctacttgggaagctaaggcaggagaatcacttgagcccatgaggttgaggttgcagtgagcgatgattgtgccactgtactccagcctgggtgacacagcaagaccctgtctcaaaaaaaaaaaaaaatcggctggttgtggtgatgcacacctgtagtcccggctgcttgagaggctgaggtgggaggatcgcatgagcctgggaggtcgaggctgcagtgagccaggatggtgccactgcattccagcctgggtgacagagagagaccccatctctactttttataaaaaaagcagctgagtgcggtggttcaaaatgctgcaatcccagtattttgggaggctgacgcaggagcccaggaatttgagaccagcctgggcaacatagcaagacgtggtctttacaaaaacaaaggcaaaaaaaaaaaaaaaagctgggaatggtcacacatgtctgtaatcccagctactctggaggctgaggcaggaggactgcttgaggccgggagtttgaggctgcagtaagccatgactgcaccactgtactccagcctgggtgacagagtgagaccccgtcttagaaaaagtaggccaggtgcagtggcgcacgcctgtactcccagcactttgggaggagttcgtgtccagcttggccaaaatggtgaaaccccgtctctactaaaaatacaaaattagctgggtgtggtggcaggtgcctgtgatcccagctactccggaggctgaggcaggagaatcgcttgaacccaggaggtggaggctgtagtgagccgagatcgcaccattgcactccagcctgggcgacaagggtgaaactccgtctcaaaaagaaaaaaaaagcgctcagcactcagtgaatgtcagagacatggggcagggctggacggtcctcagcccccaagctgactgctggggtacctggaaatggaggcctggcttgggggtgctggggccggcctcctgctggaaggccccgcctgtccaccttgccttcccgccaggctcctcctccaagccggcatcgacattaaccgccagaccaagtccggcacggccctgcacgaggctgcgctctgcggaaagacagaggtggtgcggctgctgctggatgtgagtgtggggcccaggggcgctgggcccagtggactgtaggggctcctgacagagcctcatctctcacatgtgcagagcgggatcaatgcccacgtgaggaacacctacagccagacagccctggacatcgtgcaccagttcaccacgtcccaggccagcagggagatcaagcagctgttgcgaggtgggcccaggcagggcagaggggcagtggctggggctggggctgggccagatcagcccgcaggacttcgggggccccctcctgtatccccagaggcctcagcggccctgcaggtccgggcgaccaaggattattgcaacaattacgacctgaccagcctcaacgtgaaggcaggggacatcatcacagtaagcatggccccaggggccatctcagcagggagggggcggcacctgggcgtgcgcaccccagaacaccctcccgccgcaactggggggcactgggcaggagactctgcgaaagggggcatctccctgagcgccccccaccttactggccaggtcctcgagcagcatccggatggccggtggaagggctgcatccatgacaaccggacgggcaatgaccgggtgggctacttcccgtcctccctgggcgaggccattgtcaagcgagcaggcaagttccaccccaccctggggggcaggcaggagcccctgggcttgggggctggaagcagcgagtgtgctgagggtgtgggggcccagcagggctgggtttctgggtgccagcgtggggttgagtggggagcatcagggtgccccagcggccgtctcctcgtccgttcccacacctattcctttatgcgttctaccaagcactgtgtgctgccatgtctggttctgaaccggccactagaacagatggggacccaactcccaaggagctcgtcctggggcaggagagggcaggggacagcgaagtaaacatgaaaggacatgtgacccggagcacagggagggcctgcttgagatgaggcagtcagagaaggccagagaatgctctgagaggcaggtgggttccaggtggcaggagccgtgcgttaaaagccggcggcgccaggcgtggtggctcatgcctgtcatcccaacactttgggaggccgaggctagaggattgtttgagcccaggagttcgagatcagcctgggcaacatagtgagattccatgtctacaaaaaataaaattagccaagcatggtgttgtgcgcctatggccccagcgacttgggaggctgaggtgggaggattgcttgagcctgggaagtggaggctacagtgagcgaagattgcaccagcctgagtgacagagcaagaccctgtctcaaaaaaaaataatgattaaaacaaaggcactcaagtgtttgctcttggtgaagaaaaaaggaaaaaaccaaaggcgctgaggcaggcaagagctgggtacatctgagtaacaggaggctgaggagagggactaggccaggggcccaggctgtgaagccccatgtggcagctgcaagggaccaggggcccgtttactgctgatggaggacctggaggttgacaggcagggccagcccccgaccatggccatctagctcctgagtgggagccttggctctagcttgtggggggcttcttgcctgccccccactccccagtacagagactttcataccgtccagcaatctctggccccctgcccacaggaccccagggccaccggcaggatgcctaggcttggctgtctctgcctctctcctgctctaaacgtctggggtgggaggggtcttccgaggggctatcagctccctggagacaatggtgggcagagaggacccccggctgtggctgcgccagtctctgtcctgcctcccctgcgtcagtacccgccatcgctggcccaggacttaggaggctttgcttgacccacaggttcccgagcaggcactgaaccaagcctgccccagggaagcagctcatcgggaccctctgcacccccagaggagatctgggtgctgaggaagccttttgcaggtaggctgggtccctgaagggcagaggtggcaggacttccacaaggcaccaccgtggggccaggcaggggccggcactggcctcatcttgctcccttgtgctggcaggtggggaccgaagcggcagcattagcggcatggctggcggccggggcagcgggggtcacgccctacacgcgggctctgaaggcgtcaaggtaggtggggtagtggccagggccagggtggccagggctgggagcaggtgacaagccggggtttctgggttgcagctcctggcaacggtgctttcccagaagtccgtctctgagtccggcccgggggacagccccgccaagcctccggaaggctctgcaggtaagagcaagggtgctgccacgcagcccgatggaggaaagcagcccgacagcccttgtcccccacccactctcgtcctcaggtgtggcccggtcccagcctccagtggcccacgccgggcaggtctatggggagcagccgcccaagaagctggagccagcatcggagggcaaggtacagggcttgggggtgttctcagcgtgggctccggggagaggctgtaaggccgatgggctgatgggtgcttacacggcctgcctggcctggcagcggcggggtcgggggcattgccaggccagaccctctcctctgtctgtcagtctgtgtgttgtgtgtgtgtctgcctgtgtgtacgggtgtcgtcattgtgcaggctgtgcgtgtgggccaacctgtgcctctgtgtgtgcgtgtgtgtgtgtgatggtgggactgcgagctgggcacgcgtgtctgtgtacaggtggaaggggatgggtatgagatggtgcagcgtgtgcatgggcacggcgtatggtgtgtgagtgcactcgtgtgccggagagctgtaagctgctggctgagtcctgcacggtggaggaggcaaggtgcccctgcctgtgggcacagagcccaccttccggtccagcccgaggcccctttcccagagccccctcccaaggggccataccacctgcatccccaagatggcgtggggcgtccctggtgcaggagcaggggacagtcagggaggcgtgtggcggacagtagcagcccccccgcccccctccccccaccggtggagatcccagaagaaggcggaagggtggaggatgctccaggaggcgcctccgggaccgcggactgaggatcactcacgggccaggctcaccggggcctgctgcagatggagcagcggacggcggacgcagtggctgcacggctggccggccaagcagaggaggcggcactgtggtggcagggcgcggccgggcaggcgagcctgcagtgggtgccttgtgtcttccagagctctgaggccgtgagccagtggctcaccgcgttccagctgcagctctacgcccccaacttcatcagcgccggctacgacctgcccaccatcagccgcatgactcccgaggtgagctttccatgcgccgccagcgccagctgcgtcccacagatgggcccagcccctagctgacaagcctccccactgcctaggacctcacggccattggtgtcaccaagccgggccaccggaagaagatcgcggcagagatcagcggcctaagcatccctgactggctgcctgagcacaaacccgtaaggccacctgcatcccaggggctgggcccaggacgggcagacagacagacagacagagaacctgcctccctggccacaactcccacccgccctcaggggcttgagggagaggagagtggaggatgccctgctagcagggagcctcccgatcagcccctgttttgtcactggggcaggggcaaggtgatgctgtccaggggtcgtcgttgctgagggagcctgaagccaggagagtcccctccccacgtccatgctctcaccaggactccctccacatgcaggctgccccacagggacccccagccaccaagcctccaagcactgccactcacatgcagactgtagggggccatgcttacggcctttgctcacaggcacccaggtacgtgccagccacacgcctggcaggtgtgcatggaacaccctgcaggcatccaccagcttgtgtgcgtgcacacatgctccaccgcacgtgtggccctcaccaatagctgacacccccattctcagcgatacctgcacacgccatggccaatcgtcattaacacggaggtgcggccgggcgcggtggctcacgcctgtaatcccagcactttgggaggccgaggtaggtggatcacgaggtcaagagatcgagaccatcctggctaacacggtgaaacccagtctctactaaaaccaaaaattggccaggcgtggtggcgggtgcctatagtcccagctacttgggagtctgaggcaggagaatggcatgaacccgggaggcggagcttgcagtgagccgagattgcgccactgcactccagcctgggcgacagagcgaggctccgtctcaaacaaagcaaaacaacagggaggtgcctgtgcagtgggatgggttccgggcctgaagaaggtgggcccaggcctagcccaactgaagcggactctctgggcctcacactgagctctgggctcccaacgggagaggcgatcggtggctgtcaaaagccacctggcgcgtgggtctgcactcaccctgccttgcctcactcaattggtggctcggggatcctcctaggggtcaggtccgggtcccacgggccttgccgcgcacctgggggtggctgagtgttcaagagcagttgcatgagtgaattccagctggaagtgtggacgcctgaatgccgctcggggagtgatcgggtgtttctcggtgcagattgctgtgggtgttggcacgtgtgtgtgttgtggctgtgtggcatgtgtgtggccctgtgatgtgggtgagaggtcagagtgtgaaacgggatggggtgctggtgcctgtgcacggctgggagcgcagcgtgcaaatcatgtgcgtgttcctgtaccaggtgtggccccatgcgtctgtgtccatgactcgggtgtgtctccccatggtgctgtactcgtggctgcctggccgggtgggaaagtgccttcttctgcccccccgacaagggtgtcctgtggatgtgggcagccgtgcgtgtgtgcgcatgtgtgcgatatgcggcatgcagtgtccggtgcctgagccgaggctctgcctacatttctggtgccaatacctcggcctatccgtttgtcctcctgtctgtctgtgccctgctggcccggtgacccttcctcctccagctccaggtagatgggcagggtgcgggcagccagcccaggtggctcctctgtgtgtctgctctgtaggctaacctggccgtgtggctgtccatgatcggcctggcccagtactacaaggtgttggtggacaatggctacgagaacattgatttcatcaccgacatcacctgggaggacctgcaggagatcggcatcaccaagctgggtgaggccccagccccagccctcgtccccagcccaaccctcagcccaagccccagccaccagccaccagcccagccccagccccgccccagccccaagctgggccccaagcccagcccagccccgcccctagcccggcccctgcccctccgcctcctggtccacctgacctgccccctgcgccccactcagggcaccagaagaagctgatgctcgctgtgaggaagctggcagagctgcagaaggctgaatacgccaagtatgaggggggccccctgcgccggaaggcgccccagtctcttgaagtgatggccatcgagtcgccgcccccgcctgagcccacaccggccgactgccagtcccctaaaatgaccaccttccaggacagcgagctcagtgacgagctgcaggctgccatgactggcccggctgaggtggggcccaccactgagaagccctccagccacctgccacccaccccgagggccaccacgcggcaggactccagcctgggtggtcgggcacggcacatgagcagctcgcaggagctgctgggagatgggccccctgggcccagcagccccatgtctcgaagccaggagtacctcctggatgagggccccgcccccggcaccccgcccagggaggcccggcccggccgccacggccacagcatcaagagggccagcgtgccccccgtgcctggcaagccacggcaggtcctcccaccaggcactagccacttcacgcccccccagacgcccaccaaaacccgaccaggctctccccaggcccttgggggacctcatggtccagccccagctacggccaaggtgaagcccaccccgcagctgctgccgccgacagagcgccccatgtcaccccgctccctgcctcagtcaccgacgcaccgcggctttgcctacgtgctgccccagcccgtggagggcgaggtggggccggctgccccggggcctgcgcccccacccgtgccgacggctgtgcccacactgtgcctgccccctgaggccgacgcggagccggggcggcccaagaagcgggcccacagcctgaatcgctatgcggcgtccgacagcgagccggagcgggacgagctgctggtgcctgcggctgccggcccctatgccacggtccagcggcgcgtgggccgcagccactcagtgagggcgcccgcaggtgccgacaagaacgtcaaccgcagccagtcctttgccgtgcggccccgaaagaaggggcccccgccgcccccacccaagcgctccagctcggccctggctagtgccaacctggcggatgagccggtgcctgacgccgagcctgaggatggcctgctgggggtccgggcacagtgccggcgggccagtgacctggccggcagcgtggacacgggtagtgccggcagtgtgaagagcatcgcggccatgctggagctgtcctccattgggggtgggggccgggctgcccgcaggcctcctgagggccaccccactccccgccctgccagcccagagccgggccgggtggccaccgtgctggcctcagtgaaacacaaagaggccatcgggcctggcggggaggtggtgaaccggcgccgcacgctcagcgggccagtcaccggacttctggccactgcccgccgggggcctggggagtcggcagacccaggcccctttgtggaggatggcactggccggcagcggcctcggggtccctccaagggcgaggcgggtgtcgaaggcccgcccttggccaaggtggaagccagcgccacactcaagaggcgcatccgggccaagcagaaccagcaggagaacgtcaagttcatcctgaccgagtctgacacggtcaagcgcaggcccaaggccaaggagcgggaggccgggcctgagccaccaccgccactgtccgtgtaccataatggcactggcaccgtgcgccgccgaccggcctcggagcaggctgggcctccggagctgcctccaccgcccccgcctgccgaacccccgcccaccgacctggcgcacctacccccattgcccccgcccgagggcgaagcccggaagccggccaagccgcctgtctctcccaagcccgtcctgacgcagcctgtgcccaagctccagggctcgcccacacccacctccaagaaggtgccgctgccaggccctggcagcccaggtaggccagccagggtggggtgaaggggcaacaggaccctgctccacctccttactcggtggtctgaggggttttccttttcttgggtttgatggaagcccaggtggggtgggaacgtgtccccagaccctctcatccatccagggctgggggcaaggtgagcagggtctttcccggtccgctggggaggaagccgcgggaggctggggcagggggcgcggcggcggaactcgtgcccgctcggtgccagcgtggtcctccccgcagaggtgaagcgcgcccacggcacgccaccgcccgtgtctcccaagccgccgccgccgcccacagcgcccaagcccgtcaaggcggtcgcggggctgccttcgggcagcgccggcccttcacccgcaccctcgcccgcgcgacagccgcccgccgccctcgccaagccgcccggtacgccgccctcgctgggcgccagccccgccaagcccccgtcccccggcgcgcccgcgctgcacgtgcccgccaagcccccgcgagccgccgccgccgccgccgccgccgccgccgcgccccccgccccgcccgaaggcgcctcgccaggggacagcgcccggcagaaactggaggagacaagcgcgtgcctggccgcggcgctgcaggcggtggaggagaagatccggcaggaggacgcgcagggcccgcggtaggtgcggggcggggcctggcgggcggagggcggggctcggcagagatgggcggggctcggcagagatgggcggggctcggcagagatgggcggggctcggcagagatgggcgtgccgtgagcggggctccgccgaggtcgtcgtgcggtaggcggaagccgacggagatgcgggacgtgggcgtgtcctggtcggggtgggcgtggccagacccgccccgcccactcacgccccttgccccgcgccccgcagcgactcggcggcggaaaagagcactggcagcatcctggacgacatcggcagcatgttcgacgacctggccgaccagctggatgccatgctggagtgaacgccgcctggccgggccctcccgcgccgcccgggccctccccgcacactgacctatacctcaggatgggcgcgtctgggcgcggcgcgagcggccgggcagggccctgcagaagcacaactccggcccctggacccgggccggggcgcccaccggggaccgcctggccgggggctccaagggctctaggcagaccctgcgcccgcgggtcctccccacctgctgctccccgtgcaatacctgctgggcctcctgcccgcgcgggaggggagggcgccccgggaccagggatggggcagcgcacaggcccgggcccagcacagaactgcccatcgggacgcccggccagccgctcgggcgcagcacaagggacaggggaccaaggtcagggcccccctgccccaccgcacccccagaatataagctatcaagagtattaatttattgggaatgagctgaggcggatttccccagagaaacaaaaaggtataactttaacaaatatatatttaaagaaagaaatattattgattctatagaaaaccatttaccaactgaaaggacacgaagtctagctccggacaaaagctgttagaggcccaggctgtctgcctgcggtccttcctccggccagagtggaggccccaggctgctagcacaggtggaaggctggggcccgggggcgggtgctctgccgggggctcctccgtgcttctctcctaagttctctgcgccccaagaactcgaggttgtgccttgctctcggcggccgtgtcctcctcctggcgtggctgcgtcccagggcgcgggtgggtttggtgaatgtgggtgtgtcagcgtggcagccacgtggaagcagggcatgtagcaggccaggccacgggcttgcagctcctctgagggtgtgcctggccccctctccaggggctgtgcaggcagcccatccaccccagtggagttcccacggacgcttctgctcatggtccaaggctgtgttgtgtggtcattctcgccctcccttttcctctctcctcctgccccctccaagaagtactgactggtctcctctatcgtgtttgctgatccacagtgttgggcacaactttgacgtttcttaaaaaaaaaatttaaaaaatgccgaaaaccagcgattgtggtgtggggcgggtggaggcggctggcggaggtggcgtcccggcgtgcagggccccttcctgctgtctcaccccgtgtttccctgcgagtggacgtgcccagctgtccccccaggcctctcctcagagggcggcacaggctgggctccagcaggtgggcaggggaggtctgggcaaggcgctgccgtcggctgtcaataaacagcaggaaac

SEQ ID NO: 37313 - DNA, 120520 bp, Homo sapiens
gacggagaaggccagtgcccaggttagtgagcagtgcccggcgcccgcttccctcacctccttttccagcctttgcacaggtgggttgccttctcttggccggagccgtccctggaagtttccccagggtgccccaaattcccctgccaccccaacctgttctgtgctccagcagttagcaacctggatggaggtggggcccaaggcttctgaccaaagcaagttgggggtctctgaattcgaactcacagctcgtccctccccactcggcctgcatttctttatgctctggcgctttgagaggtcacttaggtactccaccctgagctacccaagggactctgcagtccccttaatcactgcctgtattcctgagcctgttttctcattttgctgatgaatacatggtaaagttaatgtagcagggtagatgggcgaaaggctccctatcctatcctctggccatctgcctcattttttgtccctgactacgggggtcagaatttgagacactaggctctggaagcaacgtggtatattgccagaacatagggcccggaaagcctgctttccagtccctcccagccctgccactaaagttatttgagttctctgggtccccccagtgcccattttgaaggtggagttgtgtggaatgaaatgaaatgatagaaaggtgttttgcaagccaaatgcgaggcattgtttgtcagtcataagcagcaatgaaagcatttcctccaacaagagataccctgggttaaaactgccattttcagtggcaacacaccaccagttaactgaacttttcttgctgggtggtagagtggggagaggatttcagctgatggacaagggcctgggactccagtgtctttcttattgtttgtcggaaagaaaattgctaccctaggggctgtcccacagatgatagtcaatgtgagattacaaggtcagtcaagcctctcaggaggattaaagagacactgtggggcgtgaagaactggctgacatgtgttcatcccttagccttcctgtggggatgtctctttgcttctgttctacccaggagacctgttctgaaagtgggctcctgacacttgatggcccagattgccttgcagtcacagctgggcaaggagcagttggtccctttgcttaacgcagatgaacaatgtgaatgcttgtttcatggaagcaccttaataaatacctttcttttggtacttgatacatttctctttctcttgtaaaacacaggaactctcccatcccacctccactacctgtgttagttgcagggttttgtttttttgttgttgttgttgctttcttgttgggtcctggatcccctgaagcatgtcaatggctacatgtctaagtaacctgtaaaagagccagtgcaagttcaatggcacaacagcctgtgtgaagcagacagagagttaatgcagaaataactccagttaactgggtcaaagtataatttgaaaaattaaggacagtttggctctttgcaagaataagagtcggctaagttcgctgagcaatgcttgctagtgtttactgctgcagtcccaacacatgttttgaaccacccccttccctaaaagaaaaagctgaagagataaagagaaattgaacagtgaggagatctggggagggaactcttcttggttcatatttctgcacagaatacaaaggcaggacttcaggatcttgtaaatcaaaagtgaatatttataaagcgattcattttctgatgttctccatcacagcctgggaggccacacagatgacaggaacgccaaaggagattaattgctctctagttaccaacttttttatttgctcataatattagttgggacctaagaaaggcaaaaaaatctatgagctgttttcttgccaacttgagttatgaagcaatgctacagttcaccgaatcgcccaaccattatacaagaaaagcagccctgttgattctcgcatggggagaccctaaaaccatggtttcagaaacacccgttgaaatccatatatgaatgtgataaattggatttcagtggttaaaaatctttctcttttggaggcttggggaataaacttattagaataggctcaggaagaacctcactgaggtgggtagctgtgttaaattgttaatgaaaatgatttgtttcgaataaacgtggtagccctcaagggacagtaacattctgagtgattgtaagtgggccacaaactcacagaggggaccaagacatcagaactcaggtctttagatgggtaggaacatgtcctgagagaatttggttctttaaggagcagggaggaggtaaagaaggaaggcagacggtgctgcaaatcttgtttgatagcacagattactctatcatcagttcttccttggttatgcattcataattgaaacagtggattttgaatgacccaggcaacttcatagcatttaagtaggagctgtagcatctacttcagagcccaaagatattcaactctccaaaatgatcgttttgcattccttcaagttctttatgtgcaatatttaggttggactttctggaaagatcaatgagttcatttcccattcagattgaatctggtgtttttagaacatttcaatattttcagatcacccattggaggaattttgcaaactctaacatctgtggaaatgatccgtgactagatgtgagctacagcaaactttctgtgttccaaggttcaaaaggtttaagatttctaccccttatactgggaatgccaatctcatgttttgaagaactgtagttgttttaatggtcttttgcatggtggtgcaaggtgaacaaattatctatttaatttgcccaatttcccctaaaaatggcccatttaaaatttccattttacaatggacttcttgggggaggaatatgttggaaccattttaagcagtaaaacttttcaggtgtttaattgcatccatttgctaattacatctatcttttgcaatattagttgccaaaccaaagatccttgtagatctcatagaggacacaggagaaactgatcaatttgtacttcattccaaaaggattaaaagtagtcttgaagctaagattagttaactttcatttcagaaattgcttggtctcatgcttgttacttttaccttgtttgctaaaataaccgtttttgcaagctaaagtttcccttttctcccaaaaaaatctcttgagaaatcaactttaattcccttagaaaggaagatttcaaaatttattttcattttcctataacttgcctgtaaggacttagcctcagctttggataggaatgcaccctcattcacttgaattttcacccacaagccttgcaagacaggagaggcaagtcctttatcttgtgcaggcagacaatacttacacttatgtaaattctaggacattttttttttattctagcaggttagaagcctgagcatcagtgacctctatcatttccagaagatctgtgttaagtcttttttctgctttcttcccaacagcttgaaggttctgtcaccttttgcagtggtccaaatgagaaaaaagtggaaaatgggaggcatgaaatacatcttttcgttgttgttctttcttttgctagaaggaggcaaaacagagcaagtaaaacgtaagtgtcttgcatttggaaaataatacactttttataatttctttgaaaatgtggctataatctgtagcaattatgatttagcccaaatgtggccgtgccattattctaagagaagaaagtgaatgttactggtttatgcatgaattgataaaagaatgagagctttgaatcaggccaactaaatttggggctgtttttctgattatcatgtagtctttgtctcatagaacatatgacacattagcttattttctcttccctgttctaaactatacaaatctcattacattttacgtaactctagaaatatctgacagatgagctggaattttcccaaatttcagactcttcagcaaaggctttcagtttatgaaaaataatgacacagaaaagaaaaaaaaagaaaaagaaaagcaggctctgcctattcccttatgccgaaaaacgaggaaggacgaaaccttcctatgaactgggctcagatgaaaaatgttttgaggaaattgagattccagggaccgttagcaaattggatgccatttattgaaaagaacatccccgcaaagccagggaatatttctagaaagtcagcgatccgtgtaatgggctaacacattggagaaagcagagagtggcaggaagtgggggcgggggggataattaaccctccttgctgccacgtttaggagatttatgagtaacggtcgacatatccgttcttgctgcctttgcacaatgtgggtcttaccttctttgggccacttgcagccatctctgaggtagatgcttgctctaaatttgaaggaaaagcctaagctctagttcccctttttgacagcatcaaaaaaagcacaaaatggaattggtccaagaggggcattctctgcttcactgaacttattcatgagaaggagctgtgaaaatattcttggtaggaactgaagcagcatctgaagcccttcacttaaacctttatctcttttatcacataagttaaatagatcaggcagaaggcttgctgacaaggagaacagtgccaagcctattccatccttaagtgtgtttctgtcccactacaattttcatagtaagtgtagtcttcttcctgggagaaacagtgtttaatagtgtttttgattatgcttttgagcatgagcggtgtatggtgatatctagtatgattgggacacaaaaggaagtttagtggggcatgatctcagcaaggaagcttggatcagcctctactcttgtatccctcaaattgcttccttcttcttccacttgaatatagttcatctcagaatcctcctcttccagaagccttccttgatttaagtggatgtgacagaagcatccatgcattctcagctcagctcacaattagctgggcttagggatgaaatattactcaataagtacaatgtacattatttgggtgatggttacacttaaagtccacactttatgcgatatatccatgtaacaaaactgcacctgtaccccttaaatttatacaaaaaaatcttcctgtcttagagagaaacttcccttatagcctgttaatgatgacctcatggggaaagcttgtaactctcagaagaccatctcttatggaaagcctttcatatttatgaagaattgaatattgtccatgaaacttagacaaagaaagatgtgacttaaaaaaattacaaacccaaatctactactttctaatatttccttgtgctgatgaatttgtcccaagcccttttgatattcaattggtgccaaagtgattatgtaacagatggcctagggcaccagatctggtccagtgtttcaggcttattgtcagatgatgacgctaaggtcatggtccttcccttagtgagccactgagcatcattatgtgtgtccatgcccaagctaactgttctgaagacatgcaaaatcatctctgctaaagggaaaacctcaaagcatatgtcctatatatgctgtcttgatatatgcatgcacatacacaaacacacacaatatgcatgcacagagatttatattgcagctctaacagtgagaagtcagaagcagtggaaatgtcagttcatagataaatagttacaaaaatgatccaggtaatgcaatataatgctactattaaaaacactgtttattgaaaatttggtggccctgggaaatgcttgttaacttatttttaagtttcttaaattataaaattaatatatatgcttattatacaaaacaacatgaaagcatctgagcttcatatggaacatgtgtccctaaactctcattccactctcctgggataaccattattagtggtttgctgtgtgatcttccaaactactttctttgttttataaaattatatatacatgcctgtatgatattttattttacaaaaataggatattatatacacttttctgtgatttgcttttgctcaataatgtgtgtaggacatccttccatgtcaatacattgcaatgtaatagtgccatattctttctaatgcttgcatggtttgcagttgcataagtttgcattggtttatttaaccagtctatatttgtagatattgaggttgtttccggtttttgctattaaaagtaagacatttatgaacatctttaggcacttattcaagtatttgtgagaaatagtcgaagtgcatgttcagttttaatcttcataagtactgtcaaattgcccttcatataagttgtattaatttatgctcccaccatctatgtatgaaagtccatttctaattccttcaccaagattataatcaatctttgtattttggggccattttaataggagaaataatctgtaagttttgcttggtatttttctctttctgcagcatcttttcgattatgtactagttcaattttatttcttcagtgaattgtctatttttagtttggttgcttgtgatatttatttgttaaaaacttacttattaaccttttatattttaaatattatttttgatatgccacttgttttaatctttaagttgtatttttcccatatagaagttttaaaattttacgtagtcagatctgtcattcattttctgtatggcttctggatttcttattcctaggaaggtctttctcaccctatatttttatattttcttctactgctgccataattttatgttttacccatagttctctattccatctgaaatttatattcctgtatggtatgcaatggggaactaattttttttaaatctccggatggtaggtttatgaatgttatttttgctcacttttatgcttctgtctattccaaaatttccacaattggcaagtttcacttttaaaacaggagaaaagctctttttaaagtaaaagtacatcttatttcccatatttttactgtgcaactctagagacaagttggtatgtgagtagatgaagaaacagaggggttttctaaaattaaaaaggaaagcaactggaaaaacttcagaaaatgggtaagagtaggcctgggtcataaacccttcacgtctctccttgtctgacaccattttaccaaaagaaggcaaagttttttatcttgcaggggctggttagaatataagcttttaggtcaaggaatgtgttttgtagcctgtttgctctcctatttggggcatcacaggggaatgacgggggatgccattatggtcaaagatgctcactcaattgattcagaaatctgaagaggtgtggaaaaaacgctttgtttgtggaaagctcatcacaaggaatggtgaagatgggtgctgccacttgctggtagctaattagccatagttacaatttctcttataagagagaagacaggctcaggaaacccgaaaatactgatagtgcattgcaatggatgaatgagccatttgttgcttacataaaagtttgttactgtttagcatcagcaaggtttgagttctttagctgggaaaaggtccttgtgtataactccattatgctctgttgttaaagttgtagtcaatgaggccaggaaactcttttgaagttcaaaggagcgtaacattcacagcataatattcatgcaaatatgggataaatgggctgaagagtttgcccatttggcagatctaacttaggtaatgaactattgatcaaagtgaggttgaagaattgaattgttaagaatattcaattatgtatttctaatagaccagcctgtgccaagtctggcaaaggttctggagagagaaattgttcatgtatttcatgcagtccactcctgctttacaaggtagttaactggatcttcaaggagctagattgtcacttatttttctcctcaagagaaaagcttccaatattcagatttggctaaaagtgggcctctggacttctcaggaaaggcaagccaccaaaagattgaagggaaggaagaagatacttagaaagtttgaaacatgtgaagcccacttagaacttctctattgtgagagccagccaggaaggcatgggttttcctcctccagattctcccttggtcatttgaggtgattattgagcaagcaaatgcgtggacctgttcacatcttagaagtttaattaagtggaattagacgaaaggaatacctaaaattagatagcttaatgcttttcaaagtatattcttaattgttttttattttggtgagggggcagtaggttttgtcatggaggctctgtagttagcctagatccaatccccagctccttgacttacttatgtaccttgggaatgttacctaacctctccagctttcgttttcttatcagtacagtgggggaaataatagcataatgagcgtgagcattgtcatttgaagaagaaacgagattgtgtacaccaagtgctttgcatagtggctggcacatagtaagtttttcataagtagttgctattagagcaactctcttacaagccaaagatattatccccttaattttaaggtgagaaacttgaaactcaatgaaatcaagtgactttgtacaaggacaagcagcaagtcccagccagagctagaaccaaaacccaggtctccgaattaagtgttctgttcactatacccatctgcctcttggaattctttgaggaagtcagttcattgtcttgaatagaagcccagtcctttatacatggcagccacttaacacataagagatgatccaagtaaatgaataaaaattttctaacccaaattcctaagagggatagtatactatttgggagttaaaagactgagacaaggactaaaaatttttcaggaacctacatttgctaagccaaaggaaagtagtgaggaaggttaaaagtatgtgcgtctatgtctatgcttcttatatttccctgacttctcagtaggattggaatgtcttcatagtttaatggaaagaggactgtgcttaaagtcaagagacctggtttccggtcagtcttcccttgtttgccgtgtggtattggttgaatcattcgtgttctatgaagtaaagattcactacttacaaattgaaaagaattcttgccttctggactgaaaactaaaggagaatagtataggggctggggaggtggaacaagggaaacgaaggccctggttttgtgtacttggagcaaaccacatggatatttaatattgtcacaaggtaattgcaaagaatattttatccatttaagatttatagcctgtctgcttctagaaaggttagatacacattagagatgaaagaataggggcaagataatgtttttaaagatgaaataaaatagagatcatctgaagaaaatagaaggaatagatgtttttaacatttggtttagtagattatagcatttataatgtaaatctggcttatgcctcccaaaaggatgaaaagagaaactttgggtttgttgtcaagagaaaatttacagtttcatctacagagattattcccacctctaacccactcaagcagtattgatcctgggatgtttgaataaggcacattctgggtaaccttggtttcatagaaaaaagaattgtctggcatttctttactgatgctttgtaaaggaagaaggcaaatattaaattataattcaataaaggactttctataagcagtaaggaaatgcattccaggtactttccctttgaatgatctaaattggagaatagaacatggaaatgttaaatagatgtttaatatgtctactagactggattgtcaactatcagatgccctaagcaagctttctattaacatgatttgtttctgattttaaaaatagatgctcattgttaaacattcaaaaggtacataaaagtatagggaaaacaaaaatgaacagtaatcacaacgtgtatggataaccatagttaattgatatatatatatacttgtagtctttttttctaagctcagttatacaaacatattagtttacaaaactgaagcactttttaaacagtatggatcagggtttgtttatttatttatataaacttaggggagacaagtgcggttttgttacaaggatattctgcatagtggcgaagtctgagcttttagtgtagccatcacccgaattgtgtacattgtatccaataggtaattcctcattccccatacttcttctaccctcccacctttccacatctcctgtgtctgtttttccaaaatgtatgtccatatatacacattatttagcttccacttgtaagtgagaacatgcagtatttggctttttgtttttgagttgtttcacttaagatcaattcacaattggagtctctaaaatgcacttgtagtaaagacaacatcccatgttgtctgtaagtgaaagctgggcggtttagacacgagttgcaggatatgcaaatttgattctattgtgagaagttcaagagctcaacttttattctctaccaaagggaacaaaagtattcctgatcaaacagaaagcctcccttcacagagatttgcaccgctaaagtgctgataggaagaacagtttggttttttgaacaggcatttttatttttgcccaaagttctatgccatatgacatggaagagatgatattagcctgaaaaaatattcaggtcaggtttcatcagcttagcagcctttctgtaaaaggatctcctcatggcctcatagtagacactaatgagaatatcatcaactcccagttatttatgctaatgaaagatagaagggcacaataaattgaaatttcatggaaaatctccagttctcatcttaatggtgtcaccttgcttgactgccaaacttctttgaattatggacccttttcttttcgatgggtttgcccacctgctaataggaaagtaaaataaccacaaaacaagtagtgagagggccatgctgtgggaggcccaggcaggtgaatcacgaggtcaggagttggagaccagcctggccaacatggtgaaaccccatccctactaaaaatacaaaaaatttaggtgggcgtagtggcgggtgcctgtaatctcagctactcgggaggctgaggcaggagaatcacttgaacccaggaggcggaggttgcagtgagccgagattgtgccactgcactccagcctgggtgacagagcaagactccatctcaaacaaaaaacactcagtatataattttgggcaggtgatccagcaagtaggaaaaagctaattaacttctgaatgaaggaaaaagctgcatacacaggacggagaatgttgcttcttcatgactttctttttttctctggcgtctgcaggctggaaatgaagtcttaaagtcctgagaaaacatgaaacagagtcttcaactctagaaacccaattgtcagtgaaataagaaacgttttccccttaactactacatcttgcccttcctacattctgcttcaagtttgataaatgacagaagagacgtacttatgcctttattttttcttcactcttctagtagccttttaaagaaaaaaataattaaaaaggaatttgtttacttgatgtgtccactcatataatgaatagcagagattcatctttttttccactgaccatgtgttataatagaataaatattattgtaatactgacatgacaatgtgtctacagtaatagcgcttatcaaaaacagttcttgggaatgttttcttgattttggactggtgatgaagttactgacctttgcctaatcctgggagctagtcagtaatgattggcaaaacattgatggcatagtgacacgtatctgttgttgtttactttttgtcatcattgttcctattaacaggggcccctaaagtagcagagatagccacctctaatgagggcaagctgatacatttgaaaaatagctgtgatgttgcaggttgaaggtccatctcacaagttagttggaattcctttgggaccaaattctactctcagacaccattagttagcagtaagtcatgcatctgatttgtgctttttgtccaagatgatatactgggattttatgtgttattgattatactgcataactcattaaattctctccttggtaatgtcaacaatttttaaaatttcaaacttataagcatatactgaaattggctttatcatagtttctcaaatttggtgattgtccaatgtgttcatggtgaaattagtataattgtgctaaccactcaatattggacaaccatgctcaaacacgtcttaaaaattatggtgttccagcacttttggaggtgaggtgggtggatcacctgaggttgggcacagtggcaggtgcctgtaaccccagctactcgggatgctgaggcaggagaatcccttgaacccaggaggcagaggttgcagtgagtcaagattgtgccattgcactccagcctggacaacaagagcaaatctccatctcaaaagaaaaaaaaattataatgtttacttttttgatatgctataaaaatatcagtgtcagtaattgcagaaacattgtttaatagcactaatggcgtgaccattcagctccttgtctgccttcagttcctaaatttgctccttccaggagttgtaggtttctgtctgggtcataattagccaaatcccatgttgctgagataataagaccaatacacttgatgaaataccattatgttttcattttagatcaggtttctatcagcagttagtgtttgagtaagatatttgcatcctcaagaagcatagtttggaagacactggtacgtgggataaatgccacgtgaacaaatgaggaaagtgctgttaggtttaaagagaatgaaaaataacttttagctggggtaatcttgtcttcccatcaagatttcaaagcccttaaaagcatgagcactattttatacattatgtgttgtcactgatgtaaatacaaaaatgcaaaatagtctctgccagctgcactattttatatagtctttgttgagtattacttgacttcactacaaacaacattgatttttaaaaggtgattaaagttgtgttaaaaaggtatagtggaaaggtaatttgagaaaaggttagtaaagaatatgtggaagctctttactttccaagttctaaaaacagtgacctgcaccttaccaactacgtagcaggagaggcagaattctgtaaaggttatagtctttggttctaaagctacaagatataggtttgaattctatttccataccttgattagtcatgtcaacttgggcaagttaccaaacctctctgtgccattgattcctcagtggtaaaatggggccaataatgagacctaccttgtagggttgttgtaagaatttagtgaattcagatatgtacaacccttagagcagatcctgcctcataggaaatgctcaacaaatataacttgttgtttttgttattgttatcaccgttctcatctggctctatatttttcttgcagttggttccctggctgctttttacacttatcatctacctcctagcctttgagctaaattcggggcagaaaattcagatggctcagctttcaaactttgtctaataatactccttagaggctgaatttgggggaaaatgtaatctattggctgaaatcagttagttgggttatctgtggttttcaagaataatggtgaactcacatatactgaagcgatccatttaatagtgtcagtgaaataatctatcttaaatattttttagagaatagatagcaacttgcctgaaagttatatattaagaataccttcctcatcacatcaatatatactgtccttttggaaacagactttcctgcaagtcagaatcttaaacagtttggaagagagttttagaaatgtgcaaatgaacttgaaacccacatttgtatagcttgttttatttcagtgcttgagtagtcttttcggtggtctttatcttttattatcccctttcttctttatcaagtaagaaaagggtaggtcattcaaccatgcagaacatatagctgataggaaaacatattcagtttcatattttaaataggtaaatattatgtcaacctctgattgagctaatctaagcaagaaaaataattcagaatcaaacacataatatacagttatagcttactctgcaatgtggatttaaacctacaaagtaacttttagcttacctccattcaagttttagtggccccagactcatataagtatgaatatttatgctaacctagtaatgccatttgaaggagccaccttgtaggatttgcttccacatgtatactcagattctttctgaaatgttgaaataagttgtatatgtgaaatgcaaatcacttaagtgtttgtcagtgagactatacatttattgtacagaaacagtaactctcatcccaccgaaatggtagagaaagatgccttatttagatgttagtcttgggaaattcataatcatctctcatcagttaaatatactgggattattaaaatatttaaaatatttcttaccatgtccttgaatgttgtggagcagaagtttaatttgtatctataccaaaaaaaaatgtattgctaagatttggctgaaaaacactaacattctgccttaaaagtatgttctgttttctttcaattaataaatattttgagcacctacttttagctcacaaatagagattaatataacaatgttgacgatgatagtatcataaaaggggaaataaaaattgttactaaaatgaatatatattcaaccttgccgataagaaaaagaaagaaatattggttccattttcccttacttaaccaagttgccaaaactttaaacagtccattgctgggcattctcactcactgctaatgggaaagtaaattactgtggcttttctggaaggttgtctggtaatgtaaatcaagaatttgaaagtactcaaaacatttgacccaagaaatctacttctaagattttgcattaagaaaatacctaatgttgcaaacagaactttatatgtaaggatctttgtcataatttatttaatggaaagaaatggaaacaacctaatatcccaagataggggattggttaataaattatggttcagctgtgtattggtgtagaactatgtaattagtcatgaggtatgggtaaactatttaatggcacaggaatgttctgatatgttaatttataatgtagtttataaaatgtatataatatatgctgttaattttgtaataaaaccttaatacacataacccatggaaaaaaaagatcagaaagagcttccagtttccagtctgataaatagtgatcttggaggttgtcattcctgttgtcaaaagaaaaaaaactgaatgaactgaaaatcaacaatagatgcagtaagatgggaaatggaaataaaaggtatacatattgggaaggaaaaaacagtattacctttgttcatagatgacatgtttttctgcatagaaaatcccaagggatcaacaacaatgacaaacacactcctgttactaataagtgattattgcaaggttgaagtatacaaagttaatataaaagtcaattgcttttctgtctaccagcaattaacaagtggaatttgaaataaaaaatacaatattatttatataagcagtcattaaaatgaaacaggtgtaaattcaacaaaatatgtacagtatctatatgatgaaagctataaaattctgatgaaagaaataaaaaactaagtagaatggagagatactccatgtttgtgtttaggaaaactcgatattgtcaagatatcagtttttcccaacttgatgaatagatgcaatacaatatcagtaaaatcccagcaagttattttgtggatgtcaacaaactgactctaaagtgtatatggtaaggcaaaacccagaacagccaacacaatattaaaggagaacaaactcactacccaacttcaagacttactattaagctatggtaatcaaagttatgagatattggcaaagtaatagaaaaatagatcaagggaatgtaatagagagcccagaaatagacccaaataaacatcatcaactgatctttaacaaagtaattcaatggagaaaaaatagtcttttgaataaatgggtgctggaacaactgggcatccatatccaaaatgtaaataaatctagacatagatttcacacccttcaccaacatttactcaaaatggaacacagacatgagtgtcaaatgcaaagctaaagaacccttagaggataatataagagaaaaatttaggtaaccttggatttggcaatgacttgcttttttaacttttagtttaggttcagggatacatgtgcaggtttgttaatacaggcaaatgtgtgtcacggggggttggtgtacagataattttgtccccaaatactaagcatagtactcaataggtattttatctgatcctctctctcctcccaccttcatgcctcgagtaggccctagtgtctgttgttatcctctttttgcccattggttctcattatttagctctcacttataagtcagaacatgcagtatttggttttgtgttcctgcattagtttgctaaggataatggccttcagctccatccatgttcttgcaaaggacatgacctcattcttttttatagccgcatagtattccatggtgtatatgtgcacattttatttatccagtctactgttgatggacatttagattgattctgtcttttgtattgtgaatagtgctgcagtgaacatatgcacacatgtgtctttatggtagagtgatttatattcctttgggtgtatacccaataatgggattgtttggtcaaatggaagttctgtttttaggtctttgaggaatcaccacactgctttccacaatggttgaactattttacatcctctccagcagtgtataaccttcccttttctccataacttgccagcatctgttattttttgactttttagtaatagccattctgatgggtgtgagatgatatctaatggtgagtttgatttgcatttctctaatgatcagtgatactgagcacattttcatgtgcttgttgactacatgcgtgtcttttgaaaagtgtctattcatgtcctttatctgctttttaatgaggttatttgttttttgcttataagtttgtttaagttccttacagattcttgatattagaccttcgtcagatgcatagtttgcaaatattttctcccattctgtaggctatctgtttactctgtggatgctttcttttgctgtgcagaagctctttagtttgattagattccacttgctaatttttatttttgttgcagttgcttctggcatctttgtaatgaaatctttgccagttcctttttctagaatggcatttcctaggttatcttccagggtttttatagttttaggttttacatttaagtctttaacccatcttgagttgactttttgtacatggtttaaggaaggggtctagtttcagtcttctgcatatggcgagccagttatcctaacactacgtattgaatagggattcctttctccattgcttgtttttgttgactttgtcgaagatcaaatggtctgtgacattatttctgggcttcttattctgttctgggcaattactttttagatacaacaccaaaggttctatccaagaaagaaagaattgataaatttgacttcatgaaaattaaaaatttctgctctgcaaatgacactgtcaagaaaataaaaagccacagactgggaaaaatatttgcaagagacatatctgataaaggactgttatccaaaatatacaaagaactcttcaaactcaacaataagaacacaaacagctctatttaaaaatggaccaaagaccttagcagacacctcacccaagaatgtatacagatggcaaataagcatatgaaaagatgctctacatcatatgtcatcagggaaatgcaaattaaaataagagtgagataccactacacacctattattatagaattgccaaaatccagaacactgacaacaccaaatgctggtgaggatgtggagcaacaggaattttcaatcattgctgatgagaatgcaaaatggtacagccactttggatgactgtttggaagtttcttacaaaactaaacatacttttaccgtatgatccagcagtttcactccttgatatttaacatcccaaattttaaaatgtatgtcccacaaaaacctgcacacagatgtttataacagttgtatttgtaattacgaaaacttggaagcagccaagatgtccttcagtaggtgaatggatgaataaacttcggtaaatgcaggcagtagaatattattcattgccaaaaagaaatgagctatcaagccatgaagaaacatggaggaaatgtaaatgcatattactaagtgaaagaagccaatctgaaaaggctacatactgtttgattccaactatatgacattctggaataggtaaaactatggagacaatgaagagatcggtggttgacaggggttagggaagagacaggaatgaataggcagaacacaaaatatttttagggcagtaaaattgctctctttgatactataatagtggatacatgtcattatatatttgtccaaacccacagaatgtgcaataccaagagtgaaccttaatgtgaattttggactttgagtgataatgatgtgtcagtgtagattcatcagtggaaacaattgtacctctctggcaggggatattgataactggggacactatgcatgtgtggcagtggtaacagggggtatatgggaaatctctgtaccttcctcccaattttactgtaaacataagactgctctaaaaaattaagtattaatttaacatataaaaatacataaatactttaaagtatttatataatactttccctccccccacagtttatgggtacatcaaatttctcttcagcaactgcaagcaaagaaagaaaggagtgaaatatttaagttgttgaaagaaaaaggctaccaatctggaattctgtatttagagaatttatttttcaaaaataaatgataagtaaagactttctcagacaaaaagtgagagaatttgtcaccagtagaccttccttgcaggaacttttaacaaaaattcttcataaaaagggctaccaatctggaattctgtattcagagaatttatctttcaaaaataaatgataaataaagactttctcagacaaaaattgagggaatttgtcaccagtagaccttccttgcaggaactattaacaaaaattcttcataaagaagaaaaatgacataggtcagaaacttggatctacataaagaaaggaagaacattagcaaaataataagtgaagtaaaatatttttctttttcttaattgacataataaaggacagtttgttcaaaataaaaatagcagtgatatcttacatgtctgtagcttatgggaaagtggaatgagtaacaggtgtaataaggaatggaagggagggattgggaaaattctgttagaacatatctgttctacacatgcagtggtatagtgttatctaaaagtaaaagtggacttggattaatgtaaatgtatattgtaaactctagggcagccactaaaaactttcttaaacgaagtataattgatatgctcagagaagagagaaaatggaataatataaaatgttcagttaaaaccagagaagacagaaaaagaaaggaagacaaaaaaaaaagtaacaaaaaaactagggcaatgaatagaaagtcattgcaaatacggtcaatattaaactagcaaatcaatagtcactttaaatgtgaatggtctatataaaccaattaaaagacagagactgtcaggggattaaaaatccccaaaatccaactatgtgttatctataagaaaccactttattttaaaaaatatttctaataagttctattgtgtacatttaaggtatacaacatgatgttatgagatacatataaaaattgtaactgtactgaaacaaattagtatatttattcatcttacatggttatccattttcccccacaagagcagttataatcatattaattgaacaatttgtcccttcaagtcaaattcctcagttgtgatgggtcagattcctcaattgtgaccaaccattgcaggtgaaattcaaattttatttttttagtggttttatttttgagaaaaattttatttcacctctcccaatggatagacatttatttcaagatacactgcatcctcttattgtcaacacttcaaacctaccagctactgacatcttgaaacagcataatttgttatccatgactcctgaaagttcctcatgtcaccaacccttatatgatacaaatgtaaagatggctattcgtggaaatgtgttcaccacattgccaagtgtcttgggtctccttttgaaaagaatgttttttcacaaaagtcaacatttccctgaaaatgcagctccatcttctattggtatggtctgtggaagtcacagagactgaaatttcggtccatattatggttgataactacaatttctgttgcaaagtatgcaagcattactttgaactgcatctgatgcaacttggtggtctaggccattacttgcaaattgccaaggcctattttgggaacaatgctttcaattcccttttattgcatgtatcagaacaatatcctgttaactaatatgatggttcattttactgcatatatgagaagaatgtcctgttaaccaatatattttgacttttggttttagtatgttttagtacaaatatccagggacaaattcttcagttgaatacatccaagagacaatttgttcaattgatctgctataatctaatcatttagcaaaaattctgactacaatacactatcattagctatggttctcatgctgcatattagatctttagacttgttcatcctatatatctgctgcattgtattttttgacctgtatctcccatttccacacccctacaccaatcatagtcaccactgttttattctgtatctctgtgaagttgacctttaaaaaaaaaaagataccacatataagtgggatcatgtgatatttttctttgtgtgtgtggcttatttcacttattgtaatgcataccaaagaatattttcagctatacaaaaggaagagatcctgtcattgccataagatggattgacttggaggacattatgctaaatgaaagaaacctagtttaaatataaagacacagatgggttaaaagtaaaggaatggaacaatatatactgtgctagctctaatcaagagaaagctggagttgttatattaatttcagacaaagaagactttaggacaaggaaaattatccgggaaaaatggggggcattacatattaataaaggggtatattctccaagaaaacataacagtccttaatgtgtttgcacttaacaaagcatcaaaatatgtgaggcaaaaactgatagaaatgcaaggagaaatacaaactattagagctggaggcttctatacccctttattagtaatttatagatccatcaggcagaaaatcagtaaggacatagttcaatttaatcatcagtcaactggatttaactgatgtctgtagaatactccatccaacaacatgagaatatacattcttctcaagatcacatggaacattcgccaaaatagaccatattctgggtcataaaacataccttaggaaacacaaaataatagaaatcatactatacttttttttttttttttttttttgaggcagtctcactgtcgcccagggtggagtgcagtggcgcgatctcggctcactgcaagctccacctcctgggttcacaccattctcctgcctcagcctccctagtagctgggactacaggcgcctgccaccacgcccagctaattttttgtgtttttagtagagacgggatttcaccgtgttagccaggatggtctagatctccttaactcgtgattcgcccgcctcggcctcccaaagtgctgggattacaggcgtgagccaccgtgcccggccctacaatatatacttctacaccatactggaattaaactagaaatcagtaacagaaagctgtacaattccaaactatttagagattaaaaaccacacttctaaatcgcacatgggtcaaagaagaagtctcaagagaaattttaaaatattttgagctaaaagaaaatggaaataccacttatcaaaatttgcaggctgcagcaaatgcagtgcttagaaggaaatatatagcaaggaattaatatattaaaagtggaaagatttaaactgaataatacagactaccaccctgggaagctagaaaaagaagagtaaatcaaatccaaactaatcaatagaaaataaattttaatggctacaaaaatacagttagatagaatgaataagatgtagtatttggtagcaaaatagagtgcttttatggattgtgacattggtcatttctaaactttttgcctaaaccagaatcacaaagatattctcctgtttgttcttttagaagttttaaaaaattaggttttaaagtctataacccatcttgagtttatttttatatatagtatgtgatatggattaaggttcattttagtttatgttttgtatattactatccaaatatttaggcagcatttgttgaaagtactatcccttttccattgaattccctttgcacctttgttgaaaatcaattgaccacatatgtgggtagattttgaatctattttattctgttgatctatttgtctaacatttcgccaacaccacattgtcttgaaaacgtcagtctgttgttgttctttttgcttttgagacagagtcttgctctatcgctcaggctggagtgcagtggcacaatcttggctcactgcaacctccgcctctcaggttcaaacgattctcgtgcctcagcctcctgagtagctatgattacaggcgtgtgccgccatgcctggctaatttttgtatttttagtagaaacagggtttcaccaggttggccaggctagtctcgaactccttgcctcaagcgatttgcctgcctcagcctcccaacgtgctgggattacaggcatgagccaccacacccggccaaaaagtgtaattttatattaagtctctgacatgtttcttttgcaaaattgttttggctattctactttctttgcctttccatataaatttttcattagattaccaatttttataaaagatcatgctggtaattcgatttagattgtatggaatctataaatcatattggagagaactgatatcttaacaattttgtatctttcaatccataaataaagtgtatctctccattttttaggccttcattgattttttcatcagcgttttttagctttctaagcgaagatcttacacatattttgttagatttatacttcagtattttcaagttttgggagagctattgaaaatagtacactttcaatattcaatttctaattgttcattataaaatatataaatatgatttataaattctctatagtaactttttaatatattcttatagattttctatgtagaaaattatgtctatttgtgaatagaaagttttatttttttactttccagcatataggccttttatttgttcttcttacccaatttcactgactaatatctccaggagtagtgaagcagacatccttgtataattcctgatcttaggggtaaagcagtctcttgccattaagtgtaatattagctataggttttttgtagatgccctttatcaggttgaggaagtactcattctagtttgcagagactgtctgtcatgaatggatgtagaattttgtcaaatgatttttctgcatctgtggcaatgattacatgattttccttctttggtttgttgatatggtgaattacattgattggattttgaatgttgaactagccttgaatttccaggataagccccacttgctcataaaagtattatctttctacatattgttagatttagtttgttaaaattttgttgagaatttttgcatctatgttcttaagggatatttgtctgtagtttctgttcttgtaatatctttatctggttttggtatcagtgtaaagcttgcattaaatattcagttgggaagtattccctcctcttcagttttctggaagggtttggtagaatgtttgatagaattcaccggtggagccatctgattctggaattttctttgtaagaaagttttcaactacaatttaaattcctttaaaatatataggactattcaggttagatatcttttttttttttttttgagacagagtcttgctctgttacccaggctggagtgcaatggtgccatctcagctcactgcaacctctacctcccatgttcaagtgattctcctgcctcagcctcccgagtatgggattataggcactcaccaccatgcctggctaatttttgtatttttaatagagacagggttttaccatgtaggccaggctggtcttgaactcctgacctcaggtgatccacccacttcggcctcccaaagtgctgggagtacaggtgtgagccaccacgcccagtctcaggttaattatctctttttgattgagctttggtaatgtgtgtctttcaaagaattaatccattttatgttgtttcaagaattaatcattctatgttgttaaactaactggcatacagttattcacattgttccctttttacccttacccttttaatgtctgtagtcaatgcaatgaaaccctcttttttgtctctagtcttagtagtttttgtcttctctctttttatctataggggtttatcaattttattgatcttcctaaagatccagttttgatctcattggtttttccttattgactttctgtcttcaatttcattgatttctgctctttattattctattttttttcttattttgtcctactttttctagtttaagatattgatttgagacttttctccttttccaatatagatatttagtgatacgaatttccttctaagtgcttttttagctgaatccctaaatgatgtgctgtgttttcatttagtacaaaatactttctaatttcctattgatttcttcttcaacccacagactatttatatgctaccagcttcttaaaagtggttatcttcctgtactgggattatgtataatgtttataaaataacactctatattttatagcactttataatttacaaagtgcttcatttaatcctctaacatccacttgagaaacataatatttcacagatgttgaaaaggttatcagggtttgagtgacttactcaatgtcacacagagtaggttaggactcaaacctagattttctgtctcccagtttattattctgaagaaattgtaaagaaaggtttgaaaaataaattggaattcaccttgtgggtatttggaaagattcatagaggttctttgaagcaatcattgatatgaggcatctctctcagtttagttttaatttagatttctgattactagtgaggttgaacatcttttaatatttattctctggtatcgtttggctatgtctccacccaaatccatcttgaattgtaactcccacaattaccacatgtcgtgggagaaacccggcgggaggtcagttatgggggcgggtctttcttgctctgttctaatgatagtgaatgagtcttacaagatctgatggttttaaaaaagggagtttccctgcacaagctctcttctcttgaatgctgccatgtgagatgtgcctttcaccttccaccatgattgtgagacctccccagccacatagaactataagtccaataaacctctttcttttgtaaattgcccagttgcaggtatgactttatcagcagcatgaaaatggactaatacgttgtctgttccaatttcttcttttctgacttgcctatttctgtacttagattgtttttctattggattggttggtcctaattgatttgcatgattaaaatattccaatactaatattttgtttactatttgttcacaatatcttctcttagcttcatgcttatctgtctttattacttcaattttgatcgtcaggaaaatctgcactggactgaagaaaatttgtgtgtttattataagaggagtattgctttattttgagctagtatgatgaaaagtgggagatagaagaggatgggattagaagataaaccacttgatttggaaattcaatttaccaatcatttgtcagttgcttatgcttgcatattgcctataattgcttattgcccacagtgtactaggccatgtgatgaatagagagtaaagaataaatgttacctactttcagggactctgatggagaaatatatcatgtacaataaggcagttaacatggtatgtgctcaagtgaactgtggtataagataagctgtggctaccaaaatttctgttccagcaaaggagagtgagtggtttgagttagttgggagttgtattagtcagggttctctagagggacagaactaataggatatatgtatacatgaaagggagtttattaaggagaactgactcacacgatcacaaggtgaagtcctgtaataggccgtttgcaagttgaggagcaaagaagccattagtggctcagtctgagccccaaaacctcaaaagtagggaagccaacagtgcagccttcagtatgtgactgaaggcccgagagcccctggcaaaccactggtataagtccaagtgtccaaaagccaaagaacttggagtctgatgttcgagggcaggaagcatccagcatggaagaaatatgaaggccagaagactcagcaagtcagcttcttccaccttcttctacctgctttttctggccttgctggcagcaaattggatggtgcccatccaaattgtgggtaggtcttcctctcccagtctactgactcaaatgttaatctcctctggccacatccaaaaacacccagagacacccagatacacccagataggatacacccagaaggatgctttgcatccttcaatccaatcaagttgacacttaatattaaccatcacaggagttgtttaagcaagaattctgtaagttgaatgggagcagggactttgtataaaaattttagttcttttcgtctgcaacacttagcatattgcctgacagtgctcaaatatttgttaaatgattgagtgatgttaacatgtgtaggcaaagccaatcatagagacctaacacaatgcatcatctatcattcctataccaccaacagctctgagaatgttctgatacatccacatttcagacattagcttgcatttccaaagaaagggaacacaaccttttcaagaaaaagaacacatgatatgctccctttatcattgtaacggagtagtagttaaaattttgtattgctgactatggccttatagtatagtttgaaatcaggtagcgtgatgcttccagatttgttctttttgcttagtcctgctttggctatgcaggctcttttttggttccatatgaattttagaattgttttttctaactctgtgaagaatgactgtggtattttgatggggattgtattgaatttgctgattgcttttgtcagtatggtcattttcacaatattaattctacctgtctatgaacatggggtgtgtttccatgtgtttgtgtcatctatgatgtctctcagcagtgtttttagttttccttgtaaaggtctttctactcctttgttagatgtattcctaagtattttattttattttattttattttattttattttattttattttattttattgcatcctttgtaaaaggggttgagttcttgatttgattctccacttgattgcttttggtgtatagaagagctactgatttgtgtacattaatcttgtatccagaaactttgctgaattcttttatcagttttaggagctttctggaagactccttatggttttcaaggtaaacgatcatattgtcagcaaactgggacagtttgacttcctctttactgatctggatggcctttatttctttctcttgtctgattgctctggctaggacttccattactttgttgaagaggagtggtgagagtgggcatccttgtcttgctccagttctcagagggaatgctttcaacttttccccattcagtattatgttagctgtgagtttgtcatagatggcttttattacattaaggtatgtcctttgtatgccgattttgctgagggttttaatcataaagggatactggattttatcgagtgctttttctgcatctattgagatgatcatgtgatttttgtttttaattctgtttatgtggtgtaccacatttattgacttacatatgttaaaccatccttgcatccctggtatgaaacctacttgatcgtggtggattgtctttttgataggttgttggattcagttagatagtattttgttaatgattttagcatctatgttcatcaaagatattggtctgtagtttccttttttggttgtggcctttcctggttttggtgttagggtgatgctggcttcatagaatgaattaaggagggttccttcttgctctgtcttatggagtagtgtcaaaaggattggtaccaattcttctttgaatgtctggcagaattctgctgtgaatccacctggtcctggacttttttttgttggtaatttttaaattaccatttcaatctctctgcttgttattggtttgttcagggtatctaattcttcttgatttaagctaggagggttgtatttttccaggaatttatccatctcttctaggtttcctagtttatgtgtgtaaaggtgttcatagtagtcttgaatgatctttcgtatttcagtatttgaagatactcctgttttgtttctcagtgaggttatttgaattttctctcttttcttggttaatcttgctaatggtctatcgattttatttatcttttcaaagaaccagctttttgtttcacttatcttttgtgtcttttttttgtttcaatttcatttagttctactctgatcttggttatttcctttcttctgctgggtttgggtttggtttgttcttgtttctctagttccttgaggtgtgaccttagattgtctatttgtgctctttcagacttttcgatgtaggtgtttagggttatgcactttcctcttagcactgccttagccttatcccagagattttgataaggttctgtcattattatcattcagtttgaagaatttttaaatttctatcttgattttgtttttcacccaatgctcattcgggagcaggttatttaatttccatttatttgtgtggttttgaaggttccttttggagttgatttccagttttattccactgtggtctgagagagtgcttgatacaatttcgattttcttaaatttattgaggcttgttttatgacctatcatatggtctattttgcagaaagttccatgctctgttgaatagaatgtgtattctgtggttgttggatgaaatattctatatatatcttgtaagtccatttgttccaaggtatagtttaaatccattgtttctttgttgactttgtgtcttgatgatctgtctagtgctgtcagtggaatattgaagtcccctactattactgtgttgctgtctatttcatttcttaggtctgttagtaattgttttataaatttgggatcatggtactggtataaaaataggcatatagaccaatggaacagaatagagaacccagaaataaacccaaatacttacagccaactgatcttcagcaaagcaaacaaaaacataaatgtgggggtccttttcaacaaatagtgctgggataactggcaagccacatgtaagagaatgaaactggatcctcgtctctcaccttatacaaaaatcaactcaagatggattaaggacttaaacctaagacctgaaactataaaaactctagaagataacattggaaaaacccttctagacatttactggggaaacatgccaccaatatttcaacgtaggttctttctattttccataaatgtcaaccggctaagaaataaagagaaagagtacaaagagaggaattttacagctgggccgctgggggtgaaatcacatatcggtaggatggtgatgcccacctgagccacaaaaccagcaagttttattaaggatttcaaaaggggagggggtgcaagaacagggagtaggtcacaagatcacatgcttcaaaggacaaaaaagagaacaaagatcacatgcttctgaggaaacaggacaagggcaaaatcagaaactcctgataagggtccaacaaagatcacaactcaaagggcaaaagcagaattactgataagggtctatgttcagcggtgcacttattgtcttgataaacatcttaaacaacagaaaacagggttcgagagcagagaaccagtgtgacctcaaatttcccagagcggggtttttccccaccctagtaagcctgagggtactgcaggagaccagggtgcatttcagtccttatctcaaccacataagacagacactcccagagcagccatttatagacctccccccaggaatgcattcctttcccagagtaatccttgctaggaaaataatttagagatatcttccctacttgcatgtccatttataggctctctgcaagaagaaaaatatggctctttttgcctgaccctacaggcagtcagacattatggtcgtcttcccttgttccctaaaattgctgttattctgttctttttcaagatgcactgatttcatattgttcaaacccacatgttttacagtcaatttgtacagttaacacaattatcatagtggcactgaggtgatgtacatccttagcttacgaagataacaggattaagagatcaaagtaagacaagtgtaagaaattatgaaagtattgtttgggaactggttaatgtccatgaaatcttcacaatttatgttcctctgccacggctccagccagtccctctgttcggggtccctgacttcccgcaacagacattggcttagacaaggatttcatgaccaaaaacccaaaagcaaatgcaataaaaacaaagataaatagctgtgacctaattaaactaaagagcttttgcatggcaaaaggaacagtcaacagagtaaacaaacaacccacagagtgggagaaaatcttcacaatctatacatctgacaaaggactaatatccagaatttacaatgaacaaatcagtaagaaaaaaaaatcctatcaaaaagtgggccaaggacatgaatagacaattctcaaaagaagatatacaaatgcccaacaaacatatgaaaaaatgatcaacatcactaaagatcagggaaatgcaaatcaaaaccagaatgcaataccaccttactccttcaagaatgaccataatcaaatgcaataccaccatactccttcaagaatgaccataatcaaaaaacgaaaaaacagtagatgttggtgtggatgcagggaatgtaaactagtacatccgctatggaaaacagtgtggagattccttaaataattaaaagtagaactaccatttgatccagaaatcccagtgttgggtatctatgcagaggaaaagaagtcattattcgaaaaagatacttgcacacgcatgtttatagcagcacaatgcacaattgcataattgtagaaccaacccaaatgcccatcaatcaatgagtggataaagaaacatatagataaatagatagatagatagagagacagagacagagagtcagtatgtgtgtgtatatatatatatatatatatgtttctattgattatatatatgtgtgtatatatatatgtgtgtgtgtatatatatgaatactactcagccacaaaaaggaatgaattaacagcatttgcaatgacctagatgagattggagactattattctaagtgaagtaactcagaaatggaaaccgaacatcgtatgatctcactgatatgtgggagctaagctatgaggatgtaaaggcataagaatgatacagtggactttgggcacttggggggaagagtgggagggggacaagagataaaagacaacaaatatggtgcagtgtatactgctagggtgatggatgcaccagggtctcacaaatcaccactaaagaacttactcatgtaaccaaataccacctgtaccccaataacttatggaaaaataaaattaaatttaaaaagattttgtacatcattgtcagacaaacctgggtttgagttccatctcagcttcttactggttatatgactcttgattttccttatctataaaatgagactaataataatatctaccttatgggtcattgtggtgaggatccagtgagcaaagtatgtataacactaatcccctaataggaattctataaatacttgctatgccacttctcttgatgtataataaaatggatggaacttgtgattgcttttgaattttgtgacttggttgatgtttcctaacaggcatattctccatctccttcttcacagattcagagacatattgcatgtttcaagacaagaagtacagagtgggtgagagatggcatccttacctggaaccttatgggttggtttactgcgtgaactgcatctgctcagaggtacaatctctcatgacatgtgatttcccagtttgctcctcagcatgccgagaggctttcagtgcccaaatggccagggaccatggatgataaaatccttaaagaaagtaaagaagcagaccgatcgcactgtctcacgcctataatcccagcactttgtgaggctgaggcatgtggatcacttcagcccgggagttctagaccagcatgggtaacatggcaaaaccccatctctacaaaaagtacaaaaattagctgggcatggtggcacatgcctgttgtctcagctagttgggaggctgaggtgggaggatcacttgagctggggacttctaggctgaagtgaaccgagattataccactgcactccagcatggttgacagaacaagaccctatctcataaaataaaagaagaaagtaagaagacgattgcaagaaaaataaacattttctgtcttctgtcctctcttgctttttggcttgattttcatgggttctctgaatatttactatggacagatatttatgatctcttagcctaatgatatagggcatggttagagaaggcagaagagcctgatagtgggagtggaggcaaaagctcaatagaatgtttagattgtaagacaaagtagtttttgaaaattattttaaggctgacctttagggagaatattaggacaaattataaactggttcattgggagagtggattctatgttgtctcagccaataactgtaattaagactgagtttgtgaaacgttggcctgtacctcttaaggattagagctcccttggcttagccttggctcttgtccagtcatttagaaaggattttggttggcataaatgccatctttgcaatagataaagcaggttgttccatcttcttcccatggtcttgacccaggagcacagctgtggtccatctttctcaacaaacctctgccattatatgttaggctagagtttcttgtttgcactatagatatttgtttgggggctgtcctgcgcattgtgggatgttaagcagtatccctggcctctacccattagacaacaagagcaccaaccccaatcctaataaccaaaaatgtctccagacatggccaagttgcctggggagcaaaaatcacccctggtagagaagtggtgcactaggctaattggaaagggaggccttgtactaggcattgagaattctgaacttacacaaagaattttcaagaccagcttcttacctgagaccttttgtaaggactgcacctcttccctcatgcccagctagagcaggaacaatcacttgcaagcctgatccatttaccatttgaacataattttgggctgtcagaattttgagcatgtggaaacataattatcaggtaacatcaggcagtattaagaggctatgaggttctagaataaagacagaccaagtttccagccctgcctctgccacttatgagccactggacaagttacctgacctctgtgatattcattcatcttcctctttttataaatgggataatgatattaccatttcatatggttctgataaggattaaatttacaaatccatttaaatcatttaaaacaatacttagtcttggtaaacattcaagaaatgttaacagctgttattgtcatcattgttgtccttatcattgtggttatcatcatcatcgttattattattaatctattagctctagaacagaattcagtatatagcattaatgaggattcactttagacctcagctgggaggtgtggtttctgatgtgcttcagtgatctcaattcaagattataccacctgcctctgaggagtgtgatacctgaggagcttctgtggtgttgccaaatgcaacactccaaaaaaaattattctagaaagtacacaagaaaaggaaaaggttgggataaggcaattccaatttggataaaagaagcccgcctctttaaatggttagggcatgtattaaatagatcatttggggattgattaactgcctgggatggcctgattttgtcggattcttgacgcgacacatttcgacacgttggagatggacagctaaccattgggagctgaggctttgatgtctgcaacgcagtcaaaatgttaaaatgatcccaatgccaacagctcaagcacaaggcattttctatttctatatcctcttcactactttcttcccccacaacagcctgacaaatacaagtagcccttgctgcaaatgatttatggatggaaaatgtaaatgaaaaatttatttccagactatgtctttgttctagaaatggttgtgagctgtcagagcgaggggtcttgtaattgtaaatcaggcagggacccagtcgccccacccaggcatactacctaatcagctaaattccaaactctagctcgtcctcagaagaattttggctaaaaaggaaatgagaagaatcacttggcccactgggccaaggcagatttatatggaatccaggatccacctgctagggatgcctccttgcccagggctgggtagcagctcaggggacccattgctcattgtgtctttcatgttattggacaggtgattatgaaatcagagtaggttcttggaaaagacatgcagctagagctggggaatggtagaaatgccatggagccaggccagaagaagcctcccacaattaatgggaagctttgaaaattggaggagtggtgatctcagccttagaaaaatatgccaataaactatcaaccaacccagcagaggtgctggtgatgagaaaaggaaagaaaatgttgaatgcattcagcttcttgggaatgcattattcactgcctgggtgagtccctgcatgactgtttcccaaactggcttgatcccagcgacctttgaaagacatttattttttctcattgccttctctttttcagaatgggaatgtgctttgcagccgagtcagatgtccaaatgttcattgcctttctcctgtgcatattcctcatctgtgctgccctcgctgcccaggtaaagcaatttgtctctttctttcctagctgtggttctccatttccctcttcacccaactcaactcatctccataattccccagaagggaaacttccagacagataacaataggaacctttaggcagtccaaactggcctctaaatactttttatagcccaaatggggtacattctaggctctaataagttattgggtacccagtaacagatttttattgggcttttaatcatttgaaggtgggtgtcaatcggagatggaaattgtggcccagagattttctgctataagcagcctcttcctgccatgggcagcaggcaccaggagagttgcagcatggcggcatgtgtcttatacaattagtgctggaattgcatccgagcatagcttctaaattatgagggggccattcataaatcaaaggagctgacccagtgaggtttatgacagtataaagctgcctgcctgctgaatagtcacctcctccagactgcagttattatgtacacattgttaagtgtaattctaaggggcagccaggcagagaatttttcacacaactgttaggacatctactttcacgatttgcagctacggtatttgtctgaggcaggggctccctcaatgacactttgttcatgtctgactggggcccgattcccaccccaaaagcgtgtggagtgattcagagaatgcctgtgggcccagtggcaatcctagaaaaagctacttgacactcttgggctttgtgaagtagaagccttatcatcctgtaagttgattccatttccctttagggtagaaattcttgaactagggttcctggatgggcttttgagggtcagagaaccctttaaaattgcttgcagtttttggtgtaactatgtatatttgtaaattcctttagagaacatccgcagctttattgtcagtcccaaaggggtgtacaggaagaaccactaccccagctaaggtatagacggtgctttttaagtggtgaggaacttccagaacttataagagagaaaccaaatgtatccaggcaaaaatgttaggaataaggctgggaatggggttcaatgaaaacccagtcaactgaaatgttccaagagtggagaatttttttttaatggagaagaaacacccaaactctttttgtcactacctttataaaatatattttcctgcatcagtaaatacaccctaatgaacacaggtgattcatttccagatggcagaatatcatgccatatcacaggtttttaaattctgagtgttggtgctgatagtatatgctttgagatgtcagagattgacttggcatatgaccaacctaaaagttgttgggttttttttggaataagtccctaagccaggcttactgtttctgtatgtgtttatttgcttcttcttcctaaactggattgcaagaatgtggtatgggtgggggtgggggcgctctggtaaatgggaacaatgtttctgataaagttgccactctggagagcttctttgttttttttttttttgtttttttgttttttgttttttgtttttgttttttggttaacctgccaggtagcctgtcagacagccttataaaagctttttattcctcagaagtctccaaaagtggtctaatgtcataggaacttatctaaacttctgtgtaaagattgttcttccctgggaagaaggttgaggcatgacccagacccagagcatggggcaaaacaacatagaatagaatatggctgcacctaccccagctgcctaacaggaagcaagtattgagaaaaagggaaagtataagctagcagttattttgagagaaaaataaagtgttaaaagaactgagctcaaaaattccagaggtgaaagcgttgaaagaaataaacaccattatggttaagacttaaaaagctcattttatggtatggaggatagaaataaactattccttttcttttccttcttgctcttgcagctcacttctccatgagttcatttttcttcttgttaactataacctttaacagctctttctgtgggtagtagttctaaaattccttagtccttatatacaaaaaagtgtatttattttacaaccattcttgaatgataatttggctgggtatgaaattataggtgcatgttcatctcccctcagcactttgaagatattactaaatggtttgttggctttatgtttgtttatttgtttgtggttaagaattctgctatttgtagttcttttgcgggttcttcgttttttttttcttctagcttttaaaactttcttcttttcattgatgcacacaatgagatgtgtaagtttgattattctcttcagcctgctcagcacatgattttttcagccaaaggagtcaaatttctcttcaatttttagtcagttttttttttgaaaattatctcttcaccttcttattttttctcattctcaaaattgtctttggtgtatattattgcatctcatttaatttatcctttatgtctcctaatgtctcctttatttttccctcctgatattctccctaaaatgatatattacttcaactctgttctccaattcatgaattctttccatgcatactatttaggccatgtgttgggttttgtttgtttctttgtttattttcaataaccttgtttcccctcaggttttcaagttatttaaaaagacatctacatgatgctaatttataacctgttattgttttggggaatcttattctcttttttacttctttaaagtatttaaaagtttatttgaagtccatttcagattgttcaaatatctaaatatttttagatgtgaattgtcacctttgttgggtttcttgacagcttttcttagttctgaattttccttggttttctactttttctttcaaagctcattatccatgggtgttttgggtttgttttgtttgtttgtttttgtttttgttttttcttacatgagcccttctttgtgggatggttgttgcaggctttatagttcactttgctctaaaccaggtcatatattaatgactcggtttgggctgcctcatgcctgaatggtctatttctacctctgttttcttgtgcactactagtctctgataatgatcatggactgatctacaactgcctcatctacaactgcctaacttggacaatcagtgttttttagggaacactgagtggggagagctatgtcagcccctgtttacatgcgagtagtgtgaccctagtccccaacttcacatgggaagccacttgcaagctgtagtttctcctcagccatttggatccaaactatccatattcagtcccagctgctgatggaccatatggctttggctcccatttattgctgtactttccttctatattttattccacgaagagtttttttgtgtttctgaatataattttgcagttttcacgttttatttatttatttttctagttccacatttcatctctctttgttttgaaaataacagggagatttctcatgtgttctctttgccatattgaaccagaatgcaaccagctattctttctttctactgaagataaaacaagagtaaatagctttaaatcatagcagagaggagtggagcttgacaaaaggaagaactttgaacaccgtggctgttaaatcctagaataaatgactaaggataattttagtctctttacttaatatttctagaaataaaaaggtacccacccatctgagatagagttggcacagtcctgctttgagacagggcaatggatgtgatgactcctctgtgttccttccaccccagtgattattaggcatgaggaaactcatgccttcagggccacagaaatgtttggtcaaagaaaagggctctggttttccatcttaacccaatggaaggcactgtgatgaaaatgtcctcatttaagaagaaaatatttaaagccaagatgatgaataagctccgtataaaaagacgacaaataagcaaactgtataccccagatactggctttacatactgtcctatagcagtattgatttagagaagcttttgcctaggtggtaacagactcagtggaagtgtcctacctatcatgcttagagcttagtttccattgaaggagacagaggagccatctcatttcatttgtttatgtatttcccatggctcttgctttctaaactcgttacccctaaaatttccaaggagcccacctgtatttgaaattgtctcctacagctcctgctaaaccgtggaaatcagagtatgcaggcagctcttccagaaataccagagagaaatctatactgattcccacaaagagcaaataaattttttttcatcagcacttgtccaagtcttggcagaggtcaagtcttagtcacataccacagtgctctactgggcccaaagaggctacatggaggctggaacattcttaatggaaaagtcaagactgcataggactcatgaacgtcattaaattcatcctggtctctaagcaagactctgtggagtccctgataattaagagattttagtgatttgaaggaattaaattccctatcttctcttttgggggaatgaagtggtaatgctggaagggaaagtaaaacaacatgacttattttcataatatgtgtatgtatatatttcataatatatatattttattttatatatatgcacagagagagaattttatcacaaaaagaagaattttatagtgatcaggagtctaaatcatgatattatctaagagggctttttaaaatggtcattccactgagaatttgctattcagaattaataaatttgggttttcctggaggtattccagcattcctgggttattaaagagctcttataaaattgccaaaataactgatttgatctggttaacagagacctaatccacagtgtttccttttggctaggtgtgaaaaagtttggcactatgaatggttttaataggaatagtgacagtgtggtttgccaagagagacaccccagtcttagatattcaaggtaggttagggaaaagaccttaccagtgttgcactatagtatgtgttcccataaggagaatgtgggaagccctgtgtcatttctctttcaacaatagttgggttgtgagtgagctagcaaacacaggcatttctgccacaatacaatatgcacatatctgaaaatcctcacattctacaaaattgtacactgaaaaatcacagggcttaaggaaaaagtagcattagagaaaaccactcaaaacttaggcaactttgtaaccagaatattaacaaagcaactatactaatgaaatactaacacagtttaaaaaggcatcttacatttctaataaaatattacagtaaatatagacttctagacttcaccttttaaaatggtaacattagcttgaaggaacagtgtttaaggaaggattgaagctgctaagttatagagacaacagtaaattgcacaaagatcacggagaatcatgtaataagcacttacaagacagagcatgtggcccaactgaggcaagaggaagaatgtagggcaaatggcttcctgatttcagttgagttagtgtacttggcttttagctgctgtcacttggtagtgcaaaatattaatttgctgggtaatcatgtatgaactaatgcaatttctattttataccaacttcattcccttatttagcactcacatatgaaccacttgtgttacacaaatccacactatagcacagactgtgtaagatgaggtgggtacatggcatttgactgtagacaagtttagagtaagagttgaaaatcacttgtttactctgaatctgcttttttttgtctttaatcactgacctatctgcccttgtgttccccttttctcccatcccatgtatttatattaaaaaggagtctagagtctaggtctatgactatgtctgtctatatctgtgacttccacagttacagtaatcaagtagacaggccttttgtgtttcctccagtttttttctagggaaggttcaaaagagagatttatttatttattattgtggtaaaagatgcataacataaaatgtatcattttagtgtataattcagtggcattaagaacatttacaatattgtacaagtggtaagaacatttaccactaatctagtttctgaaatttttcaccaccccaaaaggaaacctattacacagtcactctccattccccttttcccctagcccctggtaaccatgaatctacttctctatggatttgcctattctggacatttcacataagtggaatcatacaatttgtggccttttgcatctagtttcattcacttagcatagtgttttcaaggttcacccatgttgtagcatgtatcagtatgacatttctttttagggctgaataatcttccattattatgcatagaccactttcgttatccattcatctgttggtagtcatttgggttgtttccaccttttggccattgtgaataacgctgctacggacatttatatacaagtttttgtgtggcatatgttttcaattattttgtatatacctaggagtggaaattctgggtcttatggtaattttatttttaatttattgaggaatctctcttaaattttaaggttgccccatcttcttttagttcatttctttgagtacctactgccagccatcctcatggttgctgctgatttgctgcttttgccaccatccatatctgatctccattgctctcttctctcttctattctcttctgaattctatattcgtttgtctcttggattttatcaaaacagatcaattcctttttaacagtaacagccaattagcatattgttttccctagtaaggtgactacaatagctgtagtgtgcaagatgatcaaccaggagccactcctttgcctgcaaaagattggtatatatattacacataataattacatatatatatatatgggtccagagttatccaaaagcctgaggattctgaaatgttggtgtctgaatagcagatattttgctttattattattattactattttaggttacagaggggctgccaaaggagatgttcacttttgatcactagaccctccatgtccatactgactgttctcttagacccctttaaccatcttccatgccttatttccactatttttctcatactgttggtccttggacacttgacacagtacaaggggttaaaaccttcttcaagaaagtagcatttgctgggtgcactggctcacgcctgtaatcccagcactttgggaggccgaggcaggcagatcacgaagtcaagagattgagaccatcctggtcaacatggtgaaactctgtctctatttaaaatacaaaaaaattagctgggtgtggtggtgcatgcctgtagtcccagctactcagaaggctgaggcaggaggatcgcttgaacccaggaggtggaggttgcagtgagacaagatcgtgcctacccttcccagcctctagtaaccactattctactttctgtttctatgagatcaacttttttagcttccacatatgagtgagaacacacggtgtttatcttactgttcctgacttattttgcttaacttagtattttcaagtctcattcatgttgctgtgaatgacaggatttctttattttttatggctgaataatactccattgtgtatatataccacattttctttatccattcttccgttgatggaaacttacgttgattccatatcttgctgttgtgtgtggtcctgcgataaacatagggatgtagctatccctttaatacactgatttccctttttttggatatatacccagtagtaggattgctggatcatatagtagttttatttgtagcttttttaagaagcctccatactgttttccatagtagctgtactgatttacattcccaccaacagcatatgagttcccttttctccacatcctcactagaatctattacattttgtctttttgaacataaccattctaactgggctgagatgatacctcattgtggctttgatttgtatttttctgatgattagtgatgttgagcatttttatatacttgttgtctatttatatgacagagccttgatacattagtacccattatgaatctaccagagaggtatatgggatgtaacattgtctaaatttattcagccataatacccattttttggaggcactttgcagaattagggttctttgttatgtgcttcaagaagtgttgtattttgccattcaatttctaggagcaatgtatgttatagcaataagctattggtatatacagtatcttagtttggagaagtttgttagggtagtaggcaattttagcacaagaccctaaactagtactactcaaattttaacatgcttaaggatcaccttgggagatttgataaaatgcagactcccagaccctacaccaaaaatcctgaatcatttaggctgcagtgggtgtcatgcatttcacacaagcatcccagttaattctgatgcagtcggattgaggactgcactacagtaatagggcccaggggagattttgagaaaggaggtcaagagaactgcccacagaaagccgttctgggtaagatcttgcagcagtgggatctccagagggctgtgggcaacatgacaacattgtttcgctgataatggagcacatagacactctggaaacacattttccttgtgtgacatttccccaggactaaccctgcagtaacatgtgcacaatgtgccatctggcctgcccctctgctttcccagagctcccacccaaaggctgcctcttctgccatcttccacattcagagtccttggctgtcatgtccagaaagcaagaccctccgtggggagcttccccctctaccccgcccattgttcatgacttgttgttggcgagaaatgaatggcatttctcggaattagcccaggaatttctgctgataaacaaatgaaactctcaaagggaaaagcaatcaacatagtttgaaataaaatcagtgttttcagcttagtctgtttttaacttagtttgaaataagagtcacatctagggtattttaaggaaaggattagcaaaatgtcctgtagtgggcttttcatctgagttgccagactgacccttgaaccagggcctgttttcttcttgagtaagcagaagaggcaattattaccttgatttcctgtgacctgtgattctgagacctgtccagccatcggatcagctttgcccaagcccacccccacttccctgccaagttgcctgacacctgaaattgtcattacagcttaatcttttaaatttaggccttgtcctgataaattcaccaatctttgaaggtagtaaattaactcttattaatcatttttactttcgtctgaacacaggatttagaaagcagattttgattgtagaaagaggagacaggtgttgcggggggaagatcccgaggccactaagctcagctgggcacctgaagagttacaaagggagaggggcctgttgaaggaagggcctaaggagtcaagctttacctaccccaaagtcctgcagaacaccagtagtatttaggataagttctttatttgtagcagaggacacagtggtttctagaatgagttgccagctctcaagtttttcactttagtgttgttaatttaaaaccaatatgttctcaaagtaaccagatatccttgctatctgttgcctagagccaaagagttttacttcagggttttggacttaaaatgactgtaacccaaaaggtttgccagattatttgcagccactaagataagcaattgtctttattagaatgatttttgtctgatttttgtgtttagaattttataccatcagctattccctaaaagtgattttaggaactggcagacttagggtgtcagttattgaaatctgttccaaaatccgcctcctcacaggactccatttttggccatcaaagtagtctattttataaatgtcttgatgtgttgtcttttgtctttgccacatatactctaagacacagagactgggaagtggttcagcaaatatatgtatggctacttacaaagtgttttctagagttatgctcccagaattggagataggctaagaaatatatgtactgtatctctcagtaaagggctaaatcaaagctgtctgcaggagggggaggaagagggctgcttggattttagtttaattgagaagacagagaaatacgtcaaacttgggagttgaggttattttttggaacatgaagataatgtaagtgtccccacaagctctttttcttttcttcaataaattcatcctgttttgatttcttcacattcacaagattgtgccctcagggatctaaggccaaatcagagtccacactcactatcataccttttatataatatattcttttattattttaatagagaaatggatattgagaaggagaggacaaggaaatgtggcatgctttcttccttgttttctttctttgtttcccttctttccttccctcattccttcctttttattttcattctcttttttgtttaatttgtgattattttcttgtgctaaaaatccataacataaaatttaccattttaaccatttttatgtgtacagttcagtaacattaagtgcattcacactgttgcacaaccatctccaccatccatctccagaacattttcatctccccaaactgaatctctatacccattaaacactaactcctcactttctacttcctgtctctatgaatttgactactctcagtacctcatatgaatggcattatgccgtatttatccttttgtgatgggctttttttgcttagcataatgtctttaaggttcatccaggatgtagtgtgtctctttttcaaatggggaagagagagaagaaatttgagaagaggctggtggtagaaatgaggaagtgaagtcaggagacaaccaaagagtcttagaggaatctagcaaatgttgcttttcagaacacattttttctggaagactccagagaccacactgtctttgaaaatgacaggcctgacaagcagtaactagtattactgcctgtgtgaaatgctaggttttgaaagacgtgttccttattaatgttccccagggaacttcagagagtgtcatctattaggagctgattactggcaagttttgtcatctgcttttggagaaatccataggaatagaacagtacccctgtttctctttatctggagaagtacttttccaaaagggcctcttctgcgattgctttctgagggaaattgtgtctggagccattcaacatagctttattagaaagattattaaaggattagagtatgaaacctatgaggtgatgttgaaggaaaactgtaattactgaaactggtgaaagaaagacaggggccttcaccaagtttcagaaacataaatgggtcttagaggaggctgatcagctttctccttccacttccaaagggggagaaagagtagaagtgagcttcagtataaaaaacttaggcacaaaaaagtagttccaggcatagataagggaagctgaagtcattttacagtcaatatattatattaatagctcaggctcaatgctgagtaaacacaagacacacataaatgcacaaacgcatacaatatgattccattaatatcaagttcaaaatagggaaaagtaaactatattgattatggatgtgcataaatgtgataaaactacaatggaaagtgaagaaatgattatcacaatagtcagcatggtggtgagttgacctccattggggggtggtgcttctggggtgttggcaatgcactctttcttgatccacgtggtagtcacatgggtgtttgctttgaaagcatcagtacaactctacatttatgttgtacgtatgtaagttatatttcccagtataatataaagtgggattacattttcatttgttcttgatggttctgattggaggcaaaagtaccagaagaccttgcaagattacaaccaagcataggattctgtatgtgcatatggcaatttgggggactgttatatttgtctacttgtttgcattgttttggtcttcttgatgtttggttttgtgtgtgtgtgtgtgtgtgtgtgtgttttgttttgatttttttttttttggtttttggtttttgggtctttttgtcacaaagaatagcagtaccaaaacctagagaaaggtgtgctccttgtcctctaagtgggctcttggaattagtaagtaggcatttgaggcattgatttctaagctgtagagtgcacagtgtattggcatctggatgaagccatctggctccaggattttatcactgaccagagggccagagggcatgtttggcttccaggaagtcaggctggtcaggaacccctttgggaaggaagaagggctttggacctgtggagtatgcctgccttccctcaaagtgaggttttattgtgttatcatggggggaggaaggcagggggggccaataaagagatggggcctcgctctgctgtccttccagttcactgtgggacattcacagagctgattaacctctttgtacctattttctcagcttgtaaaatgagatgataattcctgccttctcttaaagtttgcattgacagtgaacaagaaagttgatatgggaaattgctttgaaaagtataaggaggtatatataatcaaggcagtgatcagcaatgaaaagaaggtatttaaatcctgggtccccagatttcatctgggcatatctcaatatgggcaaagcctgaaaccatagcattttggtacgtgttcctctagatcccaatgatagcagcctcataaccaggcattgaccatgtgtctccagcctcagggaaaagatgaggggagtctaaaggaaacaagtgacaggtttaatgactgtcaggcaaaaggcattaaattaatggcatcacctctgccttgcctttctatttccttctgattagattttcagaggtgcctgtgtgagtatgccgcacaataatgctgatgttctcaaagctgagtgagctcttaacagaaacataaggtagtgctgagaatgcactcagagacaaggtaaaaatctctagactgccttgagaaattgaaggggatttttctgggggagggctagaactgatacctcctccctcctaaatcataaaaagagagagcaagattcaccattatgtgttgattaggctgccttactcctgtttggttcctaccttctgctaatccgtggtcttgctagaggctgtcatctggcgcctcttgcaggagcacagtgtgtccgtactgcagggggcctctcagaccactgggatcagggaaatgagccattgctgtagtgttacttccaaaccagggaggatcagcacacacacacaccctttctgcccccaccaacttctccagggctttagaaatgtctgggaactgttttgttcgtcacagtaatgggaggatgtcattggcatttagtgggcagcaacaagagatgcaaaatgttccacaataagtaggaacacaacgcatggaagaagtgtcccacacaaaattccagtggtggctctattgagaaatactggacagcagccttagtcagagaagcctagtgaagggcgtctcttcctaaccagaagttggtggtatgagtccacacattcattaattcactcactcactcatattaatttcacaaacatttacagagtataagctttgagacatagcccatgtatggtgctgaggtttcagagttcctgcctcgacgagttcacaatctagtggaggagacacgcataacaagattattaaaatgtaatgtgatgagtactctggtagaagtgtggacaagggctgtgcaggcagagaggggagaagataggcactctccaagagccaggaatcaggcacagtcccagaggggagtggacatttgagctgggttctgacagatgaatggcactttgccagatgtagaagagggaggtggggagggcacgtgcagaggcatgtgtgggatccgtgactgcagttgagtatggtctgtgtaggagggaggaggctggaaatgtcagattgatggaggcccagtctcaaaggaccttgtacatcctgtgggtagacattattttgcagagccagcccactgcaaaagtagggaggaggtgcagtttgtctttagtgttcttggatgtctttttgcatcccctttcctctcttgcagtccctcatatcctcatctctctcccagccacttacaaaggcagctgatgagactccttccagcagaaaggtcaatgcttagcttaactgtaagaattcactaaggatagatttctggatgtcaaagggagagtctttgggcagagaacctggaagaactgagcactatggagatagggcagaggagctttgttcagtttacacacacttgatgtaagtgtaagtgtatgtaagcgtgtgggtgagcatgtatgttggagtgggtgacattgtgtggtatgtatgtgtgtgtgtgtgtgtgtgtgtgtgtgtgtgtgaatgagagagagggagaaatgggacaatgatagttcctatctcaaaggactgttgtgaggattaactgaattaaggtatctaaaggagttagcatagtgccctgcccatagtataccctcaataaatgcaaggtattgttggtattattttagaatgcagggccagaattcagtctggagaagggggaacatgcttactaccaagatggagatgaagattttacactaaggcttagtggctacgtctggctagtttcaaatatgtgcctaggacacattctatcactgggataatataatttttcagcatgttggcttatcagaatgtacatgttcccaagtggagccatagcattacactgtatatatttgggtactttctccatctctactcatggaacacatggcaggtagaaagctgttgttttacaaatgacgtggacctgtcttgaggcccagatcagctgatctgtcctcatgtatagcaacataaaatagaagaaccacagcactagggccagagccagggagatgcattagaaaggaattaacttgggaggatctgaattagggaacaaaagtactagccagagaaggaaggaagaagcaaaaagggggaaaaaaatcactaaaaggacaggatacataagatcatccagctgcccccaaactgaacttacaatgttttctgtgttctctttggaagaggagttggcttgtccagaattcaatggaaacttgttgattgacactgaattgggcacaagttcaatgtgagtgcgcctgcagctatttatttgattttttaaaaatgcaccctttgcagtaagactgtttagtttctactggcgccctggggcagtgagtttagattgttaaaatagcagccattaacactctctgtgttatgacactgtccttcctaccccactttagaggaatcaggcatgaggttgtttgacaaaagtttaattctcctctccccaccaaaagaaactgagattcctcctctgagtcagaggcacgtttgcccagccctaaccctgaaaacctccaagtctgcctacccgcctcaccaccatccccacaaacacacacacgtgactctcatgtacatctggaacacacacactttcacatacactctcacaggctcacacccacacccatcccacaagctagaggaaccctagggagcccttgtgcttgtcttgctgttcttttgttttgctttcctgtatttgctttgttttgatttgaaatcagtctttgggattacattggataattttttcatgttattaatagtgctgtgcagggagcatgtaaggacttcctcctcagtcctggccatgcttgcttccccaaatacaatgctgactctcattgatcaatcaaactgatctttgtcagactttgcatacaatacctcatgggcaaatagctcagggagctctaaaagatgcctgaattctgggattatctagattattcatgagtctgcttaaaaggaaattttttaaggcaggactggatagctatggctttcccaaaggccctggggaaaaatcaaaggagcagagacaatgtggaaagtgtggaactgctcagctcccagagcaaggcaataatctgaccaaacactaagcccccacccaaagtcagcattggtcaggctgaacagccatcatgagcacaagcctaggaggcatggaagggaagttctgtgttctctggacatctgtgatacatgttgtctataccagcactgtccaatagaactttttgcaatgatggaaacattctatatctgcactttccaatgtggcagccattagtataggtggctgttgaacatttgaaatgtgactggtgtgagactgagaagctgcattttaaattggatttaatgttaatcggtttaaatatgaatagacatatgtgactagtggttactgtggtgtatggcacagctttatcccattcgctggatacttctgtgcggcagtgaatttaattttgtacctcctctctgttcagtgtcttgcaactacatcataaactttttgagggcaggaatcatatattgtacaactacagaaagttataccttgaaaagatattttttttcagctgcctctccccatatttgacaaatagggagactgcgaaagactctgtaactttcttgaagtgacagcactcattagtaacattacctgagcctggaacccaggtctccttgcctcccggactgtgcttctaccacatctcccttgcagacaagttttcgaaagaggaagagttttcttcctctccactttcttcactgtttatatctgagattcagcccctgatacttggaaataatttggatctcaagtctacatttatctcctcatctgccaaggcacaaaataggctctggacaaatgtctgtggggtgaaaattctctgaggtctttctgttgtctgttatcttctatatttttaaagaaaatctttttctgcctcagtgtgtttgagacaaccattacttatgctgtttcagcccagggagatggggcctctgtagatgtggccctggcctgtgcaggtgctcaggtatacattagagaagcctgtgcaacagcctggcaggctgataaaaaagctgtagcagtttgggacctgggcccctctgtcttctaaattctctagacttgatggtagacaaggatgccatcagacatagcgccctcccttcaccacattttcatagtaacctagaactaaagatgcttcagggaggagtctagggccatatcttactggttactttagaaagtaagagaaaatacccagtagaaactaacctcagaatcacctgctaaaagaaagaataattcaacttgtaggtccaagtaaagtatcctttcatctctcttctcctttctctgttttccaccccaggcctttgccctcaacccagagccaacctatggtaacacagcaatagctgaattgaagcaaaacctgttaacagtcaccaaaggctgagtttcggccaagcagatagctcctccaggcagcccttcaaaagccaggcagaggcaagggggtaaatagcctgtggcctatctgcagtagaatggccagatggtttgctggtgccaccaaatgaaggagtgatctggtactaagatagaaggcttccagggaccctcccagccctaaaaatcttaagcccaagtgtagtcatcagatgccaaggacactggagaaagtctttggagcatgtagaacaccaagccaattggagtgcctgctaggacagcacaggattcctagaattccggccacaccatatacacccccacccccagagggcagccagtggccacagcagaggccttacccagcaggctgagaccctcatcagaccctccaagagcctacttccttacttagggcctgcctgcttgcactgtgctgagttcagggaggtggacaaactgtacctcccactttagcctaagaatctgacttgccatggactctccaggcagtgaatcattttgagcaagcacttaagcaactttccactgagtcattctgaggactgtcaggtttgctaatcctgatatatactgtgtataccctttgttcagatcctatacccatcctgatattggaggagaggggttataaacaacagaactttaaggatgtgctcattagaagtcatttgtattagggttccctttgccctactgactctaacagggcctgaagcactaagagaaatcctgctggtaccaacttttgatttgtgtatgcttttggttacatagctatcaagagtatgtactctttacctggagtggcagtgcacattggatttcttttccagaccctccatggatctgttttcctttggcttcttctagactaggggccagcatttctttttttctgtaaagggccaaatagtatatatgctagcattagcaggccttgaagtctctgctgtagcaactcttgcattgtaatgtgaaagcagtcataggcagtatgtaaataaatgggcatgaatatgttccaataaaactttatttacaaaaacaagttgcaggtcatatctggcctataacccctgttctagacacaataggctaagtcaaattagtagctgagacttagtttcagctgctagagtgcttaagcatatcacattggggaaaaaatcactcttatcctccattcttttggggaagagaggtagaaattgcaggaatattttcatctttcccattttgaatatcaaagcccattcctcatcaaatattacatactccatagtaatcagaattggctaaagtatgatgcagtagcaacctacaaagttcaggacttaaaacaacaaagatttatttcttactcatactacctctttgtcttaggttggtgcctgtcattatcaccaacagactctggctgacagtgccgcaccatcgggaatttagttccagcactatgggaagggaatataacacactgtggtctggctgtttaagacttttggccaggagtgatacagattacttctgctcatctggcattggccagagcaagtcacactaccatgacttgacttctacaggacagggaaatgcaatactaccatgtgcctggaaggaggagaatttgaatattgatggaaagccctaatgacaatcacacactctaagaactccttttcagtttcttcttcatgtcattccttgcctacctttaggttatctggcctagttgtatcttttgtccaaccctacctggccttcctcagacatgctggtcattgacattgatacatgggggagggacaacttagggactaaagcattgggacagtaattattccctaaaatgctgtgtagaccagcatgaacatgaagtcaggcctcagagccaggtcttacatgccgttggatccaagggttgattgccattgggcagcaagcctgagaaaaattggacctcccataactctggttttgatttcactttagtttacttttaatgagaatttgaatcagagaggaagttctaagcatattgactttaggcagtgccttcccttagtgctatggagagcagttatcaagagggaagaggaatatggaatgtgaaaggtagaaagtataggtgatattaatgcagtattatgggctaaagtgaaacatatggcccatgattttagaagaaggaatatatctgcaaagacaaaataattagttgggataagcccattgctctaacaatccccaaatcttagtgactaaagacaatgaatgtgggagtggaggggcctatggagagggagggcttttgctccatgcagtcattcagggacccaggcccctttcactctagtggtctttctttcctctagagtctcacagttcatcactggagcctctggtatgtggtccttagtttagggaaaagaaagcaaggagagttttgcaggacgttttataggtcagtcttctaaggcatgtttatcatttcttcccacattcaattgactggaactcattcacatggctccacctaactgcaggcgagactatggaatgtagtgtagctgggtgccaggagtggaggatggagatgggtttaatgagcacacaacattgtgtattccgctgcatacttgtcttgagcaagggtgattttttgtaggaagggttcagtctgactgagtcttaactgaagtcttcatcaacatactctcaatattgaaatgttttccccttacagagcactgtcggccttggttgaacagaagactagtcctgactgcagaggccttagataaatgcaattttgccagtccttacattttacttcataattcacatggcctctggacagatatgtaagagcacttgcattctcattggtacaggtttgggatatgtatcctggggcaggaacgtgaaatagatgacattcaatggtatcgtgagcaatgatcctaggaaattcattctgaatcctaaactgggcgtaaaccattcttaaaaagtaaaaggaaaccattaaaattggaactacataactaatctttgttccatttttggcctggctaccagggcattcagagtcctttaacacactcacatagaatacatagaataattatgttaatcctattcattgtttttttttttttttgaaggagtctcactctgtcacccaggctggagtgtagtggcgcagtgtcggctcactacaagctccacctcccgggttcacgccattctcctgcctcagcctcccacgtagctgggactacaggcgcccgccaccacgccgagctaattttttgtatttttaggagagatggggtttcaccgtgttagccaggatggtctcgatctcttgaccttgtgatccacccgcctcagcctcccaaagtgctgggattacaggtgtggtatttcttatagctacttctcggttcaggtgttttctattttcaattacttcatgatatatgttgtttgttgagaacaggagaaaaaaataaggcatggcttcttcttgttttatttaggctcggtttgaagactggcatttgtgaaaaagatttttctgtgtctatcgtgacttcctgagcagttggttttatatggtgtagttttggagatgaacttcagctgaaagaaaggctcaactctaagtttgatgtgagccaaaggagtgcatcacctcttcaaggacagctagatctttgctgtctaatctaaagctgttcaccagaatggagaaagcacttttatgttccttttctccctagctatatttcaaacatttagggattagatgatttgtatctattattttttctagtccagagcttcgcaaacactttggggccagataattctttgtcatatcgtctatcctgtgcattgtgggatgtttagcagcttctctgacctctacccactagatgccagagtacccttctcaactcgtgacaaccaaaaatgtctccagacattgccaaatgtcccctggggaaaagttggccccagttgagaactactgtagttgtaaatttttttttaattgggggtagataccctcactttcccagaatcctgttctgtatttgacatttcttgcagagatgggagttggaaacaaaggttatggatgtcagggagctcagttctaagattgcctgcatttatacctccctggggtgtggactcaggccatatggaacaaatatgacatatgtttgtccagtacgggcagtaaaaaggcttctcaatactcattaacctttgagaagctgacttgtttctacagcattattgaaggttctgaataagatgaactcttagaatctgaatcactgggaatcttcctgaagtgcagatgatgtttcagtaggtctggagtgtgggtgtgagattctgcatttctaactagctctcaggtggtattaatgctgctggttcccataccacactttgagtagagggttggtggtctctggagaagaggagctggctaactagacactatttttaggttctgcagaaggaattgttctttccaagattattccattggcccagtaagtagtgaagtaatctgcagttcttaaacattccctccttctcctctcaagaaggtacaacccacagtgatagtctccctgctctctctttcattctctgcagccatttaaggctaatatgaggtaagctagtcaagtacttccttttgattagctaccttatattttttggaccttctgtgtgtccgtgtgtaagagagagagtagtttcctttccagaggaaatagtggggataacttcggaaaagccattacagtgtcagaaataggtggctattttatcctagctggagtttcagataatggaaaatccatctctagaacaatgtagtatagctccacttctgggatcacttctggttggccacttcctagcctttgtttcctcatctataattgtagataatagcaataatcaccttagagggtggacatagggagaaaagaactaatgaatatcaacctgaagccctgagcacagaaccagctcagtgtaagcatgagccagtaaatattagttcctaatcttattggtgtggttattgtcattattggaactgggatcctcagactctttttgcctctaaattgtttgcatatattgtactcctatcagtgacatctttcatcatgtgcagtgattctcaatcagggatgaggtggtatgtggagtttgaaaccactcccaccagacaccatggtctccttgttcctcttttgagggttattggtctaagcaatgactgaatctcatattgtttttccagccttggtaagtccaaagatgataatataccttatttatttgtttgatctctgacccctatcatcacttttcactctaatcactttaatatgagcatctggctgccaaaagaagcccagtttcaaactggaaatttttattaatatttgacatatttttacttttcacacctttctttcctaaggaattgtcaccatcccatggcaatcaatggtggagttctttagaatccagatttcctaacaccttccctttcctttctgtgtattgtgtagtcttaactaaataactctccccacatcaggaattttggtctgggttcttaaagaatttcctaggagaagcaaaatgatactttgtcttttcctctagtagttccatgacatggcagatgagctgcctccttggtcgtcaggaagaggtagactggattttcctaacagcgttcccactgctccagcagcctggagccttgtgtgccaccactttccttgcaccctctgccagtggcctccagggaccactttctgaagccagctgctaacagttttccaaacaaaataatatgtgcattgggggataacttttctcaattaatcttcaagtaccaaatgcctcttttcttcctttatgcctaatgtgatagcaatgggctctttcagtcacctcctgacatatcctgtccccgagctcattatctcttttccagtcatctcagaatagtttttcaaaaatgtaaatctcatcaaatcatttcactacttaaataacttccctggcttctcatcatatacaggaaaaataccaccccctggacttgacttctttgtgtctccaggtgcctgatgtcattgggctgttgttgcaagtggttctggttattagcactatacagtatttcacaggggagcattttctcttgatttatagggcttgctaatgaaagaaaagatactggagatgctatcagccatctaggagtaacgtgttaggtcttagctgaaggttgagtgtgactgaagttgggagtgcggttctggattcagcagataatagtgtccatgagatggcgaatatccagatcctcaaaatatctaggttttgatgtggtgcagggcagtgctttccaaggagtgtttctggggcattcatagttgttacctaggtgaaaaaaagagtctggtggataagtaaagtcagagaaaatgctgagttatcattaaacaggtttctttactatgggacttgtgagatccttttaacatattgaaagggacactgaatgttgaatgtggatcttttcccaactttatttaagcacagaattttgttttcacagagcatcttgtggactagtagtgctctgcagagcagacttgggaaatgctggtgtaggcaatacaaaggaatgcttgactgaactccccactgtctcatccagatgcctcacattgtttctgtaaatgctgcttgagggtaatgactaatttgtccatttcaaagggtcattgaccttcaaaaaaaaatctagttctcaaaggattagaactaaccaagtaatagtagaactcattcttaatttattcagggagaagaggaaggcagtgagtgacaacattaccacataacctgttattaacaatgaggcatcgtgaagaatcattgatttaacattacacctcctggtaattagaggtttttaaaacccatagtacagtagcaaaggaataatacaaatctatcagattcaccatggaagggattctttttgttgggctacataatccaagttcacatgaagatttgaggttgaggaattagcctctgaaaacagagggatttgtgttttatcttccgcaattattagactggattttagtgggcttctctagccctcacgttttgctgctctaggtaaaatgaagagacctaaatttgaatctttgctttggcactaaatagcagtgtccccttggcatctctgggcctcatttccacctgtcaaaagagaaggccatttccagtttcctcttggagatagaaccctaggaggcttatgtaatgagattggaatggtccatgagctgaataatggagctgatgataaagctgttcagtaaagtggaagaagaaattttgacaggaaagaacatagaggttgcctctgaagactggattatgagaaacttccacaagtaagtactctcagcacacagaaagctgaaaacaagtgtgcataaccttagagccacagaatctggacagagttgtttgcagagatctcatactgctgaagtgaaatcctcagcccccctgctttgtatggcaatagagagggtacttcttttgggtcatgaaatcctgagaatctgattgaacccacagacccttttcccagaagaaatcgattctgtaactcacttctgaatcacttttgaaaatcatacttatttctctccagctatctgcccttaaatgaagaatcaccttgcctctagatatgcatatttatatgttaatgaaattaataccagactcttaaaattagcatgtatcactatttgaatatttgttccttcttgccatgctctgttccttttttttttttttttttttttttttgagacagagttttgctcttgttgcccaggctgtgcgatctacagcacaggctgtgcactgcagcagtgcaatctcggctcaatgcaacctccgcctcctgggctcaaccaatgatcctgccttagcctcctgactagctgggattacaggcacctgccactacaccaggctaatttttatatttttagtagagacagggtttcaccatgttggccaggctggtctcgaactcctgacctcaggtgatccacccacctcagcctcccaaagtgctgggattacagtcatgagccactgcgcccagccagcatgctgtgttctaatgctagagccagcaggagatagagaagtagaaggcatagaccctgtctcctttgcacttattgatcacttaaaaagcggcacactttatattaggtgctagatggtaggatgcaaacaggcagaccatgagagttgctgcagaaaatcagagtgtgtttgatgggccctgggggctggatatgagtaagcaaagagtagtctgtgggggcagttggggctagcatgagtcagggcagaattggccaatcagaggtagagcattctttagccaagtggcacatcctcaggggatacatctttgacatgaacttcatgaccctggctgggccatgctgtggtgtgggtccgtacatggaactccagtctttggggtgtgcttactcacaagcagttgactgacactgcaagactagagttgctacctataaggcagcacatcacaagctgaagggacttttctaacttctatgggatgtagtaactctggacactggaccatcaaagcagacaaaattatacatctctttttgccttcaggtagaatgcatttggtaagcagggagataatcataatcagttgactttgttgtatgttgcttctttactccctgaatctttttgaaaaacataatcatttttgttctttataatatatccctgtgaaagagaagcaggtgaaatgattacctctgacacacacatacacatatccacacagaaagttctttagaaactgaagcctagagatgcaaagtgatagcagttccatcacacagcaaacaaatagtacaacttagctaagaatacatgggccctccccctgccccccaaaaaacccccaaatctatgccatttgcaagcactctttgcttcacagagacatggccctttcttgcacactctctcctcaagccatccttcctagccatctgtctgacaagacggcatattcaggcagggtcagctactgactgacagcagctgaaacactgacggaagtgggatgaaaaacagcctgcagatggggtccggatgaggagggggagagctgggattagactaggatgtgagctttcagcgccctcttccactctcttctcgccagctggagcagcagatgactgtttcctctcactcggcaccttcttggttgggacagagtgttgtgtctgtctgtttagctgcagagtgatctgttgaatctgctacaagaatttcctggcctgggacctcactgggggttgggccaagggtagaagtagggaggccactagtcttgttgaaggtgtggtcccacagagtctcctggaagctttcaagcaggaaaatcttccccccatcaccccctcctttagctgagctgtctggctgacccactccatctcccaaagtggatacaccacggctggggacactaggcaaaattatgacttgagattgactccctctacccatttgtgattctccctttctttttaatttacctttctcttcttcaactgcctatcacctacaaaacaccttcatttttttcaggcccgctccgctctgatacccagtctttgtgtttgtattgtataacgtttggaggttattttttttttttggtaacgctttattgaggtatacatacctcatactgaggtttacatactgtaaaattcacccttttatgttgtaaagttggttttagtatatttacaagatgttgcatccatcaccactatctaactccagaatattttcgtcatctctaaaagaatcccatacctactagtagtcactcccattctccccttcccccagctcctggcatccagtgttcttctttctctctctatggatttgcctattttggacatttaatgtaaatggaattatacagtatgtggtgttttgtcactggccttttttttcacttagcagaatttttcaagtttcatccattatagcaataatattacattttatggatataccatattttgttcatccattcatctactgatggacatttgcattgtttccatcttttaactattatgaataatgctgctataaactttcatatacacatatctgtttcagttccttctttcaatttttttgtgtatatacctgggagtggaattggtggcttatattggtaactctatgctcaactttttgagagactgctagattatcttccaaagcagctgtactattattatttttttttacattctcaccagcactgtataagggttccaatttctccacctacttgctaacccttgttattattgtcttttttattatagccatcctagtggatgtgaaatggtatctcattgtaggattccccccaatagcgcctttctctttactggggaatagttccagtcttgtgtattcatcactgtgaagatattaaacctctgggaaagatagggcccttctctaactaatgattgaatctgggggcatatcaggcattctggcagggtggagaggaagagagtttagggacatggtgaacttgccacctttggaagctctaccatcgcagaagcaatctgctctattgattgctttcccttcccacaaagagaccatcaagtgcagaagtaatcaagtgaagttttcttgaaaaggcaagacaagagctgggcaacgaagggtgggaggccaaaggatgtatgaagggggaaatggagaggcttcctaaactaaaaaatattaaatcctttctgaaaagcaccttcagtagtgacctaaaacaaagatgaaagtcaaaccaatcaacaattacttttgtttagcaattctggaaaacatgttgcaggagaggacactggaaatgatggttaaaatacggtgggagccatggcagttcaagcctgtaatcctagcacctcaggaggctgaggcaagaagatcagttgatcccaggactttgaggctgcagtgagccatgatcacaccactgcactccagcctgggcaacagagtgagaccccaactctaaaaataataataataaaataaaatacaatgggagtgttggccaaggagttcactttttctctctattccatgccctttaggactactcataatcacaaatacatttgtgacccttctgagcgtaaatccacctgtctggggtgctcaataagtccaaagtagagtctatgtgcttggtaaatggctctggctagaaagcaactgcttggctaaatcacacctgacggtcttcccactgagatgggaaaatggggcagatagtgtttgcccaggagctggggcataaaaggattcttagtggatgtgatggctcagaagtgaatctctagttaccacttgggatctgacagtttttgagaagttctacagggctgtgaaagactgcacaggggtaaaaacaaaccttgtcattacattacaggtgttgagaatttctaaaatttacagtatataatactgattgaaaagtaaatgtcactgctactttggagttcagcataagccttatacagaggcagggtctgccagtgtggtaagaggatggccactgtaagggttaagtagccccacatctctttccctaccagcctgctttctgccctccagaaaccctatcatttatagctagtagtaaaagaacaacaattgcatttattgggcattaatatgttcctggtactatgctgaacagattatgtcttaccttgtttgatcatcccaacaacctatggggtaggtaccattatcatcccaattttatagatggagaaactgagactcagagatgctaagaatttgctcagctaataagcaataattagcaatggagctttaatttgaatccaaatgggacactctgaagtaaggcttctcctctccctaggacaggtcttggaagctgcatttttagcaagttccctcattcaggtcttaagttctagaaagtttcacactctttacccggtgctctacagcctcattatgaataaaacatcaaaggcctatgttacaatataattatctagaaaaggaccctgttttaaaacattatctaccattttcatttcagtatgaattacttaacgggattagtattaaggcctgccagcatgacctcaatgtgatgggccacaggagagttaagttcttatgggggaggagagtttggggaaaatctagaaatcgttggactctacccgaggaaagcagatctagttaagtcatcacatcaagaggcccaggggaaaaagaagtgatggcagttgaagtgctgaaaaaaaaaaagaaatctaaaggtaggcatcattgattcaactgatgggcccatttgaagcagtacctctgatctcagggagcatcccaaggaaaatgtcgtctgaatccacatagcctcagaatatgagcattgttactttttggaggtggggggaggctgcagacacccactcttctttgtttttgtttttgttttgagatagagatttgctcttgttgcccaggctggagtgcagtggcgcaagctcagctcactgcaacttccacctcccaggttcaagcgattctcctgcctcagcctccagagtagctgggataacaggctcccgccaccacgcctggctaattttttgtagaaacggggtttcaccatgttgactaggctggacttggactcctgacctcaggtgatccactgccgtcgcctcccaaagtgctgggattagaggtgtgagccactgtgcccagcccactgtttttgatacattcatcctgcaagatgtgttgcatcctggatgtatgctcttactttgcctgactgagatgcagctagctcccagctgctcctccctccattacagcagtgctctggtagaaggccatgggtgatttcccactagcaaccttatttgtctatgttccttccatttgggccaaggactaaaagccagctcagatttacacaattactttaacattgtttaagaaagcaatgtaacaacctccactttgcccagatggacgggctcaatgatgtcggtggagagaacccattattggaataagactgggaacacaaagtcatagctaggatctctcccactagtaggaatacagccgggcttctgatgaccagctttgtaggattgattttctatggttggaatggacccaaaatgttcacctagtctagtctacggccttcaagtagaagttttttcaaacgtagtcttcaaatttaatgaggaatacatttatatcattcaagaatatgaatgcatatgtatatgtacatgtatatatgattatatatctaggtatacatataaaagaatgcaatagaatatcttattcaccccgtcccacactcacccaattcttatcttctccctacaacatgtagttcccccccataacttttagtggttatatatctttccagatttttatgaaaatgtaagcaaatatgaatatatatatatattttaaaaatattttttcatttacataaaaggtagtctattgtgcacatcattttaccccttgttttcatcatttaataatatatctttctgtattagtgcacagagaacttattcttttatagaactacataatattttgttataataatgagccatcatttatttaaccagatttctatcaatggacatagaagttgtttccatattcagccattacaaacaatgctgcaatgaataatttttatatgtttcacacatgtgcaagtatatctgtagaatgaattcttaaaaataggattgttgggtcaaatatatatgtatttttaaatgaacagatattgctaaattgcccttcatcatgttttaatcaagtcttcacagacttaccaagagagtgttttattcaaacttttggatttttctaaatctgctaagaaaaatggtatttcattgcagttttaatttatatttctctaatgaatgaggttgattttttcatgtctaagggccacttgtagttccatttctgtcaactgtctatttatatcctttttccatttttaccattgggttatgaatctgtttcttgtcaatttatagaagctctttatatattagggacaaataggattttaatccccaaacagcaaatatgtgaagagattctattccagtgttttacagtgtcttatggcagcaaactctttcttcaaatgaaatttaaaaaagctaataaaaacacatttcactaacaaagtaagaggtattctgttgaagtagaaatggggaagggattttttttttcacatccctcaagtacctctgaagaatcctaaagcagcacagaacctagtttgaaaataatttccctacatgcctagttggcctgtggttccagtttctaataactctttcagcaaggaatcttttttagtatctaacctgaatccttattgatgcagttgatactcctccccacttaacattggcaatttgtgattatttgacctctcttccattatgaacctttatgtgttatttaaatacattatcatttaacacctttttgtgccttcccctccaatgaaagcaggattttacttgaagtcaggggaatgtcctatttatctttgtagctttaaggtaacataatgccaggtattgtcaatgtatagtcaaggatctattagtgccaggtatagtcaaagacctccacaagtgcttgttgaatgaataagaaaacaagagagaaatagtgttttgactcatgtctccatagcacctaccatacacatcagtgcaaagcaaatgcctttcagttagttatcatctatggaaattgggaaaattccttcatattcttcaactttactgctttcctctctgtgacctctttctagagcaagatcatctaccatttattgtgaatgttatgtaccagatacctttgggctttttaaaattaattatcgctgaacctcacagccacgtaaagtagaaggcatactcaagccttcctaagatcacagaaccaagacatgccaaagctggtgtcttagtctgtttgaactggtataacaaaacaccacaaactgagtagcttataaacaacagaaatttatttctcacagttctggaaggtggaaatccaagatcaaggtaccatcagatttgttctctggtgagggcttggcttctggttcagtgatgataccttctccctgtgagcctatatagtagaaggggcgaacaagctcccacaggcctcttctattaaaagcactaatctcattcatgaggatgttgcccttataacttaatcacctcccaaaggccccatctcctaaaagccatcaccttgggggttacgatttcaacatatgaatttcagaggcacacaaatattcagatcatagcagctgggaccccagagaccaatgtttgcagaccccagagaccaggctcagttatcttctcttgcatcactgtgagatacgcacatagaaacagcatcctattctaggggtttctttcaaggcctttttgtcattctctcttcccatatatttctgagacttggggtaaagccctttagatgatgtagttttactttgttggatgtgtatgtctctctgtgtgtcatgggcaattaaagggactataacctcttctttctagtctttaccttcatttccatgtcccttctccagccacctcccaatagcctgcaaatgttctaggactctatcagtagaatgacagagaaccaaagaaatgctagcatcaggctcagccatcagaagaaaagtaggaaccaaagtaatggcagcaatggcaaaagaaaagatggcttggcgtcaaggagattagcaactgatctctgaaagctctggggaggtttgtatttataacactgggagcagatttgtctcctgacatacaagctgcttttctgactatccaagaactgtcctactatggaaatgatcattttatagggtggggagagtggggaagagagcagtcagcatgaggacttggttccagagtgtgggaagaagggtaacaccaggagaggagggaaggcgtacaaaaagaagtgaagtggaaccacaggcttcttggtaaaatttgccagttgctctgaaggacaaaaaaaaaaaggcctgtggcagttattcagactgaggtgttagttagtgacaaggtgtaagtgtaccctctcatataattcttgggattacaaaatctgattgcaaaaggtagccatttaacctagaggaatggacttccaatagtggcattttaagcatcagtgtgagaaaaggtggtaagagacatttgggataagggggtattttctgagcatcccggaaatcatagttctgcttacatatgagatcatccctcacttggggagaagaaacctcctctttcccaacacatctgtggtcacatgacttagtgcttgtctgctcaccctacaatggttttttctccagtcctcctcttagtgctaggtgggaatttgactggaaacagaagagatgggggaggttagaagccacgcagcctggtcattcctattgtagcattccctgaggggccctgtagccagctttgctttgaactgattttctgctagttttcagtcaggaacactgaatgtgttccaaggatatttgtttactagcccagccaccttggaaaatctgggagaggagaaggtaaaatatgaggtggtttttcttccttctgcagttaggaagcatgctgtgttggccctctaaagatgcaaggggagatttgagtccatatcgcattcctagaaatattgaagcttaaagaggtaaagtgccttgtacaagattgtggggagtcagtaccattgagttgggattgtgactcagtgatcctgctctgaagctttaacacccattctgtgaagagcacaaatttgaaagcaggaaagctatatttctgagttggctctcttgttaaacagctgtgtgacatgggacaaatcttttggagtactagtagcctcattttcagtaattcgccccccacccccgagatacacaccattaagggtgttgcaagaatgaaataagaatgagatgttaagaattttattgcataaaactagccttaagcatgaccataattggtttctttttctttgattctactgtgtcttcctctctttctctttctccctatctcctgttgagtagaataatagactccagtgccaggttactcagaagactattgcaaggaagattctcaagatcattcttccactggaaaatctcaccctgcagttgccttgccattgattccttggtagaaggcccggttcaaaaatcaagccacattcttttgaggcaaaataattccaaacttcttttttgttgttgttgtttgtttggtattccaaacatctgccagctcccataagagccgtgacaaatattattttgtaggtcactgtagatttccttcaccacaaaatgctgagatttggaataattagagcccagggggcaaatgggcctgcttctgtcctttctctgatgggtttcactcatgtctgccagctgcagctgtctgattgtatacgcttgtgggcaggggcagggcctcttagcccagacagagttaattagtatgagttaaactctttctaggagctaaggctgtctttataaggcaaaagtaaggaactttctttatatcctctaaagggtcattaataagtagttaacaccctgagagtgaattactcagaaattgatgttagatcgacttatatagcaaagtatagaattgagttagttacccaaatcgctgaagccaaaagaagtgcattgtctgttttctgggtattttaggccacaacattagggacagcatagccttcatgttctagtggtttgggttttggtttttaattaaatggtcccttccttattataggtttgaagtgattggcactttttttgatagtggttatgagggaaggttctagaatcagtcagacatcaagttatatcttagtgctgccacttgcaagttgtgtcaccttgggcaagtcaatctcttaagccttagtttcttcatctgcaaaatgggcataatcatgtctacatcagaacattattagtaagagccaatgagattatgtatgtaaaagcactcattcctgcctggcacatagctagggcttgataaatggtatctattcgtgtattattattattattatggatgttattattgttagccttatcattttcactacatactgagaataatttcattctttttgcttgtttgtttgtttgtctgtttgtttgttttttgagatggagtctcgctctgtcgcccaggctggagtgcagtggcgtgatcacggctcactgcaagctctgtctcccgagttcacgccattctcctgcctcagcctcccgattagctgggactgcaggcactcgccaccatgcctggctaattttttgtattttttagtagagacggggtttcactgtgttagccaggatggtctcaatctcctgacctcgtgatccgcccgcctcggcctcccaaagtgctgggattacaggcatgagccaccgcgcctggcccattctgtttttttttaaacagttgtattgaggtataacttacccaccacaaaatagactcatattcattacagttttgactgatggaaaagaaaggatggttcaactctctaagcctctccctaatgaaacacacagctcccctgatttctctccttccactgtcttatggcaggcactttccaagctctggttgtatcttttgttggtttcaattccttttttcaccactcactagctttgtgacttcaaataattcacataacctcagcaatcctatttccctcaaatgaaaatgaaggtaagaatttaccctacttgattcacagggttgttatgaagctccattgtaataatatatgtgaaatctctttgtaaatggtctgctgggttactataattcacaaatatgagtttcaataatattcaaatgtcatattgtgtgcttcagacattagatgccttgagagatccagattgtggctggagttatttagagaatgcttcgtggaggaaaggcggcataagctgaaccttcaagatcagataggacctcaatgggtggaaaagagtcagggagtgggcagtctcggtggagggattaaaaaaaagcaaaaccacagaggctggaacaaacagataagcacaaaagtgatttaaaatgtaggcggtggccgggcgccatggctcacgcctgtaatcccagcactttgggaagatggggcaggcggatcaattgaggtcaggagtttgagagcagcctggtcaacatggtgaaaccccatctctacttaaaaaaaaaaaatagccaggcgtggtggcaggcgcctgtagtcccagctacttgggaggctgaggcacgagaattgcttgaacccaggaggcagaggttgcagtgagcagagctcgcaccatgcactccagcctgggcaacagagtgagactcagtctctaaataaataaatgtgggagggaataaagttaccagggcagtataatagatgggtccccttctgaagcaactgggggaaaagattaaatgagatagcatggactccttcctttcaggaaagataatatcttattcatctaggaatattagctccatctaggcagggaccttgtccatgttctctgatccctctctaacacatattacaattcctggcacatagtaggtgctcagtaaatggtcaacaaataaaagaatggatggatggatggatggacggatggatggatggatggatggatagatcataatgtcagctgctgtacttgtctggctgttttaacattattcaaaatcattggtcactggagcggggactgtcttaaaactccctctatgtagtacagccccgtctgctgttgggatttatgaaattcttgtcaatgatgccaatactcagtgtggtttttctccaccctgttctagaagactccttacccccagtgaacaataaggtgaccagcaagtcttgcgagtacaatgggacaacttaccaacatggagagctgttcgtagctgaagggctctttcagaatcggcaacccaatcaatgcacccagtgcagctgttcggtaagaccctacatcttaacattcctgctaggccctactcaaatacaagagcttcctctgtacttgtactttcatttgtgcctgcactgtaaggtgtttgaataaaacatgacttgcattaaatcataagcctccttgacaatccaaactccctgatcttcacccaccctgaacaactctgttgaagggctcaggcccaatcatatcccagtcttaaagctgtaggactgcttaaatgggcaaaggtgagctgtttgtgttgatcggcgctccttttcataataattataccaccaaagcctccatctgaaggactcacaattatttgaagctttgggaatgctatgggtggaaaagtcactttgactatctagggccactcactccaattaacaagaaaatgagttgtctgttagttcccatatctgaagtattttactaaccagttaattcctagtgccctgcaatgagaaaactctctataaatgcttggtcatgatgactaccaggacattacttgtcagaagaactgcatttactttacaaacaacgtatactaattacatcttatctaatatgcagtccggagaatataatcaatagaactagaaaatggagtaaaatgagtgtttaaactgaagcaggaaggaatgaagttagatgtagtaacaacttttctgcctgcaagtggcattaagcactggattgtcaagggaagctatagaatctcttccctttaggacttttagtaagaatatagtatctcagtagtttaggagaattttcgtgtggccttgctttcttaatggccttccaggaatcattctagccccaaaagaatgtgcttctaagaactaagaacaaggtttaaggaataacatttgaaagatagaaatttaggaaatcaggattattgcaaagacagatgtaaccagcaagtaaattttatcctctcccttgccttgtgctagactgagctgtggccatcagatcatcttgtatagttttgtattaccccagagagcttgttcctttggtttggaagggagagtctagtgaatattacaaatggaagctatgaaataaatcttcattcctttaaacccccaatccagctgggggaccaagggtaccatgaacagagaagaaagaaacaagactataattcatggttcagaggctcatggcatccctgacagactactttgtaccaccttagaccatgatgctcgactaggattgctaacttttctgtggcttagtctctggcatggaggaattgtaggagaaaaaaaataatgcgtaataaaatgtaggaagtaccgagaactgacgatgggagagctggggggaaggacatgccgtgttttgagtccctgctctatttcaggtattaagtgaagcctttacacttatcctagatgcttctaatcttaattctgtttctccttggcaggagggaaacgtgtattgtggtctcaagacttgccccaaattaacctgtgccttcccagtctctgttccagattcctgctgccgggtatgcagaggtaggtgtgttatatcccaagacccctgggtgctgctatcctgtgtagtagaatttagaaaggaggaaaatacctgtctaatgtcctagggaaaggtaatttttatggtagccttagtttttaaaggtggtttaattaacaaagggaaaaataaataaagcattgattttaaaggccacagcctttaaaaaaaaaaaaaaaactacaggatggagtgctgtgcttcaggggaggatgggaaagagtcatcaaatgtgaaagtgaatatatttatttctccatccttaatcccttctagcttggcccttaaattattgtatcataaaacacagactattttcattcatagccttagaaggaagaatggaccttgcaaggaattgatgtggccattttgaagactgtgcagggcaaatttaggtatactttttaaaccccataataagatggtgacaaactcaataaaagcaaaacagaaagcattttctcaaattatattcaaaattgaattgtcttctcacattagtctttttttctttaggttttattttttttataatggcaccagttttttcgctaggttcctgggatcaagtgtaatcccctttaatttctcctttgttacctcttctcagattaccaaatctttcagcagttatctgtatctctcccttttcccactttcccactggcaatatccttattttgtcctttttccttctatccagtcaacatattttttgaccatctactgtatgctcagcattgtgctagaattggggtatttatattgataaatacagtagatatatagggtggtgctagaccatatggcatctttatgtgagttacaaaaaggattcccttacataagatactttattgccatttttcagaaaatcccagggaaagcacctttgtagctgtggcatccttttgcagcacacaacctacacaacaatatatatagcatacatagcagccaagatatgttctttgctcttatggaactcaccagaaaagacaaataataagcaaacgtggaaatacagataatgcaagtactatgcagaaaataaacataggactgagattaaaaataagtagtttatttaggttgagttgtcaggaaggcctctctgagaaggtgacatttaagctgagacctgaaagataaaaagaagtcacccatgcaaagatcccaaagaagaacattctaagtagagagaaaagaaagttcaaaggccccaggcagggaagagcttaaagcattcaaagagcctaaggaccagtgtagctgaaatgtagtgattgtggttgaaactgacatgggatgaggctgaagaggtaactaggaattagaccatgcaggattctgaaggccatgggaaggattttggatttccatttttaatacattgggaagctattggaaggttgtgagaaagagtatgaagtgatccaattaacatattaaaagatctcactggctattatttccagactagactggagggaggcaataatgcaagtggagagactagcaagatggttagggtagtactctttccagtgtgagaaaaagggtgcttggactgagaacacagtagtggttcagagtggagcctttggagccaaactgccttggttctaatcccagccttgctactttgtagttgaatgaccttattcaacctttctaccaatctttaaagtgaggataatgttagctcctaccttcaagatgtttgtgagatttcaatgagataatataagagaaggacctggcacagtgtcttgtatatactgaggacccaataattaaaagtggacaaatttgaaatacatttggagccgtggttctcaactatgggtgcatattggaattaccttggtagatttataccagatcagaaggaggaggatgtgattccaatatgcagctaaggttgtgaaccactgagttagaggaaaaaaattataggatttgctggtgggggatgtgtaggtgacttctatacattactgccattttaatcttccaaaaagcaatccatcaccgtgttacacccctgttcaaaaatttttatgccaacatgtatttggacttactatatgtcagtcccagttctaactaagcattttacagatatgaactcacttaatctcatgacaaccctatgtgaggagtactattgttctccctgttttatggatgaggaaactgaggcagagagcggttaagaatcttatccaaggtcaggtagctagtgagttgaggagctaagatttgaatcctggcagcctggctccatatttcaggctctaaccacagtgttctgccactgaaagggatgactccctgtcgccactcaaatacatgtcaacccccgactctgatagtgaaggcctttcatggtctaacctcaagttacctttataggtcaatattcttccattcatgcacctcagggcccactgcattgttcctgtgctctcttacctttttacctttgctcagtcctcttcctgtcagtgtttctcacactttagtgtgcttcagaattgctcagagaacttgttgaagttcagattcctggatcacacctgcagagattctgatttagtggccttggagtgggacccaggaatctgcatttaagcagaccccatcgttcattctgatgcagaatggtggtctgtggactgtcactttgagaaaccattcctgagaccatgtagataacctggaaccaaggatttgttttaaaaaatctgagtttagtgcacttaaattgagcacattaaaattctgaaacctgagtgaaccagtggaaaagcaaccaatttcagttcctgattggttaaagcatctaagtccgaccatatggcaaccaatttgagatgaatgagtggtggccatttcatgataaggaactgggatgaaaaggagacaaaagggctgtctaagtaacaactgcacatgtacaggttggatggagaaaatgtttcctctttctggaaaattctttttctccatccctgcctgtggaagtcctgctagtccttcaagacctagcacaaatgcagcttcctcagattctattgcaggccgtcctcaggtcgcattttgataagtagtagttggaaggcctttcttttctgccttcccacttccatccctaatttctccacccataaatcctgcttatccttcaaaatccagcctaattgccacttcttccatgaaatgtttttaaatcctgcaaactagaagtaaacctgtctctactctaggactcctcagcacttaacctgtgcttcttctggagcatttatcaccttgtcaacttctgttttttattatttgtgcccatgtattatcatccctattaatgcataagctcttcaagacagatactctttttcatttatctttatttctcccactgtgccaggcagagtaggtgctctttaaatgaatgcacactagattggaatgattactagaaatttagtcaggatttgaattaggtgctaccaaaaaagaatatggttgttgtgcatttttccccctgaattactgattgactgtggtagatggtgttgactatacattgattcctcgtcaataggaaattacttggtctcattcctgatctccaagttgttttcttcccctataccactttaggaaactacagttaacattgctttttggaaggactgagcttgtttggactaccagtgtatgctcatcccttttaatatgctatttgcatcagccctcataagtcaatatggatttagttacagcctaatttgatttatgctttggtaaggccctggatctttccatacatgtttctcacaatgtgtgtgtgtatatgtctgtactacagtgtagctgttacatttcagtcaagaaagatggatattttgttcctcacctcctttcttgtcttggccccaacttaatttcagtgtggctcaaaagaaagtccatactgagcagaggtgtacatgtggttgctaatataaccagttggtcactataatccagctgttaggctgatattattccctttggggaaaaggatatgtgaaatctaaactggaaaacaattgataatagaaaggaaaggcaacagtgaaaagacatgtcactgcaacctaggggcaatacggtataatgcaaaggacagaggctctgaagccagaaggtcatagatttgacattgcagggctaccacctacgagtgctgttatcttggacaaactatttaaccactcaaaaccttggttttctcaggtgtaaaaatggagattatgcttactacgtatgaaatgggttgtgtagattaactgagatggcgtagagtgctaggagatggcctaatacagagttattggtttataagtaacaattactatattttatatagtaattactatatttattacccccgagttaagtatcattgcaccttctcctctatctttgatagttttgcctttttaaaatgtaatctccatagacagaactttagttctagttcttcttgtggtaacagatcctggaactagctattttatgtactgttctatcgttacaatttaaatttcttttcttttttatgtcctcagaagcaacagataaaagctagttattactggccatgtattgtccctttatatacttgataattcattaagttctttctttgcaacctctcatccagcctaaatgcacaattttctttcatcttcctttataaagactaaatcctacacttttgtaaaaattgttgttctttcattgcctccagtttctttgcatctttcagctgtatataatgtggttgaaactcctttgaagttctaacttttgaagcacctagttattttttcccatggaaatgacgtttttacaatactgtatcttatataagcgtattactcatacagcagggaacccagaaacctctcccctatgctggccaccctgactgcaggccaaatactgaagaagaaataatcttttgactgctgaacttgcaaaccttcatataaagggcattgaaatagcctctctgcactgtccccaaacactaatgtgtgtctttcttcctgggtcagacagcaatcctagacgcggattgaatctcagacctagccttcattggctagacgtgtctttgaggctgggacagtcaaggagagcgttggcagaatgtgtgtcattgctagcacttcagcaaacctcattaggactggaagcatagtgcaaacagccactggaaccttaagggaaattttatcagaagaaaaaatctcttcagatcctgtgttagtttgctaaggatgatagcctccaactccatctatcttcctgcaaaagacatgctctcattcatttttatggctgcatagtattccatggtgtatatataccacattttctttatccagtctgtcattgatgggcatttaggttgattctgtgtcttcagaattgtgaatactgctgcaatgaacatttgcgtgcatgtgtctttttttttccccaaatactgcatgttctcacttataagtgggagctaaatgatgagaacttacgaacacaaagaaggaagtaacagacactggggtcttcttgaggatggagggtgagaggagggagagaagcaggaaagaatctgtacaacaaaccctcatgacaggagtttacctatgtaacagactttcataggtatcctcaaacctaaaataaaagtttttttttttttaaatctcttcagagattatactactgccacattctgggaaggcaggcttcaaacccaaacccacacccagcttccctccaccattgatcatttccacttcctgtcccctgctcatcttgccaaaacaacagggaaggctatgtacttggactctagacaagggaaaggtatttggggtaggtattaactgtattgaaagccaagtatgcatttagtaaatggtgtctaaatgtagcacgtacaatgtgccagacaatgttctaagcacttatgtgtggaatagctcatttgatcctggcaaaaatagtagcaactatttatatccccattctacagatgcggaagctaaggcagaaaagttgagtgatttgtccaaggacaaatggtagtaagtggcagagctagaattttaacctggtcagtctggcttcagagtttcaagctcttaacttctatactacctgttgggacccattcataggagtatgacaaggatatctcctagtacaggggagtaaaggggaagacgggacatgcatggcacattgttgtgtgcagatactcctaagagagtatcttaccacactgcccatgttttcccatcaaggccttaacttacccttctctcactctaggcttaaagtgtcttgagtgtaaatgtctactttctttcattcagcaaacattgttaagcaatcactaagagcctggcactgcaccagtgctagagatacaatggtgaacaaaaatggacatggaacctgccttcatggagttttagtagggaagatagacaccacgtcatgatataagtaattataaaattgcaactgtgccacatgccacaaaggaaagttgttataaaagccaataattgagaggggttgacctagtcagggaggtgaaggaagacttctgagactgtctctccagcctcaactcgcaccacatccctccttgttctctgcactccagggtgaggaaagattggctcaaaaattagggagataactggtggcagtcatacactcctgggatccccaacttctgatcccaccatgaatccagtccctccccaggctgtaggggtctataatgttctttctacattatacatgctacataataccctaatctaggaattttcttttactcttctttcttttggctgtttcctgtttttcagagacagggtctcactctgtcatccaggctgtagtgcactggcacaattatagctcactgcagcctcaaactacaagctacccttctgtctcagcctcctgagtagctgggactacaggcgtgcaccaccgtgcccaaccaatttttttttttttttagagacatggtctcgctatgttgcccaggttggtctcaaactcctggtcacaaatgattctcctgcctcggcctcccaaagtgctgggattacagacatgagcccagcctaggaattttctttttgagaaactacttgatcatgctaccatttcttaccatattatccaatctgaatttttcagcttgtttttaaagaccctctgtgaaacagtctgatccttccttaacctactttccagcctcatttctctgacaccaacacacacatctcctttaggctggctggctgatctctttgttctgttacatgctatgtttcttcctaccttccctcctgttatgtgcttcacttaaactgttatttttcacaagcttggaatagcccccgctcctcttctacctattcgcatcctactcatctttcaagggtccagttgaagttgcacctcttctaatagttttgcccaatcactctagttctcattgatcttctttgaccaccttcaggacttaatctggttcaaaaataagcattcagaaatatattcttgcactgttattgctttgtgtcttcctgtttcccctggcataacataatattaatcatatatcatgctgactggtttatttaatacaaaaagagccacagtcacaaaaagctcttgacagcattccaagtacagatgcagtagggaggcaggagaaatggtggaacttacaatttgctcaacccaagcccgttcatccaacatatctcaaatgagcccagggagaaaatggaagtcactttttatgaaattttgatatttctgctaactccttcaaggtaaatgaaactggaagcaattgtttaaaagtatattagtcagtgttcaagataagtgccattttacctaagacacttgatttctctttccgaaagagcagcaaaattgcacctcagatcccatctcagctagaatccgggatcttcagggaagtggtatgtgagatacttcattgattttaaacatcataaaaattgaccagtttttcaaagttttcaaaatcaaagaaaactgaagaaaataacagcaaatccaaatatagattctcacaaattagtctcaagttgtttatgttttggcccacattttctgcagaaacaccaccatctcctggtcatgatgataggaaagaaacattgttaatgagaaacactactttaaaaaatgaaaattcatcttgtataactgaaaccttatgcctgttgattagcagctccccacttccccctccaaggtgaacaagttctaaagatctgcagtacaacattgtgtgtgtatagttaaccatatagtattgtatacttaagtttgttaaaagggtaaatctcgttaagtgtccttaccacaataaaataaaaaaaattaaaattaactcagtaatttttgagtttatacattctcacctaaacttcaaaatacagtccgccctctatattcactggttgcacatccatggattcaaccaactgcagatagaaaataatttttaaaaacacgttaaaagtaacagtacaacaatctaaaaattacaaattttagaaaccaatatagtaaaatgactatttacatagcatttacattgtattaagttttataagtaatctagagattatttaaagtatatgggagtatgtgtgtaagttatatgcaaacactatgccattttttatcagggacttgagcatctgtggattttggcatctgtggggggtcgtggaaccaattccgcatagatactgagggacgactgtgtattgatatactctgatattttcatagctatagaagagtctcgctgtcattaataataccttttcaaaagtgaatcatttatgttcatgtgtatgggaccattttagagatttgccatcctcacctacctctcctcatctaaatcccaactggatctccttccatggaaatgttccagattgtttttgctttctctccatctcttgtgctcaaaattcatccccacgtacttgctgactgtcccaggaccccgtccctctaaggtcatcatgttccttcttggcatgtttcttacgtctagaatatttcttcttgaatagaaagtcattcagacagtggatgggacagcgttgactttcacattgagtttaacaaattaatagcactgattcctaatcggccatctgggttgtcctgtcagggtcagtaataccccattctgtttctgggattggaggacttttttgtgtgtatatgaatctgtttctataataaaaataaggaattcccagtgaagcatttcagagcaattatttcttcatgggtggttaaagccactctttcttcaaccttattctttctaactccttcaaggaattccatagctgcccagaaacaccattggatgtgcccattactcacattataatagtctttatgagcttagactccaacaatttatagaaatcaacctggtttgttgactgacagtgcaaacagaggtaaaagatacatgagaaggaagagcagtgtatacaactgactgcttttcattttcaggttgaccagacagtcagcatgggtaggtcattgagtttctcctctctgtcctgctttttattttcagttcatggatgtggtagcacagaactctactttatttggatacttggatttttttttttaagacagagtctctgttgcccaggctggagtgcagtggcatgacctcagctcactgcaacctctgcctcctgggttcaagtgatcctcccgcctcagcctcccaagtagctcagactacaggcgctcaccacatctggctaacttttgtatttttagtagagacggggtttcccgatgttgtctaggctggtctcaaactccttacctcagatgatctacccgcctcagcctcccaaagtgctgagattacaggcatgagtcaccgcgctcagtgggcacttggatttttaagacttcactttataactttgtaaattgtactcctaccaatgaagcagatatctttcctgtcaagcctcatttttagccaagagagaaaagagattttaattaagatgcaaactcttttttaaaaaattggaaatagaggactagcataattatgagaaattctaagccagtttagaaggtgtgagccgaagaaatctctctagccatttttaaaaatatctccaggaccctgtcttccaatgatttagagatgaaatgattccttttcaatgtgcaggcatgcagttatctttgctaggctttgtttgcttgtttgtttgtttgtttgtttgatccaagcccttttctttgttaaatacacagcacacttgtgggagtcccttaagccgggtattcccccatgtgtaagctacccttgaggagaaggaggaaaaagaagtggaggcaaagaatgggaagaaaggggattaggaatagcagctaacatttagctgacacagtgtgccaagcacaattctaaatgctttgcatatactaattcatttaatcttcacaaccctataaggtaggcattattgtctccattttagcaataaggaaactgaggcacagagaagttaattcatttgcccaaagtcacataagtaggaaggagcagagccagaatttgaatccaaactgtttggctccaatctgttctcttagccattatattatactgcctctcaacttggggaagcaaagcaaatttgggaactcttatttctgaggctaccgggaggaacagactgtgtgatgaccatctttccaggggccagatatggtaacaatccagcagatgcattgggactgctctgagaagcaaagattctgtttctcaccataaacttggatctgtttagccacatctccattgaaagagcagagtgtggatggtgggtaccatccagctcgtagtttctgtattcactctcttctgatttcctcctggaaacgcatgcattctcacaatgcactttttaaaaagtaagtatttatgatttttctggacaaataattttgtactcttcttcagatttggcttgctactgttggcaggaattccccccgttgtgtgtgttttggtatttctcaaggagctattttgttaaaaatactaagatcttatattgacagcccaaacaataaagtacttcatttgacaaagaagtattttttaagaaaataactgtctgatcctttttatggctgtatagtattccatggtgtatatgtgtcacattttctttatcccatctatcattgatgggcatttgggttggttccaagtcttgctattgtgaatggtgctgcaataaacataccggtgcatgtgtctttatagtagcatgatttataatcctttgggtatatactcagtaatgggattgctaggtcaaatggtatttctggttctagatccttgagaaatcaccgcactgtcttccacaatggttgaactaatttacactcccaccaagagtgtaaaagtgttccaatttctcatcctttccagcatctgttgtttcctgactttttaaggatcaccattctaactggcatgagatggtatctcattgtggttttgatttgcacttctctaatgaccagtgatgatgagctctttttcatatgtttgtgggccatataaatgtcttcttttgagaagtgtctgttcatatcctttgctcactttttgatggggttggtttttttttcttgtaaatttgtttaagttctttgtaggttctggatattagctctttgtcagatagatagattgcacaaattttctcccattctgtaggttgcctgtgcactctgatgatagtttcttttgctgtgaagaagctcgttagtttaattagatcccatttgtctagtttggcttttgttgccattgcttttggtgttttagtcatggagtctttgcccatgcctatgccctgaatggtgttgcctaggttttcttctagggtttttatggttttaggtcttacgtttaagcctttaatccatcttgagttaattcttgcatgaggtgtaaggaaggggtccagtttcatttttctgcatatggctagccaggttttcccaacaccatttattaaatagggaatcttttcctccattgcttgtttttctcaggtttgtcaaagatcagatggttacagataagtggcattatttctgaggcctctgttctgttccattggtctatatatctgttttggtaccagtaccatgctgttttggttactgtagccttgtagtatagtttgaagtcagatagtgtgatgcctccagctttgttccttttgcttaggattgtcctggctatatgggctcttttttggttccatttgaaatttaaagtagttttttctaattttgtgctttataaaacttgcagatttcttgtattgttgtatatcatcattggaagctcaaatgcctatcagtggagaatccttatactagtttccttttaaagcttctctcaaatttcagcacacttgctccctcccagcagaatttatagaattagatgtttggcagaggctccctaaagtcatctgcttctactcacttcttcatctctagcttcggtatggagcactggcattaaagtgctcccccatggaacccagctcatggtaaggagagacttcacaatgggtttattcctccctgctctcttccactttgccctgattctgctcatttcaacttctgcctcaaaaaatacagagaacatttcccctgtctcagggatttgtctcatgtccctttgccttatgattagagtgactatgtaatttactatctcaaccgaggcacattttgaaagcaagagctgcaatcttaataattatgcctgccagaaaaacaggcaataaaactgagttgtctgagataaatctgctctatggctaccctatttatgatgtatggttcaaaagtggccacatgctggcatagttttgctctctgaggcttatcttcatgggtatctcggaatctcattgtacacttagtccttttgagaggacagtttacctctctgacctgctcaagccaccagagattaatggaagccacaggagttataaacagtctgaatttcagcctagcttttggccatttttcaaatacttgttctccctttctcccactactagaaagccaacccattacagcttcatagggtaccactcagagagagtatgactgaggtttgaataaacaatacatgtggcttttagggttaaatgaatattgtttgacatacagtacactacacttgtttttatttcagttcaaaaaattggttaaaattatatcttgttgcttctcaaaattaattagaatccatctgaatccattagaatctctgttttttgttttgttttgttttttacaaaaagacttggctgaatgaaaaagcctccatctcattcagataatctttccagtgatcagacaaaaagagcaaagaaacaggttttttagggtattggtgcctactttttttcaaagtatgatatctaaggttgcaaatggacatacctattttcagctatccagacagactgtacccaggtctagagaaccacttatagccttataaaatgtcaacatctaagaagataattccagtttaattatgggttaaattaaatagaataattcaaatgttaaaacgtttagcagctacttaatagacttaatagaacattgaagtttagagaatgcaattttgatgactttgaaagctcagaggcaccagaaatgctaacagttcctagtatttatatatttaatgtatataatttataatgtacatagtatatcttatatataaatatagtgtatatatacatatatgtgtgtatttatatacaggttaaatatcccttgtccaaaatgcttgggactggaagtatttcagatttccgatgtttttggattttggaatatttgcattgtacttaccagttgagcatctctaatccaaaaaccccaaatccaaaaatgctccagtgagaatttcctttgagcatcatcagcactcaaaaacttctggagcattttagactaggaatactaaaacctgtatgatatatataacatacagttttagtatgatatagatgatatatatatatatatcatacagttttagtatgatatagatgatatatatatgtaatacaggtttagtattcccccattacttgtttttgtcaggtttgtcaaagatcagatggtatatatatgtgtctgtgtgtatatatatatgtgtgtgtgtatatatatatatgtgtatatatatgtgtgtatatatatatgtgtgtgtgtatatatatatatatatatatatagtctccattactttttaatgaagtgctgaaatttaggtatgcattcttgtctgcaaatgctcatcaaatacacatcacgacacactcatctgatttgtgttacagggtattagtattcttctcctatgcctgatagtgacttgcctccttgattttccatcttacctctctgctcatttgtaagaggcgctatgtgcttctataatgctttgagattctgactggactataagtatttaatgacactctttaattaaaatccttttaaaaactctagggtataaattaaataaactgaacttttcagaaggccagctaagtaaacattttatgtcaataccaatcattaaatctacattttaaaaggacatttgatgaagagaactagtctatcatttttcttttgcaacttgttttctcccttttgactacttaaattaggcttgaaaccacattatatagcttttacattttgttttgccatttgctggtaaatctttactggtttctattcgtctctctagtcccatattttatttggcccagacccactactgcccactgaaacaagggggacaagtaaatctaagctcatccctgctcaatcactgtccccagctctccagatttgcaacccaagagttgtcagatactgatttcccctttgccttccttccccatcatcaaatcttccttcagggtcttatcagtttcttttcatctgtaggagtctcattcaatccttcttgtgtgttattgcacagatgctcatggcctattacatattactatagcagcttcctgtatggcctcctgcattcgagttactccccaactagtctataccccattgccagaataggcttccacaaatatcagttttatcataggaacccctacagaaaaattggcaacataatcaaatgtgaattcttcagccttttacaaaattttatatttttttgaatttttactgtttactttttacaatttaattattttcttaaaattgtgtgggtacataataggcatatatatttatgaggtacatgatatgttttgatacaggcatgcaatatgaaatgaacacatcatggagaatagggtatcgatcccctcaagcatttatcttttaagttacaaatgatccaattacactctttaagttattttaaaatgtacaagtaagttattattgactatagtcaccctattgtgctatcaaatagtagcacattatttactacccctatttacctcaacaacacaccccactgtcattctccctccctccttcgctctccctctcctccctttctctctacaagttcaattaccagcgtaatttctcttgttttcatatctgaagtttctactcaagccacaccttgcttgctgtctccagtatgtgacttgctgtttacaaagctctggtcctttgccaatgtcactccctttggttgaggtactctctgcccttatcactgtcggtttatgctgtgcagtatctacttctaaaaatgtgacttaatggttctttcaggaagctttctacgattacatctgactgctcactcatcccattcagtgtctcctaagcatgtgtatttcatttgtatttgctttttttgtgtgtttttaggctgtttcctatattgatttcccatcacctccaacctgggtgtaaatatcctgagggcaagagcccagcctgattttctcctctttctgctgtagtatcaggctcttcacccaagaagtgttcaaagcatgttaactgactcttgggcataattttctagttataaacatagttgaaatcatctttgttttacagtagtcagtcagggtttccacagagttcagcttgcagtctacaatctttactcagacatggaataaaacaggcagaaaagagtatatatactattgaccaagcacttaattctgtatgttttactgcagttcaattcaatacatatattgagcacctgatgtgtacgcagcaatatgctaagtgctccagcctggttattcacaaactcctgcatccatcagaatcccctggaaggcttgtcaaaacccaggatcaccagcccccatcctgagtttctgacttagtaggtatgggttgggatctgaaatttggcatttctaacaagtttccaggtaatgctgatactgctagtccaggaagcacattttgagaagcagtggtctaggagatacagaggtggtctaagacataatctctcattccaaggaatttacagactctctagggagacaaggaaggcccagaaaacatttaacagtaataaatattgtacagtgttttagtatttattgattcgacaaatattgaataagtactatgtgcccagcactgccccagatgctggagttacatcagtaaacacaatagacaaaaatccctgctgtcatggggggattctaatatgggaaagcagacaataaacaaaataaataaaatataagaaatataagatagtaataactgctaaggagaaaaagcaaagagcaggcataaatatcagatgggggttggaactatagatagggtggtcagagaaggcctcccagttccatcatttgacaagtatttattgagcgactactatgtatcaggcactgttatagatgatggtgatatagtaacacaggtaatgaacccttttcttatggaatggacatacctatttgggagccaggtaacctagagttttggtgttaattctcacaaactcattattagactctgaatggctacttcccctctcagccatggtttcttcatctgttaaatggagcagttggacaaagttatgcttgacgtcctctatacttctaaaacttcaggatgcttagtcttttaggcaatcagaaatatgtaagagtgtttgaagaagactttgcagaggagagaaaacttaaatggttttcacaggcatgggggagctatggggtgtgggagatggaaggtaatttcagaagaagaataacatgagctacagcacggaagcaacaatgggagtccagtattcagtgaagagcaagtagctcaaagggttcccattgaagagtagctgagatcattgggtaggcagtagggggtgattgtagagagtcttggttgggaacccactgagggttttgatcagggaatgacacgattatacaatcaaagtggtgttttactgttttatgaagattaacctagcaaatagttaaatcctcaaaattcattatttttcatcagataatatttgaattatgaagatttacagtcatactctgttataagtcactgcctgattctaatattgctatcaaactaatttttaggtcgttttcaagcccttaaaagcctatgatactacctaatttcccctaacactactactacatgcttgaactggtaacatgttactctttttgtgtgtgtgtgtgacagggtctggctctgttgcccaggctggaatgcagtagcatcatctcggctcactgcaacctccacctgccaagctcaagcagttcttctacctcagcctcccaagtagctgggactacaggtgcacaccaccatgcccagctagttttcgtattttctgtagagacagggtctccctgtgttgcccaggctggtctcaaactcctgagctcaagtgatctgcctacttcggcctcccagagtgctgggattaaaggcatgacccactgcacccggcgtgttactcttatgaaggcttgagagagtaatcagaatagaaaattcttagtacttacacttttttgtgtttctggttatcttataaaatatatgttgaatattaggtttatcttcagccatatatataatttaaatagtactcatttcaagtgatgcaaacatctctaagacaaggctcttcccattcgcttgcttggtcagaggtaacacaagggcaatattcttggaaatgatcctcttgttttttaatcagttgaggtatatccacagctcttgtgtgtttgttgctctagaggctgaaagtagaatattcttcctataagcagttactttagaagataatgataaggagttctctgtccaaagagtgggtcatgtagacctagagaaaggtgtgtcataagaaattatgacagatcaaatcctcaaaactcattattttaatggtagtttaaacagaagtgaattatgacctgcaaaacacttaactgtcacgaagtaaaatgagcaaaagtgacagtgatggttaaattaggtggaaagtgattattttccttttattttccaaattctgcataatgttgctaggacatctatttagaaagtggcaactttcttcagagttgttttgaaaaatgaggcacacccagagaaatctttcacagccgctttttgaaggacagccacaaaagcaaaaacacttcaagaactttgggatcatagtaccaaaaatgttgctgggtcacaagggtgataactttcccttttatgaatgtatgattttctccttatttctttttaataaacaggagatggagaactgtcatgggaacattctgatggtgatatcttccggcaacctgccaacagagaagcagtaagtgtgaatagctcaaataattcaacactccacagcatcaggccaagctttcctctcctcgtggctactattctagcaaatccaaaaaaaaggcccgatttctaacaccatttttcttcccttttctcaaagtttttaatgtcatcaccaactggaaaccatttaagtacactgtaaaattggtaactggaggcaggaaatgtgcacaaagaaaccatagccccagccctttgtctaggtcagaagttggtactctttcaggatgacttgccaagtctttatgtgttctctaaggaagctaggtcactcctatcctcaacagtgaggaccttctgtagggttgtaggatacaaccatctttttggtgggatttggtaggtacttcagacatgtccacataaactctttcccaagccttaggctctcagtcatacagttggaaaagaggaaaggtagcagtctggattctcctctcttcagcctggtgatgtctcccttctgttctctgcactaatctcagaataagcctcacaagtaggcatctgtctatgtaagtaatagcatcttttgttcttttgtattttgaaggaatttataaaatagcattcctctctaaaaatatatgtctaagaagctttacactacaaatttcttaaaatctgaaaaggagatgttccgattcaaagaatctatcatacaaaatgcacagtggtgaccattgcacataaataggtgttcatcacatccttgtacaaaaaaagtatgcaaggacattcactgcgttgttgttttcataaaaacaaaacaaatggagacaacctaaatgtctactagggacttggtgtgtacatccaattaatgggacactgtgcagttgttaaaagaatacggtacatctaaatgtagtaaagtgaattgagctccaagatatgttaagtaacaaaacaaggtgcagaatgaaattgtacactatcacttctttatgtaaaaattgtatgtgcatgtatataaatgcatataaaccaatctggaaggtcacataccaacatgtcaggtgtgctaatcttaaaggagtagaagtgggcaggaggaaaggtagattttgactttttactttatattttctgtataatttgatgttttcctataagcatcaattagttttgtaataaaatatatttgattttctaaaaccctagaaaaatctcagcaaggattgaatatgaggcaggagtccagggaattacagggcaagcctgaggatattgagcatgtgaggaagatgttgataggggatgcagtagaatgactcatacaaacatcacagtgctgctgaggctgggcttcctggtcatcacatgggccacttctaacttgcatgctcccagcttgccaacacccaacccaaagcttcagcagtgagatggaaccatttctatttgtcttactctctatcagtattattttctgaacactgctgtttctgaatagttgcagaagaattggggaaaggggtttggagaacagtactctggacatctcaaaaaatcagcatcctgcaagagagggtaggcttccctgtttgctggttaatataaaccctgaggaaagattttctccacccaactctatctgctttatagtaagtgagattccttccagagcctgacaggagatgatgtcagtctcagttttctgtgttgtctgttcctctttttctcagcccctattttttattgtggtaggtagttgagagtggctgaattagtggctgtcaaccagatgtcattctaaaccaaatttagagtttagtcaccttaagctatgtgacttattccctgagaggcccccacactaagcactatggccaccttagcagtcttgctggtaatgccatgaattagcctttcttcttgacttcattttacactgccctcaattccagcccttatctttcagcttcattgacaggcctagtgataggcctggacttaatccagtacttcctgtagcaaaaaaggtcgggtacagaatgtgggcccttgaaatagttattgattttcaaaggagttcaagacctatctttagaaacaaacatttgtgcctggtagaccaaaatggccatatggtttcactttattataaataaatatttccctttgttctaaaagggatagatattgtgggatatgatttgaataataaatagcatctgtagtaatggaaaaatatatacctggcacatagtagtcacccaataaataaacattgaatgaatgggtgtgggaggtggcgtaaaatgtgtgtgatggtggagtggggagggggttcctcattaattttaatgcacaggaatttgtctcaaatcagagataaactcttcaaatttgttgtttgctcttgaccagcctaaaatgagaaaataggagaatcccttctgaatatcctttgcaggcccaacttcctcagggcaagaagaaaaggcagccctaacaacagatttcttatccaggagactgtccttttcgtaaactgttcctatttaccgggaaccagcaaaacctctgttcaacagaaatacagctgactggtttcttttgccaggtggtctgaaaaccatcggcttagcaagttttatgaagtgcacaggaagaggaaccagtggttcaaatatgactcctttgtaaaaacctgaaacagtttttgtttgatttctaagttgtaatttctcatgaattggtcctcgtgccattggtggggagtgtgtctgcgtgtgtgtgtgtgtgtgtgtgtgtgtgtgtgtgtgtgtgtgtgtgtgtgtgtgtgtgtgtgtgtggagtggtgtggtatgtggggaggaagaagtaggtgcagactagaaagccaaaacatgaaagcatgcataattttgttttggacaacagccaagccctgatttttgccccctgtagattacgttgaaatttaccattaaaaaaagtgaaagcgtttgggatagaaacgacatgaaacagataaaaatccatgtctcatttgtactgtcagaacaatggtttgggaaggaaattggcctaagtgtcttccagccagagatagtcctaggttggtagtgattaagatacaatgttttaatggctgtatggattagaatatattctgaagccgctttttaaattaaactttttttattttgagataactatagattcacttgcagttgtagcagaaaatacagagagatcccatattccctttgcccagtttccccaaatggtaacatcttgaaaatctatagtacagtatcacaaacatgagggccctttctggaccctgatgttttcttgtctacaccaataaaactcttatattttagactttagaacatgaaattcttgggggtcctctacaatagtggggatttttcaacactggaaaagaactgttttagagccacctctaaagcctgaaatatttttcagtctttcaagtaagtaaatcaaaaaataccaaaatactgagcaaaataaaagatcatagctatatggtcatttctaactggttttgacccgctctctcaagcaggctagttgcagctaatttttaagataagctccaatttcacttacaacttcagggcgttaataacctttttctcctttgctctgagttacaaggtcagaatggcccctcataagtctctttcatttgtttaggggaggaactctaaaagaaccattacccttaaatcaaaatcacacaccaccaccacccactccagcccccaaacagaaaatcctttatgtcagtgattcccaaccttggcttcaaaccagagtctcttggggagtatataaaatcctaatgcccaggccttcccccaaaccacttacataaggatacctcagagcgggacccaggtatgagtattttttacagctcaccgggtgattttagtgtatagccaaagtggagtatgtggtatatgtggttgtgaacattgtagctgaatgaacttttgtatctgaaagaacttctctttgcaccagcttttagtcaaatggttatagaccactgagtttgattggacattctttcttccactttctccttcttctccttctcttcctccttctattcatcttccccctactcctacactcctaccatctccaaaaactcaatcttcattatcaccatgagtaaactgcctctcctccttggcctcagtttctctgtctgtaaaacaaaagacttcaacaagattaggttctgggggactgactggtctacaatagggcctgtgatcaaaattcttgaggattttgttttttcatcatgatcattttcctaccattattatatgtcccaggtctgagacgttggtgctaaagaatggcttttcattttgtgttcaccatcatgagtcagagaacttctcgtacttgcagcttatcctgggtcaacaaccttccctctctaattctatcccagtccaactgcttctttttaggatcagtgggacaccaaccagccaaactgtcctctatgtgttcctttggcaaaactttgccaaacttcaaaaaggacagagcaacctataatggcctttgtggaatgtgagtgattatggcagaaaaggacatatgagccattgtgggaatgagaaatatttgaactgagaatcctatccatgtgcatgaaaacaaactgatgcaaatttttatttgtgtgaattttgatagcaatgcaccaacataggctcttcttagatagaataacattgtctttcaaaaggctaaaaaaggtcctcttacttcagctcctgtttactctccctttcccctaccagtggccccttcctgccaagagggcaataatacttcccaaagtgaaatttgcaacatgcctgtctgtggcccataactttaaacagtgttttatgggatatggtcaggggaccccataactatcttcccaaggttcctcactatttctgtcactgaatataaagaccttccttttcaattgcctgtgaaagagttttttaatgggttccccctccttcacccctaacaattgcctataaaatacaattaatcttacttggctttaagccttaaggttccattcttcattcatttcatcttcttgtacccccagcctactttagctcctgggagaggggtgggtagcacaatagtctggtcatcacgtgtgttgaacccttgctgaaagattacttgtatgacaagactctaagcttttcttaggtaccagagttttgttcactcaacaagtatttgatgaacaccttctagatgcctgacactaaaatctaggcactggagatatagcagtgaacaaaaagtccttgatttcgtagagcttacatgccaatactgtcatgtactatcaattcttctacctataaaatacctagggtatttgtactgcattgtatgatcttatgccattacctgtctttagagtctaagtacatcttatcaagactatactcgaatctcatcttttcctcctatccagttcaccctatgcatgatcaggattcaatgctttgaaacagttctgattacattatttctctaactttaaaaaaaaaaatccctcaaagccttctatgccctcacctctattgcttaccaaataaagtcttcaccccttagcctgtcatttaaagtcttccatgatctggcttcaacccacttttggaatgttattctgcaactgttcccttttatggactcgatgttctcttcttcaccttctcaacttgtaaacctctgcctggactattccacttaacttctgcctgtaaaaaagtctacccatccttcgtggcccaggtcacaagccctccccaactagaagctctctctttctccttctgatttgcacaggactgcttacttcttctgcagcctctattcacattctgccttgcgtgcagactactgtcttaactcttaaactgaaatgtgagagtcttggcagcaggaaggacgctttagcctttttggctcttttctccctgagaagtttgcctgtaaatctagtcctatcttttagaagaagagagataaaccttggcaagttgtcattaaaaaaaaattttaatgaaaaaaatgtcagctgcttgtacatgaccacatccctatttctattggtgtaggtaagcatgcagctgaaatcagagctcaccactataaatcaaaattattgaatgacttctagtatataacttaatctctgtgatctcattggtggcttttggactaaatttgttcttgttattttacagagacattcttaccaccgctctcactatgatcctccaccaagccgacaggctggaggtctgtcccgctttcctggggccagaagtcaccggggagctcttatggattcccagcaagcatcaggaaccattgtgcaaattgtcatcaataacaaacacaagcatggacaaggtaaggggcatccttcttttgtatacttccacaacaaggcttcagcagccctggtctttgcagggctggagctgggaaaggaccctttctcccaggaatagcccatattcacttgtggctcacttagcatcaagtctgtgggtatagtcaggtgactccaggagactctttggacttccttaaatgcagccaaaagagcatagtccggtcccttttgtaaacagcctcttgtattttctcaattatccctggggattgtaggtcatttgggaaaatttcttgggtctttaacagaatgagtgattgtctgtgttttagtaggggacccaacattcaaaggtactcagtgccaaacatcactgaagctcttatctataccttagaaatagcaattctcacacctcaatgcaccccagattaccctggggctctcgttaaagatacatattcctagccccacactcagattctggttaaatgtgtagcatatgagactatccttagaaacgagtaatccaggtgcagtggctcatgcctcacagcactttgggaggtcgaggcaggaggatcactcgaggccaggggttcaaaccaggctgggcaacataataagactctacaaaaaaaaatttaatgaaaaaatattagccaagtatggtagtgagtgcctgtagtcctagctacttgggaggctaagacaggaggatcacttgagcccaggagttcagggttacagtgagctatgattgtgccattacactccatcctgggggacaaagtaagaccctatctctaaattaaaaattttaaaaaggaaaaagagtaatccagtgagaaatcccaaaaccacctggctgagcaccaggaagactgatcaggttaagactgacatgctgtccacttagttgatcaactggctacagcaggcacccatagacttccatagcttccaatgtcttcttacacagcattttctggcctccacccgccccctgcccccacccccacacacaccagtagcaggagtcagggaggagaaactcaatcaaacaattgactgcttcttacttttttaggcctcctgtcaaccagctcgttggagcaagggctcagctgtttccttttatgaaaccacaaacatgttttgtttcgtttaaagggaaaacaaatcaaaagcagttttctgaatgggttaaaagtaataaattattaaaccaaatgattgaataacatgggtgaaaaacaatccgttacaaagaactcctaccataaatctcaacaaagctagtcaagccaaagctagttgatcacatctgttactagttagatgtatatttcagattacagataaaaaaattaaattgcttttgaaatttgcaggcttaaaaaaacattcgaaataaaaccattaatggaaaatggtgatgtagtagaagaattggaaatacttactatcgatctgtgtttgatttgtattttattatttttaagttccaaggatttctgataaaagcttatgaaatcaggaagaaaggtaaagatagcttgattttcaattctaaattgcctccaatagattccatttgctgtgaaagtatttcaaagccttttaaaagtgtagggaaatggattttgaaaatcctaaatcccataatttccacaaggtctctttaatttcagggcagaggctcatcccttgattttctccatgtcctacaaaaaccccagctggtttacatttattcatttgcccccactgatttggatgcaacagttctgttctgacctttctaatatagctcactgaggaatcacttgtccccacccccaactcccaagctggatgattcaaaatcatctcgataatttttggggtaaggagagggctatgtttccctgtccagaattaacttcaccccattccactgcagagtctcatccagtctagactattcctttagtccaaatgttcaggggagatggagcctagctatataacactgggaatcctgcctgccctgctcatcatggatcgttcttttccttacatctcttgctaataatgtggtcctctgatatatctacttggctccttgttagcatcaaataagagaaatgataggaatccaccattttgaacttgaatccagcctaaattttcttgaagcatactgtgtgtccacttgatcacattgtctagaagggaacgttactgtttggggagaaaaaaaaaaaaagaggtaagggcaggagagtgaacagcacatctggcctgtcttgtgtgatcctgtccacagccctgacctcacagttgaggtgtcagctctccattttgtctcattgtaacattgtgagccactccagtttaggttattggaaatctttacgtgggttgaccagttagagtgtccagtattctagcagctcttgcaaaggacaggaaaaggcagctaacattattcttatttcttaatgtgactcagtggacttgatgagaaagaactagcccagtgattcatccttctgaggccattgtcttgcagccaaatcagccaattcctagaaatgcatcaagtgggactatttctccccaacagcccagcctgaagtgatacaacccaccctagagatgttgttgattgggatgccaacaggtttccctgggtgtgatgaggtgatgggaataataagaaacacacccagtcctagtcatgacttgaaatctccacaatgtctcagcactctcaaaaagggagataactcatcctcggacttccccatctgcagccttgtgcagttatcttggagcctagctccatgccttatagtaggagccagatatatttggtgttgatttgcatagaaagatactcctgtggccccttccctttataggcccctcagcctgcatcctagatgcttgctccttttttgggtgggtctggggagggaacagggtctcactctgtcacccaggctggggtgtaatggcgccatcacggcttactgcagcctcgacttcccgggcccaagtgatcctcccacctcagcctcccaagtagctaggactacaggcatgcactaccacacctggcgactttcgtattattatttttgtagagactggggtctccctttgtttgccagctggtcttgaactcttgggctcaaaggatcttcctgcctcggcctcccaaagtgttgggattacaggcaggagccaccacacccagccagatgcttgctcttttaaggtccttcagaagacatggggccaatgacttaacttcccacttaacaaatgtcagactgccaaaggatatctgtgaagcaagcagtgatcagctgtagccaaatatctatagccagtatgaggtgggagactgaggaaattgcctgaaattagaggcataaaaggctatcccttcacaagttacccaggagggcttggtcctttccctctcaatcttgacttatcactttccttcctacaccaaacagtgccgaacaccattaagctccatacttatatatgttggtggatcagacagactcatagcatttgacattctgaatggatttgcttcaggatccggaagaaactgtccctttgggaagagcagtaatttttgcatctagcctccatggaaagcaaatctcccaaggaaattttcatgcctggaagcacatccacttgaggcatacaaattttctatagaactgaaaatattaacattacattctactagagatagaactctgctttcatgcattcatttattctcatatatatatatgagaatatatatatatgtggctgggcgcagtggctcgcgcctgtaatccaagcactttgggaggccgaggcaggcggatcacgaggtcaggagatcgagaccatcctggctaacacagtgaaaccccgtctctactaaaaatccaaaaaaaagttagccgggcgtggtggcgggcacctgtagtcccagctactctggaggctgaggcaggagaatggcgtgaacttgggaggcggagcttgcagtgagccgagatagcgccactgcactccagtctgggcgacagagcgagactccatctcaaaaaaaaaatatatatatatatagatatatatagatatacagatatatagatatatatagatatatagatatatatagatatatagatatatatagatatatagatatatatagatatatagatatatatagatatatagatatatatagatatatagatatatatagatatatagatatatagatatatatagatatatagatatatatagatatatagatatatatagatatatagatatatagatatatatagatatatagatgtatagatatatatagatatatagatatatatagatatatagatatatagatatatatagatatatagatatatatagatatatatatagatatatagatatatagatatatagatatatagatatatagatatatagatgatatatagatatatatagatatatagatatatagatatatagatatatagatatatatagatatatagatatatagatatatagatatatatagatatatagatatatagagatatagagatatatagatagatatatagagatatagatatatagatatatagagatatagatatatagatatatagatatatatagatatatagatatatatagatatatagatatatagatatatatagatatatagatatatataggctgggtgcggtggctcatgcctgtaatctcagcactttaggaggctgaggcaagtggatctcttgagtcttagagtttcagaccagcctgggcaacatagggagaccccatctctacaaaaattaaaaaaaaaaaaaaaagcacggcatggtggtgcatgttagtcccagctactcgggtggctgatgtagaaggattgcctgagcccgggaagtcaaggctacagtgagccacaatcacaccactgcaacctgggtgacagagcaagatccggtcttaaaatatatatatatatatatatatatatatatatatatatatacatatatatatttatggactgcctactatgtctgaggccatttataagcatccagaagctgctgctgaagaatctggagaagctcctgagagtagaatatggcccaagctgttttttggtcacagatactactcggtaaacatagccccatggctatgacaagaacaaaggatgcttgatatgttaagtagttcagggcttgggttctgaatatagggttccattttagctccttagcttttaattgctaattctgcattctctttcagtgtgtgtttccaatggaaagacctattctcatggcgagtcctggcacccaaacctccgggcatttggcattgtggagtgtgtgctatgtacttgtaatgtcaccaagcaagagtgtaagaaaatccactgccccaatcgatacccctgcaagtatcctcaaaaaatagacggaaaatgctgcaaggtgtgtccaggtaaaaaagcaaaaggtgcgttggttggaggccctgcttttggttgactgagattctcacctagtctttctaaactttctttaggcatcagaaacataacctttcatataattgtaatgataatatttctaataataatgaatttcattctctcttctcttgaaagactgaaaaggcagttgcttggaagaaatttactacccagaaatatgcttgtgtctaccacacctctcatgtatccctgagtgttgaacttacctatgcttttctaaatagtagagaatttaggctatcatgatgataaggaagaatagtagcagctttcatttatatcactattaaacccatcaaagtacaatcacatccattgcccttttaagacaggacgagaggcaggtgagttatagtggaaggagaccaggttctgatccaagcctaagatgttgagtgatcttggaaatgtgccatatccattctgagcctcatcagccttatctgtacaattgaaagtttagaaaaattatctctaagctcccttctaacactataatcctataattatattattatttattttttaaagataagaaaattgaagtacaaaaatcaaaggacttgcccagattcattcaactaatcaatcataaaaccaaggcctataacccaagtcacttccagcccatcgttttttctatgccagtagaaaatattgactgataaaaaagacaagttaattatttaaatggtagtttttaaaacatgagctaaataaaaatatagtccctaatattggggttgacagaatataggatgggtaatcaagcattctatctctgtcttgccacaggtttcctgtgtgatctataacaagtcacttcacccctctgagcttcagtttccttctttgcagaatgagagggttagagtagattttttggggggcccttacagctccaacattcgaagagtcgatgatttagtcaatcccaggcacatgaatttatcatttcttatgcttctgcaaagcatttttataaacacagatgaaaattcaaacattttaaaaagtaggtagagagctaaattatatacttcttcaacttagtccctcatgactagtaggcaaacatgccctgaatcaatgtgtatttattgagcattttcctgcaggccagtggtactcaaacttgtctgaacattagaaccccttggcgagcttctacatatacctgtgtcccatccccagagactataatttaattgatttgaggtgtggcctgggctgtggcatttttaaaagatccccaggtgaacattgtgtgcagaaaagtttgagaactactgctgtaggcccagggtcatttatggtcttgctactcaaagtgtggtttatggactggcaacagctaggagctggttaaaaatgttgactctcaggcccccactcaagacctactgcatcataatctgcattttaacaagaacctcaggtgattctaatgcacattacagcttgagaagcactgatttatgacacaaaatcttcctcaatgtaacaacccccatcttccagagtacacagggggcagcgtgtggacaggaaggacaggagctatttgataaggtgtagagaactggggcattgaaatttatgagaaaatgtatttattacgaatacagagagaacacattctttttatttttttttttattttttgtttttttgagacagagtctagctctgtcgcccaggctggagtgcagtggcatgatctcggctcactgcaaccttgcaacctccacctcccggttcaagttattctcccgcctcagcctcccgagtagctgggactataggcacgcaccaccacacccagctattcaaactcctgagctcaagtgacccactcgcctcagcctcccaaagtgctgggattacaagcgtgagccactgtatccggccaatggagagagcacattctaaggatgatatggacatccgggccacccagcaacaatgacctattatgacttccaagtctgtggtctcactggatcctcaaaccttttagtatcacatagtggtagtttcatgaacacaattttctcttctgtcaggggtctaacacttaatagtttaaaaagtaatgcaacaagataatttcagacaaaaactaatatttacacaaattacccatgataacataaaccctctcattgtataatattccaatttgaatctcaggccttcagaccaagtcttatttcattgtgtgcttaaaattttattgatgcagatgattcaattaaaaaattaaataatcaaaaagctgtgagaacaagacaaacaacagtcattgcttttaaaacaattgtcctctcaggttggtaatgtttattaaaacatttggtggccgggtgcagtgactcacacctgtaataccagcattttgggtggccaaggcaggaagatctcttgagcccaggagtttgagaccagcctgggcaatgtgatgagacctccatctctacaaaaataaaagaaaattagccaggtatggtggcacgtacctcctgtagtcccagctacttgggaggctgagggctgaagtgagaggatcattgcctgggagcaatggctgcagcgagccacgatcacaccagtactttccagcctggaacagagcgagaccctatctcaaaaaaaaaaaaaaaaaaaaaattggctaaaaaattccacttctaggaatcctaagaaagtaaccacagacatgcacaaagatatacaaataagaatttttgctgcaatgctgtttacaatactgaaaaattggaaataatctgaaagttcacgaatatgggaatgattaaacaaattatggtgtatctgtaccgtggaatattaatatagccattaaaactcattatagaccaagattgaatggcagagaaagatgtttgcaatgtatttgttaagtaaaaatagcaagctaaagaacaatatgtatattatgatccaactttttgtgttaaaaaagaaagcgttgaccaggtgcggtggcccatgcttgtaatcccagcactttgggagtccgaggcggacagattgcttgagcccaggagttcaagaccagcctggacaacatggcaaaaccatgtctctaccaaaaatacaaaaattagccaggtgtggtggcatgtgcccatagtcccaactactcctacttgggaggctgaggtgggaggatgggttgagcccgggaggtggaggttgcagtgagccaagatcgcgccattgcactctggcctgggcaacagccagaccctgtctcaaaaaaagaaagaaagaaagtgtttatatatgctaagacaaaaaaaagaaacaaaaagactggaggagcatacggcaaaatgttaacagtgaccattttcttgtgactgaattatgggtaactcttattttcttatttatttatttgtattttccaaattttctatagtaaatatgtgttacttttgtatttagaaaacataataaaatttatcatgtaaaaaactgccctccagtatcccagttggcagtatattgaagtctgaatgattaaaccgatttttctggaagagctgcttttcccactttcccactctgctcaagtttgtggagatagacgattgattgagcaacatggaagaagagaatttctgtctcattctgtgtatctgcctctcagtgagccagacatgggtgtctgcatgttgaatcactccttagtcacattgcctgagagtcaatagccacatagccaagggcacctgctccaggtactctgcaactgcagagcatcaggaggcatgcacttgctcatgcattcaatctggaaatttgttttaagtacctactgtgtgcaagacacggttacatgcactgaggacagagatgtgaacaagacaaaggctacttgccagcatgctctttacattctagcagaaaagaaagacagtgaacccaaatcaataaggtaattttagattgtgatgagtgctgtgaagaaaaaccaaacaggatcaagagagagtgaatggggcaggaagcacttttaaaggagtagtcagggaaggcttctctaaagatatttgaatagagtcctgaatgacgtgaaggggtgagaaatgggatgatcatgacattactggcctcttaaaaaatgacacatgacacagaagaaaaggaacaaggcagtgaggagagaagtagatggaaggaagaaagaatggtaaattcagttatgttgaaaagggaaaagagataaataaaattcactgataatccagccaaaagtttcattgtaacaagtgattgcagcctcctacaataacaaactaggaccaatattaaagatgtgagtttcatctctctcttccctttgctctggtagaggctgaccttgctttgcatatcaatggccacctacagggttgggtaagatgtccacttcctgaagattccccaactcacttctcacactgtcgtgccaaactcctattaacctcagtagggaaggcaccagatttaagaggccgaagaaaagatccagagccagcaaacaagacatggggttttattaggggctgacatacaggggagagagtccagtggaggtgggctggacaggagaaccaccttacatatagaaacagtccagtggcagcaggttgggcaggaaaactgcaaccacttgcaaacatcatgcagtttatatagcattttcactgaacactctccccttaacgacctggcaaccttcatctaacccaaaactcaaggcctctatcccctgtgcagccccagggatgagcctggggttcagatggtcctcacagacaaggaaataatctcccagttggccacgcctggattcccaagctcagaacacacattcagatacgtctgccatacagggtcattctaagggtacacttaagttattgctatcatgagcatttactgtacatacaaccacaataccatcccaataccttgaatttccataattacatactccttttaggttatggcattaaaagtccctattaagacttaaaagttgtcccagctggaataatacttctccttcattaccacttctgcaaggaattctggaaggctcaggatgggaacattctcttgggctgtggaaatggccagaaatgacatcaagcacattgtcttccccaaaagaaaatgagagtaggtgaactatagtgatcagaaagcaccttgaagtgcagagtgtgaaaaacggcggatgttgctaagtaggtagttctaaagacaaactttgcttttcttagcattttcaagtaccagccagagttaagtcaataatgagttttgttgtttgtagatcccttcggtcaagtaaattaagctcttgtagggaaggaggtagtggtgcaagatgactcttcaggctactggaagaacttttagcatattacaggtactgccagtgccatcatggatttcatgtcagctatagctgtagccaatattaagctggtgagcaaagtttgagaaatgaatttggctgtcattctaaaggtgataattgaatacacagaagtctctgtacactcagtgacctcttccctctctccaacccatttaaaaagtgctagcacgtggcccttaattacctatcaccaaaaagactggcccaccaagtaaataaatagctaaaaagaaggacaaaaggaggaaaacaaaaagcttgattccacaataatccacaaattgagtaattcagtctggaatcaagagaagactatggttttgtccttacaatgccaaatggtggtgggggtgggaaagctaatcaggttaccaagagacatacaatagcaatttgattacaacttctagtccaaatgtgtctgattggctaacagtgagtctccctaattagagtcacagatccaaagcactcaacactcagtggtttcatcctcaacaattcagatattcttacagatggcttctgttgttctgatttgagtgtatgctttaagtacgcagttcaagagagtactgattacaaggccagcaagcaaacttaactcactgataaccaacaagaagaaactttttaaaacaggggactgaggaaagaggagggagggtggagtgaaatgtagagcttgtgcctttatgcctgcgagctgaaattcaacagtttagtttacacattaaatgatccatcgctgagggacttgaccaattttttgtgtctcccaaccattcatttggcatagcatacatatggctaatctgacatctagattttggcactggtgctgatccggtattattgttccccttacaaacaaatcaaagagcattcagaaatgtcaagccaatttggatggatcctttgggcaagtatatgcacataaatgagtgtcatgaatgttttctaagtataccaaaatgatgtcaggggatgttaaccaaggccctttttcagcccattccctgggcctctcctggcaacactgagctggacagagcatgatcctgaccctgtatggaaattcctatgttctcttaagtgcctaggagatttgtacctggctacatttttcctcatgaaagtccacttctcagtgacagtagtaggggtctagtgttccgaagaactatggattctgtcaacacatggacttcaatcaaagttacgtgctcctttgtgatttgtggcttaatctgtggcttgttgcagtggcagcctaagctgggctaatgaagtatgggtggaatttctgtctctcgaagaatgttcttgttaattgtccacttttgataagtgtgagatgttatgaacaatgagatacataaatgcagaagttcacttctagctttagaaaaccatgacaaaattctacttgcttcctgattccagaagaacttccaggccaaagctttgacaataaaggctacttctgcggggaagaaacgatgcctgtgtatgagtctgtattcatggaggatggggagacaaccagaaaaatagcactggagactgagagaccacctcaggtagaggtccacgtttggactattcgaaagggtgagcaagacaacattaatttctcatctttgtaagggggcacagaaaaggatgagaggactcactttaattttgcttcaacctgttccctcatttggattaaaagttctttttgattgcttagaaactgacatatctaacactattgtcattatggcctttcaaatttaacgatggcctgtgctaaagatcaagtactgacccttgggtttccaaagctgcctatttcacaccaccaaaagctggagaagcggttctcaaccctggctgcccatcagaatcatcagggagagttttggtttcctttaaataccaaatatctgggccctacccccagagattctgattagttggtctggagtggggcatgggcatcagtgtttgttcataatgcttctcaggtgattgtaatatgtagccaggattacaaactgtcaaactgtagtctgtcattctttccagaataaagctcaacaaccatgaaaacccattcattcagggcaaagctaagtccctaatatcacgatgtgtcttctggggtaaaacaaatttaaaacatcatccctgccctcaagaaggttatagtcttactggagaaaccccagtcacaatgttcaattccttttctgattactcacagtgactaccacagcaagccacattctgttcattgtgatcctacagctcttctaactttttgtaggctcaagactagtgcttatttagtgtggtcaaggttcctcacaatccaagtggataagtgagatttcagctggaaaatatacacatctttttgctattggctctcacataaggctcaagagtactcgaacttctgtatgcatcaccattacacagggagctggttttaaatgcagatacctggccccatcccagagataggaattcagtagaccttgggtagagtccaaacatttgagtgtttaacaaatagccagatgattctaatgcaggtggcacttggaccatgctttgaaaaagactgctcagtatttatgaggctttttttctctccctttagacaacagcctttatctaaagaatgcatttctccctaaaaaaaagatgcttgaacatgtatatattcactcatgcttatttttggtctatgccttggagtgttgatttgccatctttaactccctagctcatccataacaggacacctaggactaggcactggtttgttgcgtttccccagcagtgggcccactattcgtcatcccacatctttcgcctctcagaggtgtgcagatgaatttcaacttgctaatgtagcgtctaaatatcctcttgttcacagttctgggttatcaaggtctatgcttggtggacacagaaaaagaggcttaatctacttcgcccatttaagtgggctggtaatatgttgctccttcagtataaggcagttgtcagttgtctacctgttattgtgataaaagctattcaggcaaggttgagactgtggagagcactctattttaactctccccatttatgaataaggaaggctaaaggatctgtgaatatttcccaaaggaaaatatgcttttcagtgagttcaagaacaagggtggcttctccatttacaaaaccaacctgcctgcaatcccactgcaggctctcagtgcttagccaggagggcagcccagcggtttggcatggacacagtctatccaggttgggggcaagtgcagaatttctaatactgcctatggctgcagaagctccagtaagcacttatgctagattccatgtggctttccctaggagagagtcccatggtcagcagcactatctcccttatctccatccactggagaagccgaggggaagccagtaagccaaggaaacaaatggagtcaattataacccttgagccatccaagttcctggttaagcacattacacagcccaactcgatactcttaagccctagtaatgaaatgatatgctgagcctgagcagaaaaaaaggagttgatggttccagattgagtgcctgaccatttgctccactttttgcttggccctaggcattctccagcacttccatattgagaagatctccaagaggatgtttgaggagcttcctcacttcaagctggtgaccagaacaaccctgagtaagtagtacttctcttgactgctccctgaaaaacacattcagttttcaatttagcatagccacagctaaagtccctccgcaatctcagtgaacattagcactgctcagtatcaacactaaaggatgttccatctctcttctgggtgacttagcagtgaatggggtgtctgaatgtaatctgaagagcttggacatggtgaatacaaacccagatgtagtctgagcataggatacctcaggtcaaggcttcctgaatgtctttaatgaaactgctaagcacagagtctcaagagggttggagaaagctcataagattccaggtctggtatatttatggagacttcacatctggaagggtgtatcctctggtggtgggtatgagaggcaaagagaaattaaaggcatatcaattcctgtgttatatgaaagcacttttactcctggggaactgcccctgggtggtcatgtttccttaaaagcattcaggcactcaaaaacacttgcagctctcccactttccacactagatggagcctagggactaagatacttctaggcattggggcgggtgttgagcacttctaatgggataaaaggcacacagtttctatccacagggaattataatggatgagacagaacatgaaaatgacttcagtatgaattagtatagttctgaggagttaaatatcaaagtgctcaggggaatctgcaaagaacaatgagatgagagccaggtgggcttagtcggggaaggcttcggggaggaggtgtgttttgaaagagaagggtatgactgggcaatgggtcaggaaatcagtccaggaaaagagtgcagcctaagagaagactcagacaggagcaaacaggaaatgtgggtaggggagaggaatgatcacaaaggccacagaaggtgcactaaaagattagaagatttggaggtagaaagtagtcatagggcctgaaaaaaagccagtaaaatgttcaaatgtaaggcaagtagcatctgtagttgctgcaaatagcatagagatatcaacatggtgctttggaaagatgtctttcggctatcagatgcatatattacattaagcacacactttgacgaagccagattatgaagtgcccaatttatcatgctaggacattggacttgatctccaggccagagaatgccagtggaggtttttaagcaagtgaatggtgcattcagatctgctttatttatttttttatttttttagaaagaggtcctcgctgtgtggagtgaaaggtggacccttattaagagaagtgggatagtctgaattaggaactaattatactatattaaatcaatgagacgggaggagacgtcactgtgagaaacatttctgaggttaaatcaacaagatcagcatcaaagagagaaacgagtttggaatgggtccgatattaataactcgactgggtgaatagtaataccattcaccaacagggaaactgtgaagaataagcaggtattggtgaaaaagagtttcacttggaacatgtttaaattaatatgcttaagagccatctgagcagagttagggtccaataggcagctagaaaaagagccaaggcagtcagttgcttgtctttggcaggactcatagaaaataacaggacagtatgagaattcaaatggaaaagttgggagtccttacatgtgagtaagaaaggaggcagagtgtaagatcctaggatcaattatgggacttctgaagttacatgttttagttcatactgtgaacaaggctttgttctaggttccaggggacttaaaagatgatttagatatactctgtgcccatggcaggatttggggtatataatggagtagaaggtatgtgcctcaaactgtgtgtagctgaaagaagttggtatgatcctacagggtcacctaggagcaaagaagaacaaacccaactcttttatataatgtgcctagcagagcccagcacattatagggcttcagtaatagctggttccttgcccaaatcctcttcttgtttttttgtttttccttctatcttcccattgagtcatagagaatggggaaaagggagaaatccaagggagaaaggagcagagaaatcaggcccatagggaaggtgggtcattattctcttgtggctaaggaaaagaaaaagaggttcaagacaggtttgggcttaagaggagttggcttaacttggactaggagttctccaggttgcagtaccatgagcacaggaataaaaagaagacaaaacacagtatccagggtgggcagagacaacaggggatggaagggctacagccaagtttactctgcgtggaaagggattccatggggtatatgagaatggatgaggaaccatgggaagggatttagggtgctaagggggtataaggacagcatgtggacgtaggagaaagcaacgtcgagaagtttttaacaaaagatagcaggaatagaggaaagagtgatatataatcaaatagtaatcaagtaacccaaaccaatatttggggaccctaagggtaagcaaagccccagtaatacagtaggtgccgttttccaaagtgcctttttgacctggtgccaagtaagctgcctaaatagctaacaagcagatattgaagcattttgtaaatgctaaatatactgtaaaaattccaagaataacacttaggttttgctcttgaggaggggcagttctatattattcttgggattcttacaaatgctatgtgttgaaatgaaaacttcatttcccattttccatatctgctactagaaaagtgttttggggccattttttgaaaccaagtgatatttgtattccaaattccctggtaggtccatgagtaagtgggtaagcatggggtatattggttctattcctaatttgctctgctttcctcttacacactcccggccactttgcgtttgtttgccttttaggccagtggaagatcttcaccgaaggagaagctcagatcagccagatgtgttcaagtcgtgtatgcagaacagagcttgaagatttagtcaaggttttgtacctggagagatctgaaaagggccactgttaggcaagacagacagtattggatagggtaaagcaagaaaactcaagctgcagctggactgcaggcttattttgcttaagtcaacagtgccctaaaactccaaactcaaatgcagtcaattattcacgccatgcacagcataatttgctcctttgtgtggagtggtgtgtcagcccttgaacatctcctccaaagagactagaagagtcttaaattatatgtgggaggaggagggatagaacatcacaacactgctctagtttcttggagaatcacatttctttacaggttaaagacaaacaagaccccagggtttttatctagaaagttattcaagtgaaagaaagagaagggaattgcttagtaggagttctgcagtatagaacaattacttgtatgaaattatacctttgaattttagaatgtcatgtgttcttttaaaaaaattagctccccatcctccctcctcactccctccctccctccttctctctctctctctctctccctccctctctcacagacacacacacacacacacacacacacacacacacgcacgtccacactcacattaaacgaaagctttatttgaagcaaagctagccaagattctacgttacttttcccttgactggatcccaagtagcttggaagtttttgtgcccaggagagtaaataactgtgaacaagaggctctgcccttaggtctttgtggctgtttaagtcaccaacaatagagtcagggtaaagaataaaaacactttcatagcctcattcattcacttagaagtggtaataatttttccctaatgataccacttttcttttccccctgtacctatgggacttccagaaagaagttaaattgagtaaaatcatcagaaactgaatccatgtaagaaaaaataattgttgaagaaagaagttgatagaattcaaaaaggccatctttttgctttcacatcaataaaatttaccaagtaat

SEQ ID NO: 37314 - DNA, 98456 bp, Homo sapiens
gccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagtaagtggccaggcgcggggggatggaggctgggtggcccggagacctgggagtagccttgcgggtccggagcgctgggaccgcgacccctgcgcctcccgcaactccgcggggcctgcgcccccgccgtccccagcctgggagcccgggctttgttcccacgttctgcgccctgggaggtggcagaggtcggggaaacccggcgcagccagaaaacagccggtccgctcactggctagccttcccttctcgccttctccttcctctgtttttctgcttttggcttctctttccgccgttctcggggcttatcctcctccgttttctcacggtccctcgtgtccgctccgcctctctctctgtctttctctctaccgcccgctgcactcgccaacgccgagcatcccgagcgccctgcccgtgtggcctgggagcggcttcctgggaccaggctcggtgcctgccacactggtggggtaggacataaaatgcccgcggcagactgtggtagccttggctaggggatggctcgctgggtatctgcagccacacacttcggatccccgagctggcaggagccctactgaaggccaagtcaaacgcacccatttcacagatggggaaaccgaggcccacaaaagggaaaggacttgcccaaggccacgccacgggttgaggtccgcggtggcactggaaaccagggctctctttccacgccaacccgacggccgccttctttggtcctcagtttccccttctgtgaagcgaaggggtctgactcgatgtttccagctaagatgccgggtgatgtccgtgtttctcaggactagtttcccagacaccaatcccctccccggctccatccctcgggggctataagcagatttcgcggaaggcttggtcccggggggcggtgcccgggttctctcattatgaccggagaaggcttagccctggctccaccgctgcagacgggctgggctgactccagactgctgcttgggggaccaacagtcagcgttttcaaatagagcgagcaccggcggagcgagggtgggctggctggacccccgggccgcctcaaacccagaggctgagagctcttccgacagttcggaacttccaggggccgaggtcgggcggtcctcccaaagggctcaaaggaaccgccctttgagctgttgttccgaaggggaaactgaggcacagaggaggttctagggtagcaccaggcctgtgtcagtgcttagtgcaggagaaaagcatgaagaaagacaaggaaagctagttactgctcctagcacaggcgccttctctgagttttgagtccttggagaacacttgctgtagaatatctgggaaataacgaaaagtgtaaaagaaaatgatctgcaacccccaaatccacagttgctgttgatattttgttttttttcccctccacattctttgtgtgttcctatggatatatattgataaaattggaaccatacccataagtacagtttcgtgtcttgcgtttttcacttcacaccatgagcgttttccacatcatcaaattctctgtaaaacatgattttaatgactctatacaaagttttcaaaagttaaaaacacgactcatacaaatgtggccaagatttattcaactcattaatgaggtagcaaacaggagagtaaagctgattcagggagcattagaaaggggtgatacaagcattggagaaagaatgttgaaatcatgtggcccagggcagatgcagaaatggtggatgccccatgaagcaaaccataattcttggttatctttcttttttaatttccttccttcattccttcttttctttctttttttttttttcagagtctctatctgttgcccaggctggcatgcagtggcacgatctgggctcactgcagtctctgcttcctgggttcaagctattctcctgcctcagcctcctgagtagctgggcttattggcatgtgccaccacacccggctagtttttgtatttttagtagagacggggtttcaccatgttggccaggctagtctcaaattcctgacctcaggtgatccgcccgcctcggcctcctaaagtgctaggattacaggcgtgagccattgtgcctggccaggttatctttttactatgctgaaatcacttacatctctgtcagacagaattctatagatatatatagattatataacttcacagagtgtagcttttaatcaatggtaaataaaaagtcaatggtacattcccctagataatgcagtaatccatgggtgagtctgttaaacaatgctctgatacaacattgagaagacatcttgcttgctcttgccttatttccaagttttggagaccttttcttaacatgtactatgttcctcttttggtgagattttagattgctttcactatttttttacaatcgtagatatcatttaattccattaaatgctccattaaatattatagaattcctttttgtttaaaataatatagacttatcagagccaccagggcaagagcgatgcttgtcttttttttatttctgagatggagtcttgctctgtcactcaggctggagtgcactggcgcaatcttggcctcccagattcaagggattctcgtgcctcagcctcctgagtagctgggattacaggcatgcgccaccacacccagctaattttcatatttttagtagagacagggtttcaccttgttggccaggctagtctcaaactcctgacttcaggtgatccgcccacctcggacctccaaagtgctgagattacaggttgtgagccaccgttcctgtcctgcagtatgcttgtcttgttcctccatgaatattaagcacctattcatagcatagtacttggcacatagttaagtactcagaaaatatttgataaatatatgaatgcattgtttctaatatttgcctgtctgatgaattggtgttggtccaataagattatttttaaaatctatgttgactgcaagtgcattatatcggtattctgaagagaatgttaataattactcataatcaccactctaacagaacaactatggccatctttttatcattcatattctgtatgattgatgtagttagtttagacagaatagattttggagtcctcagccccattcccaggaacactacggagaccagtctgtttaggtgtcgggaaattaccattttgttaagatagtctgccgccagtatttgagttctgcagcgccctgaacaaatctctcctatagtttaaattctctttcttgcaaaacaggactcctcccagtctctagtaaaaatacaaaaaaattagccgggtgtggtggcgggtgcctgtagtcccagctactcgggaggctgaggcaggagaatggcatgaacccggaaggcggagcttgcagtgagccgagatcacaccactgcactccagcctgggcgacaaagcgagactccgtctcaaaagaaaaaaaaaacaggactcctacttcctacttcccagggttgccttgagcatgaaggagaactggtttgggagagtgatttgggaagtagaaagtggaatacaaatgtaaacttgccattaggaagctccaattaatgtaacttgatgcagtgatgctctgcggagtaggaggcaatttcatattgactcttcacaataaagctgtgagatgggcaggtagcatctttgtcttcattttacaggcaagaaaactaaagctccatgggagcagtattcatgggcttgacctccagaatatgcccagaatcccaccgcttcattcctctccactgatgtcattctaatctgagccaccatcatctctcaccagggctccagcatatctctagcctggccttcctgcttctgctctcactctcgccgctctgcctcaccccacccccattctccaccacgcaggcagagtgatcttttttaaacttaacacagatcatattgctctgtatttaaaacacccagtgccttccaagtctatttataagaaaatccagacactctccgtggtctctgcattatcagacccatggctgtcttgctgaccacatctcataccaacttcctctttcatttactagctacccctaccttatgcttgttccttcaacaggccaagttcacttctgctcaggcagggccattgcacttgctgtttcctctacctggggcactcttcccccacgtttttgcatggctgccttctggctcctcaggactcaaatgccatctatgctgatcatcctgtttcaaataggcacctcctgatagatgtctctttactccatgaccccaacttattttattcagggtacttagcaccatgtgagaacatttgttcattgtctgtctcccacctttacaagtacagagaccttatatgtcctatttaccacaatatcaccgacacctagagtgcctagttcctaggaagtgccaagagcctgaaatccagcaagtcttctaatgacccagtgcaggggcagctcacagaaagtgcatgtgtggcttagctggggtatagaggtctgggattccaatggttttgcatcttgtattggcaggaggaagtgaggaaggcagccccaagctgcagcatgaacttatcatacctcagtggaagacttcagaaagccccgtgagagaaaaggtaagactcaaaagacctcatttacactggcaggagttgacaactgaggtttgggctacctactcaactttcttagaatcccagtcatcaccattagttctgtttctggcccactctgtcctctgggtgcccattttggagatcacagatgggactttccttccttgtatgacaaacttctagaacacttcccaatgctattagttgaggaaatgaaaattcacattaatgctgacacaagctaagtgcagatgtgttggtgtcacagaaatcacttagtcttgattggaattcattaaatattgtcattgttatttttgctctgcataatacatacttcattttcttgaaggaataatgtacttggagagaaaaaagataataatataaactataaactattttaataagacgcagcgtagagacctagtactggggaatgtatcttaaaatccagtaggctcccctggccagaacaccaggaaaacacataggctttatcaaagagattgggaagaaaacaaaaaacactgtcctgttcttgcagagaggacctgagcatttaggatattctttgtggttctggtttttgttttttgtttttttgtttttgtttttttgtttgtttgtttgttttgacagagtctcactctgtcgcacaggctggagtgcagtgacatgatctcggctcactgtgagctccgcctggcaggttcaagcgattctcatgccttagcttccggagtagctgagattacatgtgtgtgctgcgaagccaggctaatttttgtatttttagtagagatgggttttcaccatgttgtccagggtggtctcgaactcctgacctcaagtgatccgcccacgtagtcctctcaaagtgttgggattacaggcgtcagccactgtggcccactgtggttttggtttttccagcaagtgagacgtgaaagagcaagaaaggaagatgcggttgttgtgtgccagtaaccagctatgtgacctgccacttgcgaagtggtagattttcttcatttataaaatagtgcttagagagaataaggagaaaagaaagctggggagaggggttttttctaagatctctttgggttaaaatgatttgtgatttattgggcaacatataggagcaagattatagcaggaaagagatgtgtcaggaaagacttcagacattgtggctgttgaatctggaaagataaatggaaaggagcaatgtccaggatccttgaaactctggccaggataatacagacatgtccaaaaaggctccaacttggatttaccaagggaacctaacagtgtaaattttaggacagaccaagtgcgatggctcaagcctgtaatcccagcactttgggaggctgaggcaggaggatcatttgaggccaggaatttaagaccagcctggggcaccatactgagatcctatctctacaaaaaaaaaaaaaaaaaaaaaagaaaattagctagacctaggggtgtgtgtctgtagtcccagctactctgaaggctgaggtgggacgatcgcctgagcccaggagtttgaggttatagtaagatatagtcgcatcagcatcactgtcctccagtctgagtgacaatgcaagaccttgtctcaaaaaaaaaaaaaaaaaaaaaatcaggacaaataaaagcaagtaacattttgtcctaaaggcagtaaacgcatggaattcatttcatcaaaaagtaggagaggctgaaaatagcttcaggaaaagtctcgacaaattaatggatggtcatcctagagcagattacttttaacaattaagatcttgggtattgcaacctattcataccccctgaggaatggacctgctactttttatagaggcttctttgttctctccagatgtggatgccgggcatcctcaggaagggcctgagaacaaagcagaggaccagatcctgtctttgttcccaaccattgtctgcccagcatatgggtcattgtattctgtaggaatagtcagcatagtgcctggcaccgtaactatttgttcaatgaacaaatgaatgaatgttgaagagagagagactagaggctggatttcacttgggcctctcattctcatttatataattaattcactcattaaacatttttttcttctctttttctcatcactgacttaaagctcacattcattaaacattaactgaatacttatactgtatactaaatattatactagatcttagggggaatgcaaatataggacagatttccaataccctatggagctaaagatctatttaatctagactgaaggggaaagaatttttaacccatccctaggagaggtataaatagtgggtcagcttactgtacttcataggagaggagagctgatggtgcctcttcttaatacagagtggagtttcatcagaaaagctcatcagtagagccggacagaaaagcttcatagatccttaaaatgcagtttcattgttttgcttgaaatgccccatagaaaaagggaacatccttttttaaatatcagtgcctgagcaccttccagaatagagagaattatttttggatcacccacataaaaataaagattactactcctggcggggcatggtggctcacgccctgtaatcccagcaccttgagaggccgagatgggtggatcacctgaggtcaggagttcaagaccagcctggccaacatggagaaaccctgtctactaaaattacaaagattagccaggcgcagtggtgcacacctgtaatcccagctacttgggaggctgagcatgagaatggcttgaaccctggagatggagtttgcagtgagccaagattgggtcactgcactgcagcctgggtgacagagcgagactctgtttaaaaaaaaaaaaaagattactattcctgctgcagcttgtgtctctttgggggaggggaagatagtgctttgatttggggcagtattcattttctgtgggggcagtcacatggttacctacctcttggatgagggaattgctgtagctctgttgctgtgtcgtctttctttctttcttttttattttttttttttgtttagacggagtttcgctcttgttgcctaggctggagtgcaatggcgtgatctcagcttaccgcaacctctgcctcctgggttcaagcgattcttctgcctcagcctcccaagtagctgggattacaggcatgcgccaccatgcctggctaattttgtatttttagtagagatggggtttctccatgttggtcaggctggtctggaactcctgatctccagggatccgcccaccttggcctcccaaagtgttgggattacaggcgtgagccaccgtgcccggtctgtgtggtctttcttaaatgcccacttggagctggggtccctgatgctcagtgtgattgggcagggcactgcctcaaaaactccataaagtggcaaaggatctgcaaccagaataggtgttggcagagctgaatcagggcatgacaaacagagaagtgaatctcttagtgaaagttattggtcaaacatctccccagcttcctacttcggtgggtttgaaatgttccttcttgagatgaagtaatacgattaattaggcaatggccagcgttgcccaagagcctttgatcggaatgttgagatctcatcagagcccttggtgacctcaaagtctcagaaatgcccaaatcctaatgcagagtggggtttgcagcgaggaaggggaatgtgcttagacgaggtaggcttctaaccagaggtggcagaacaggtgacctactttctcagacatgcaagaagtaagctttgaggtcaaccttagaagggctagaagctctactctagcaatgattttgtggattgaaagggacttcaagaatttatctgctggatgaggtggctcacatttgtaataccaacactttgggaggctgagttgggaggatcacatgagcccaggagttcaagatcagctttggaaacatggtaataccccagtatctacaaaaaatttaaaaatactagcccagtgtggtggcatgcacctgtggtcccagctactcagtatgcttgagcctgggaggttgaggctgcagtgagccgtgattgtgccactgcactccagcctgcacaacaaagcaagaccccgtctcaaaaaaagttgtcagttccttagtcccaaaatagagagcttatgtttaaaacactccaaagaatctgttctgttttaaatatgtaaatatccttttttaaaaaaataatttatttcttcgaaaaaagttcagtagccttaagttgaattgttgaagcgtggagatttattatgacttggtttttaaatttctttgaaattctccacaataataaagtaaaaagagattaataaaaagttcttttcttaaactgtgaaagcaattgtaaacatgtggaaagatgtgcaaaagaaaacaaaattaactcatgatcccattaactatggtaatggttaggcttatttctctctacatttttccctttgcgaagtgtatttaaataaaatattcagtattgtattttgagctttatgactaatgattattgtgtacattttgtcagtaatttaacaactacttaaagttgctgcttttaatgatcattcagtgttctgtcatatgaatggatcatcatttatttaaccattctctaacaggttatatttaggacagttaggttacatttcattattcattactttttttttttttttttgagacagagtctcgctctgtcgctcaggctggagtgcagtggcatgctctcggctcactgcaacctccgcctcccaggttcaagcgattctcctgcctcagcctcctgaatagctagaactataggtgtgcaccaccacgcccagctaatttttatatttttagtagagacggggtttcaccatgttggtcaggctggttttgaactcctgacctcaagtggtccacccgtctcggcctcccaaagtgctgggattacaggcatgagccactgcgcctggcccattattcattattataagtaataaatgtccttatgtgcaaacctttgcctgtgcctccatttattcctttcaaacagcctcacattcctgagtctaaacatttttttttttttttgagagagagtgtctcgctctgtcacccaggctggagtgcagtggcgcaatctcagctcactgcaaccttcgcctcccaggttcaagcaattctcctgcctcagcctcccgagtagctaggatcacaggtgcccaccaccatgcctggctaatttttgtatttttggtagagacggggtttcaccgtgttggccaggctggtctcaaactcctgatctgcctgcctcggcctcccaaagtgctgggattacaggcgtgagccactgtgcccggccgagtctaaacatttttaaactctcagtgcatactgtcatgttatctttcagagagttgccgtcagtttaaattctcagtggtagggattgcgagtgcccagtttacagtgggcattgtgcattgtgatttagagttttagataacctctggcactttgatttttttcaaggtatcttattatttttaatttgtttttctggacgtggggaggtggtttattagcgatgtcgaacatagtttttgtgcttatcaaccactggtatatgttaagtgatccgttctggatatgtagcacctgtggccactaccaaactgcttatgtgtaaaatgtatctactttttggcctataaaaccttaatttgaggatctcttagttgcttcctctgagatgattggggttttccaaacggagagccaaaatgaaataagaacccactacgaagaggatcccctagtattttacaagataataggcaatatgtatcatggcttgccgtgtgccaggcactgtgatacattatttatgctcattatctcactcaatccttacaagatccccatcaaattgactattactatctctgtatcatacatgaagaaactgagatgtggggaggctcagcaacatgtccgacttcacacagctgcaggtgtcagagccggtgcttgaatccagatctgactctgcaggacatttactgctggagattgtgttttccagtgtttcccttcaccgcaccacatacatacacttacaccacattgcagcctggagtttcttctctatgcctttcaggagaaagcagatgggggaaggatttgggtcattctgggattgaggtcattttacatgtgggctggaaatgcaattgacctttgctcattcacttcctgtggatcaatgttggagcgctgtgctagatcctgtgcccgacccagggagcctggtgccggcttttaggaactgacattgttttgttgttgcttttagcatccactcaaagctgagctcagggtaatggctgaggggcgagaactgatcctggacctggagaagaatgagtaagtggactcctcctttgtctaaaatgaaacaaataacttctgtgtcaacgccggacgcaggtgtcgctgttctggaaggaagcagtcaatggagtgaccccaagctctcagtccttggtttctttcaggcagcatcttgcaaagccagagcctttccacagcctcttgactcgatgtgagattgctggactgctaaatgtgttgctaaaatttccttaggcagtatttcaggggcccctggagttcactgcgggcacacagaggtctgtgtatgtgtgagattaagggagtggatggaccagaggtctttggcagctgccttactagcgccagcctagtgtgtggcaggaaatgaaggagattagaggaaaacagcagagaggagcgagcaaagcagggtgtgctggggcttggagcctcagactcagattgttccatgtgttctggttcagccgcatctgagattttgtcaacagggcatcgtcaacagtctcctggctacatcgggcccggctcttccatcttcttaacctcattcatcttgggtggtagcctggctcagaggcacttgcacattgatttgccatcagatgcagtcatatctggattcatgtaatggaggaggtgaatgggcacgatgcatggctatgtctgtggctcattctttggccattccccatctacttagccatgaagagctctccttacttggccgggggactctgaaaacatttggtgtttccccactgaccgtcccacttttcgttctgccacacagacgtcgcagataaggctgcgtggcttggagagctgcctgtctcctcttggcagcctccagaaccccctggaagccaatgagtaatcaaatgcatcactgccaagaaaaggatgaagaaggaccttcctgtatacaaaaggatgggaatagcttttaggcttgggtggaaagggagaatataatttattccaaatttgggctttttgggcacttgcaaaggaggatgagtgctgtcccgagtgtggttaaaatacaactcacagcttgtgcagtggtggggcttcatccacatccttcctctgcctccaggacatggtggcctcgggaagccagaaagatggggatcacagtcatttttgttcctctcctcttgagagtaaagccagtttaggctgtgtttcttctctcctgtgtccctggaatagacctggccagctgcgtccctagacagtgcagcgtctattggccctggatttttccttgcattgtcttcctttggtcctacaagaaaaggcccttagagggtttgttcttgaccgtgtctctcgggggcctgcctttgttgctcacggcagctttgttcccattaactctagtctaagtgttccctgttgttgcctgtgtctaatctctcctgttctgcccccagtagagcctgtggcccttcagctccctctggtcagcccaagtgatagtgttggtgttgtgggaaaatgcttaggagttggactggccaagcaggagtcccaggactcaagtctctatccttccctcctattttgaaacatttgctacagaccataggaagctaaagcaggaagatgccttagaaaacactgaatggaatgatcttagaaaactctgaaattatggatgcagaagttttgattcagagagggataggcatttgtctgaggccacccagcaagtaaatgaaagagctgaaactaggatcatgtgtattcttggtgtgagtctggagttacagaatgtgacccagggcaaatggctgaatcttttggaacttcggtgtccttgtttataaaatgagggtaataaggccagcctcgtgggatggttgtgaggataaatgaggtgaagtgcaggaagtgcttgcacagcgcatggtgagtggccagccactgttgggatttttattgtcccacactgaggctccagaggagagcccggggctgtggttctagcatctgcttttccgagagcagctctcgtttcccattgagccgcatggggctggatgtggttcctggcctccttgaattggcagaaggcagcagagttggtaaaaatggaagcagcagagccaagcaatatgacctcaccaggtgtccctgggggacggcttcctgctattttcatccaaattgggctttttgttttgaacatgtgttagtgagcggaactccaactgcacacgacttcctagtgtgtttatttcccaaagccttctcattcatggtgcgtgcgagtccggattcaaaacagctttggagcgggggagatgattttctaatttttcaaatcactgtgttgaagtttctataatctcatgacatttgggggaaactaggccctgggccaagccatttctcagcctctggttcttaacctcctcgatcaacgtattcatttttttttttttttaatctacgtgcctctgtgacatttcaggcaccagtgcaggtactggggataaagctgtgaataaaacagtacagcctttatggagcttctattctagtgggaaacagtaagcagacaagtgagtgcaccgtccgtcaggtgatgggtgctgtgcaggagacagaggagcatagggagtggggccaggggagtgtggaggtagaatgggagctgctgtttctgaatggcagtcagggaaggcctttcaggtgaactgatacttgagtcaagacctgaaggaggtgatggagtgagccatatgggtagctgagagatgacaattccaaggagagggaacagccacgttccaaggccctaatagatgatgaaggtttccactctccctctgtacatttccccatacactggattctcaggtctcccaggagcggtgagcaagggcttctgggactctggggggagggagaggacattttaaatttctttttcatcatcctgccgtgtctggccttctcccatcaaatcaaagcccacgtattaatgcatggcccaaaatagcagtgagcaagcctttaatggaattcacacatggagagatcgccaagaatggtgaggatggaaaggcatggggcatgggccaggagaggagggggaacacagcaaagtgagcttcagctcaggcagcagacacactgaggtgtcctacaatagcgcggcagccggcagcctgtctctgctttgaagcaactcagcaactcacggatgacatccgtgagaagcacacattcttttctctattgagtgcaggtgaaaaacagtgaccctttagggataatctgagcattgcttttgtgtcggttattcctgtgttcagatcctggctctgccacttactaccttgtagcctctttaagcctcagtttgtgcatctggggtgtaattatagtcccatgtcatagagccagagccacagggaggatgaaatgagatggtacaggtgaaggacttagcagagtgccttgtttgtattccaagctcaaggtagctatgattatttcttgctcattgtttttaaattgcaaaagcaaagcatgctcattgtaaaacatgtagcaattccaaataaacaaaagaatgaaagtttccctcccacgaggaaaatccactgctgtttggtgagcaaaccctggaccttttctatgcatacaagaacatgcacatgaatcctcacagacacaatcacatacagacacagtcacacagaagctgctatttttgttggggagggaggagcagaaatgagattatgtcagacatattgctccagcatttccttttttgaactcaactggatgtcatgaagacagtcttctgctctaataaagtatatattacattgtttaatatttatacacacatgtaatcacataatttgcaaagattggtgcatagctgctgttggagaaacttgtgattgaggcagtgtggtacagtggacatagcattgacctcagagacagatgatatgaaattggtcaaaaagccagccagctcccctgagcctctgctttctcatctgtaaaatgcagattttggccccggataggctctgaaggctctttctgcactacctcttttttttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgcactacctctttaaaggatgctctgtgagtagaaaaatgcaaaagaagtctctgcctcaggaaatttgctctacctgtggagacatcctgggaaatagtgggcagtgggataaaggaaaaaggtgccccaaatcacgggaccttgaagttggggacgaacttctaggtcagaacccgcaggttcaggcaacagaaaatacaagaagggaaactacagagcagaaattatagactgctgtttgcacaacccacagatttgagcattaatccatattttttctctatgttcttttccccatgtcctgagactacctcaccaacccaggaacccatatttgacaaaaacttgtttgctgaaatcaaatggaatcctccttagttagctgcaggcatccagggagatgaacagggttatgtgagccccagcgccatatcctgtcctttcttggctttttcccaaaaggagggcacactgaattgctcaaccagattcctggatgctcactgggccgcattactagtgagcaggatcactctattacaagatcaccttcaaaagcaaatgaatggctcaactagtaggcactttgcccagaggctctttggccatatgcttctgtcttctagtatcttaaacacattctaggactctcatttcttcaatacactgtccttcctcaagtccaaatgatgatggcttgagaaagggagagacgtcctttggtctaaccccatccatttgtgctccagcccagttagctaaagagagatcttatttgctcaagtttagttaataagaacgggcgtttgttttcttttgtgagtatgtctacctccaaaccacctggggaacagcaattgtcaaggcagaatttgggcatttagaggtttactgattttaatacctatcattacttccaactttaatctttcttcctatccctaacttcttatcagtccttcagtgatatcatagggaaggagaaggctttcattgtcctggaaatcaagctacaatctggaaaattaacattcagtgctaatggagtaatctagctccctaacattctcgtttttcctcaagtccattatacaatttggattgcataatactggtggaattgaggaagggcagaattagcaggcaggaaaggaatttttcagcaacacacggggcagattagttgccatctcttattcctgcacttctttttcaaggatacctggtagaaatagtagcagacccaaagcaaaactatgaataccacttaggcagtggagctctccccacctccaccctcccagcttcctcccaggtcaagagtagactttaacatcttacctaggataaaggacagctctctttgaccctctcttgtcaggagcttcatttgttgttggcaaaattcaatttcctggatcaaagagcagcttagaaaggcttagatggtatcccaatgctcttagtaaaccatgcttcactgagttgcatttaaatgagtcatagacatatggattacattgcacttaaaatacacatggctcaagaaattaaaggatatcattctttaaccaagtatttggcagatctaaagtattcaaaatgtttttccaaactctactcgcagctgggctccccattccccatggctaaggttgtataacccggggagacaggtgctgaggaaacagttggatgaatgggtggggacaccagaatttgatgagagctgcctgtggtgtctgaaattttcttcacatgttctttggaagtatgaagaactggtttaaccctgctgtgttgacgctgaaggcagtgaatgcatgagtggatttaaattccaagtgctttgctaggcacgtcattccagagagacctggtagtcctgtttgagatgtagtttctaattgtagctttgtagactgagaatgatttcatttgcatttcccatgttgtcccaaatgcctggagttgcagaacaaatggattgccagccagtctgatgtgattttttataagccaaactctcaaccccaccccagcataagcagggtctccatttgcaatgtactgaatgtttatgtctcccttcaaattcttatgttgaagtcctagtccccaaggtgatggtattaggaggtggggccttttggatatgattcgtttatgagggctctgctctcatgaataggattagtgccctgatagaagagacccgagagaattagctcaccttttccaccaggtgaagacacagctagcagctaccatctatgaaccggagagagggccctcactagacacgaaatctgctgatcccttgatcttggacttctcagactctagaaccgtgagaagtaaatttgttgcttatttgctacccaggttatgctgttttgttatagcagccagaatggactaagatgccattatttctaaaatattggacacatgatatcactttcttagggtccattgcttaagctcagactcagtaataagcctggtgatctgaagggatgcagcttcatgatacgcttgtctaaggtatcagagagcatccaaaattgaaatagcctagatgtgttgattctgaaagccttgtgcacacaagccttaaacatcctaatccatagagtagaacagatttggactttggtcccagagaccctgattcaattccagatactgacacttccggttgggtggtctttggtaagtcacttgccttctaagttttacttcttcatctgtattcatagtaatactacttggccaggtgcagtggcgcatgcctgtaatcctagcactttgggaggctgagccgggtggatcacgcgagcccaggagttcgagaccagcctgggcaatgtggcaaaaccctgtctctaccaaaaccaaccaaccaaacaaacaaaaaacccccacaaaaattagccaggcatggtggcacatgcctgtagtcccagctactcaggaagctttagtgggaggatcttttgagcccaggaggtgaaggttgcaatgagctgagatcataccaccgcactctagcctggttgacagagccagatgctgtctcaaataatagtaataatactcactgctttgtgagcatttgctgagaatggatacttcggaaaaggcacttcacacaatgtcttattgaatcctcatggcaaccctttgaatgagatattgttgtctgcattttataatgaaactcaagcatgaggagtttaaataatttacccagtattgggcatagccaggagtcaaactctggcctgcctgcctcttactacattatagcacttgcatagaaaatagagacattgataccttcattgcagggtgtggaaggctgaaaaatgcaccctctcccctccaatgataaccacattcgaatccctggaacatgtggcagaatctttgcagatgtgattaagttaaagatcttgaggccgggcatggtggctcacgcctgtaatcccagcactttgggaggccaaggcaggtgaatcacctgaggtcaggagttcgagaccagcctgactaacatggtgaaacctggtctctactaaaaatacaaaaattagctgggcatggtggtgcgcccctgtagtcccagctactcgggaggttgaggcagaagaattgcttgaacccgggaggcagaggttgcagtgagccgagattgtgccactgcactccagcctgggcaatagagtgagaccccatctcaaaaaaaaaaaaaaaaaaaaaaaaaaagaaaaagaaaaaaaaacaggttataaaaaccttgctgataaaacaggttgcagtaaagaagagtcacttgagcctgggaggcagaggttgcagtgagctgaggtcacaccactgcactccagcctcagcgacagagcgagactccgtctcaaacaacagcaacaacaacaacaacaaaatcaaagatcttgagatgagaagattatcttggattacctggatgggccctaaatacaatggcaaatatatttataagagggaggcagaaggagatttgactatagacagaacaggagacagtgatgtgatcacagaggcagagattagagtggtgcagccatgagccaaggagaagctggaagaggcaaggaacagattctcccagagggcacgcagccctgctgaccccttgattttggcccaataataccgatttcattcttctgacctctcaagctgtgtgaaaacaactttctgttgtttgaagccaccaattttgtgacaatttattacacactagccccaggaaacacacacacagggtttgtgaggttaggagataatgtatgacaatgcacttagtacaacgtctggcacatagcaagcaggttttcaatacatgctaatttgtactaatgcaacgtccagaacaaatgttttcaggtgttttggggatgcaagctgtgacatgtggcccttgcagctttcttcaagcatgaaaatgacaagagaaaaaaacatattgagcaataatctgtgtggttattgcttatctacattacccaagttccgggtcatgttctctgatgctctgtctgcccttagggaacttctggctgaggataactaggaatgattgtcacatattaacaaatggtgatagctaaaaagtaggagatgcctgtataacaggcatcgtactgtggtatttatatgggtcatctacttcacttgtcacaaccaaccaatgaagagtagattcctatattagccctatttggcagatggggaccctgaggtgtggagcagtgtgacttgctaaaagtcatgtgggtgggaagagcagggccaggatgtgaaactagatctgtttgactcccaagtccaggcttttaactggggcagtatattgcctctcagatgcatagtcctggctcattatgctttgggctcttttttggttagcactggcatttcttcttcattgttctactctcccccttccctttcctcctacctttcccaggccctggttagaatttgcatgtcagtgtaatgtgatagtgtaatccaggcaggtgtgcatcccaagcttggctccttgcactacctggaggtgtaagctttggcaagtcgctcaacctttgagagtctcagttttctcatctacgtgatggggataataacctcataggatgtgtgtggaattcaataacgtaatgctcttaaaggatttacagggtgcctggtgcactatgagagcacaataaatagacactgttatttgtgttttgcagggtcagaaaagcatttaagaatgaagtcagagggaattcccctgagttggtttccaaatgtaattaagaagagttgaccttaaaacccattgcccctgggaggaaattacttctgctctccagcgatgcccagtttgacctaattgtatctcgaaaacactgctttgcagtgttctccagtgggccaaactgtacctcttttctgtgcctgcagaatcagatgaggccctgaactgtccaatatgaggttgggatttgttcactggttccggctctccttccagggatccgcagccagggctgcctgtgcagccaggaaggatgtccacggttttcttttgtctcaagcttatttctcctggctgctcttcagcaggagcacggggtaaaatgaatgggaggaagctgtcaactgccctgttggccttagatggacccttatccgaactaagggaagctgtggacttggaagaagtcaggatgcttgggtttggggacccctttatcatcaggctgcttaccttcagataacaacaatagctggcattgagggagtgagcatttaccatgaacttaatattttatgtagattttaaaaatccctatgtatatttatatacaaatgaggtcatagtgtattcttggttttgtaacctattttttttcacttggaaatatagcatgggcatttaaaaacatttaaaagattttacatggaactttttggaatgtttgacatttttcataataaaacttcagagaaaaattaaacaagttatagagtttttaaatgcatggtatcgtactttatatactattttataattggcttttttattttttgtcttcagtgtctttccacatgagcacatttatagacctgtttcattctttttaatggtgacataggattccactgaatggatgaatcaaaatttattaatttccttattaactgacagttaggtttctgatttcttgttattacaaataatcctagcaataggattgtacataatctttaagcacatttgcaagtatttctgtagcactgatacctagatgtagagttacaggatcctatggagtacacaattaaaacgcttttaaattttgacaagttgtacctctcactccacaaatacctccccaaaggctgaatgtaccattttgcatttatacaacaacagatacctccccaaaggttgaatgtaccatttcacattatgagcatattataaatatgtctccatgtacctttatcatatttaaaaaaattaattagaagttctatttttacttactttttagcccatgaaacaaatctcagtaattttatcttttccttttttaatttttaatttttgtgagtacatacatagtaagtgtatatatttacggggtacaagagatattttgatacaaacatgcaatgtgaaataagcacatcatgaagaaaagggtatccattccatcaggcatttatccgttgcattgcaaacagtccaattatactctttattttaaaatgtatagttaaattattatagactgtagtcaccttgttgtgctatcaaataataggtcttattcattttttctattcttttttgtacccattaactatctgcatctccccactacacccttcccagcctctggtaaccatccttctactctttctgcccaggagttcaattattttgatttttagatcctacaaataagtgagaacatgggatgttgatctttctgtctgtacctggtttatttcacttaacataatgatctccagttccatccatgttgttgcaaatgactggagctcattcttttttatggcagaatagtactccattgtgtatatgtaccacattttctttatccattcatcccagatagagacttaggttgcttccaaatcttggctattgtaaactctgctgcaacaaacacaggagcacaggtatgtcttcagtatactgatttccttttttttttttttttttttttttgagtagagtcccgctctgtcacccaggctggaatgcaatggcacaatctcggctcactgcaacctccacctcccaggttcaagcaattctcctgtctcagcctcccgagtagctgggactacaggcacacaccaccatgcccggctaactttttgtatttttagtagagacggggtttcaccttgttgccctggctggtctcaaactcctgttgcccaggctgggcttgaactcctaagctcaggcaatccacccacctcagcctcccaaagtgctaggattacaggcatgagccaccgtgcctggcccactgatttcctttcttttgggtctatactcagcagtgggattgctggatcatatggtagcatgacatagtggttgtactaatttatgttcccaccagcaacgtacacaagggttcccttttccccacatcctcaccagcatttattattgcctatctttcaactgggtgagatgatatctcattgcggttttttttgttttgctttgttttgttttttgagacagagtcttgatctgtcccccaggctggagtgcagtggtgcgatcttggctcactgcaacctccgccttctgggttcaagcgattcttgagcctcagtctcttgagtatctgggactacaggtgcacgccaccacacctggttaatttttttgcattttgtatttttagtagagatgaagttttgccatgttgaccaggctagtctcaaactcctggtctcaagtgatccatcccaaagtgctgggattacaggcatgagtcaaggcacccagcttgttgtggtattgatttgcatttctctgaagatcagtgatgttgagcaccttttcatatgcttgtttgccatttttatgccttcttttgagaaatgtctattcaaagcttttgcccaacttttgattggattattagtttttttttttcttatagagttgtttgagctccttatatagtcttgttattaagcccttgtcagatgggtagtttacaaatattttctcccattgtttgggttgtctcttcactttgttgattgtatcctttgctgttcagaagctttttaacttgttgtgatcccatttgtccattttttctttggttgcctgtgcttgtggggtattgctcaagaaattttgcccagaccaatgtcctggagattttccccaatgttttcttgttgcagttaaatggtttgaggtcttagtttttttggtctttttttttttttttttttggggttggggggacagaatcatgctctgttgcttaggctggagtgcaatggcgcaatctcagctcattgcagccactgccttcttggttcaattgattctcctgtttcagcctcccgagtagctgagattacaggcgtgcaccaccacgccagctaattattttctttttagtagagacaggatttcaccatgttggccaggctggtctgcaactcctgacctcaggtgattcgcctgcctcggcttcccaaagtgctgggattacaggcatgaaccactgtgcctggcctgaggtcttagatttaagtctttaatccgttttgatttgatttttgtatacaatgagagataggggcctagttttattcttctgcatatggttttcccaccatttattgaagagactatcatatcattttcgtggctgtgtgatattatagtctatgtgtatgcatgattaactcttacagcttcttatagtgaaaaattatcaaacgtgcagagtagagagaatgatggtatgaatcactgtatacccaactgagtcaaagcgaatttacatgtaacgtggatatataaaggcaagttgcccttggctcctctgcaagtttatatctcactgcccttgttgagagatcctgttttcccaaacacaccattgagttgattattgagcttgggcagactctttaaacccaagctctcttgtctttttttttttttttccaaacagctttactgagatacaactcacataccatatagttcactcatttaaagtatacaatttcatctgttttagtatatttacaaagtcatgcagccatcgccataatctgattttagaacattttcaccactccaaaaggaaaaaacatcagcagtgttatgagttgaatggtgtccccccaaactcatatgttgaagtccttatccccagtacctcaaagtgaccttatttggaaattgagttgtggatgtatttagttaagatgagatcatactggagtatggcaggtctctaatccagcatgagtggtgtccttttagaagggggaggtttggaaacagacacacactctgggagaatgccatgtgaagattagagttatgccaccacaggcgaaggaactcagaagccaggagagagcctgggataagccctttccttgcacctgcagagagaggatgatagcttgatcttggacttttagcctcaagaactgtgtgacataaacttccgatttttaagccacttggtttgtgatactttgttacggtagtcctagaaaaggagcacagtcattcttcattctcccccaccccacgtcagtcctatgaagctggcaatctgatgtctccagatttacttattctggatgtttcatgtaaatgggattatacaatatgtggtctttttgactggctactttcacttcgggtaaagtttttgaggtttattcgtgttgtagtatgtatcagtattcttattgctatatggtattacattatatagatataccacattttgttaacccattcattagttgatagatctgccttttaagctcgagctaatttttctccattctacaagtttgatttcaggggatactgattgagcacctctatgtagaatcctgtgctaggtgctgtagagactaggcatgaaaacaggatattcttaccttctggcagtttagactctgtgggagagaaaacagcatgcaaacagcataatccaaaacagattacaaatttacatggtagaattgaaagtaaagaactgcgaaggcaagaggaacgggaatttgtgactggggaagaggggagccttccctaatgagggttacttgaaatattgtcttgcagaatgatgggaggcttttgatgagggagggagatgagatgaatggagaatgagaaaggaattcagactgagaaaacaatgtgtaaatgtttggtctggatcaaagggaacctaaaactgtagtgctactaatcttttaggaatttagtatccctaactagccaaatatttgaattcagaagagtgatatgttgaggttggggaacgggttgctttttcttccactggtgggctaccagaggatttgagtggcatagagctcaatattttaattctcccatttttgactttgagttgcattctcttgcctcaggcagacccatgtggtcagggaagtaggtgagctacttctaggaaacatacttgaagtgcacttaaaagctaggctgtatttctacaccttggaagagaagtagctttcctcccacccctccccactgaagaacaatttgggctgagccaagaggatggaggtgtacttggtggatggagcccatggattggaaggggctgagcacaaggcattgatggcttcttcacaacttctgtagatggggaagcctcctgagatgcaaggctggtgggcgggatgcagacggatttatggatatacatttggatttgggagaggctctttcggccttctcttttctcccagctccgaggatgtgattaaactcttcatctaggctctctggaaattggagggtgtttcctactctttaccctttgtggttgggcaatggagcatgactatcctggagaaaaatgagaggaggctgacaatgtggcccctggacagattctgtcctgaaaatgaaactacatttacatttcacccaggagatgtttttgattttgagcaattaagatttgctttttctttatttagaactcagtgacatacacagacctttggctgaccccttgaataaactaagtgaatagtcttctgggtactatggggcaagttgctaggtcttgcacaaactcaactggggcaggtattgagtcagagaatccctggcttttctggcaagtctcttcccagtgtactgggcttgagttctggactactcattgagaattcctaatttatgttattcctttcttctcttccttcattaaacaaatattgtgagtgccaactatgtggcaggcactgggataggtcctggttattcccgggagaatcaatggtgatcagaatagtctctgccatcatggggcttagaacgtagtagaggggacagataattaaacagttacagaacaatgtgggacctgctaggagggaggaagtagagggtactgtaggaacatggggaaggggaacttcctctggattgggggcacgggaagtctgataggaggaagtaaagaaaagggggagtgtgatggtggtggagagtgtggcagagttggctcatacaatagggagtatgtgccaggcagcacagatcacaggatcaaaggcccaaaggcaagaatgacattgaaaatgaaaagttctctatagttagaacagagagcaggaggaaggaaatgatgagagaagaaattggtgaggcaggcagaggtgagtccttaaagggccttgtaggcaccttaaagagtttgggcttttatctctagggcaatgggaagcggatgaagaatattttaaaagtcacatagtgacagcatccaaaacgcatttgagaaggactaatttagggaagaggtagctgatataaagagaagaggatagattccagagatatttatagggtggaatcatggaaactgggaaatgggttgcatgtgggctgagggagagggtggtttcaagggacagtccaaagtttctagcttgaataagtagcaggatagttgtcttaattcattttgcattggcaaaacagaatcctagagactgggtcacttataaagaaaagaaatctgtttctcacagttctgctggctggcaagtccaacatcaaggtatcagcgtctcatgagggccttcttgctatgctaccccatggtgaaagggagaagggcaagatagcacatgaaaaaaagagcaagagagcaaacttgcagcctcaagcccttttataacagcattaatccactcattatggtggagccctcatggcctaatcactcctcatgaggcctaccttccaacactgttgcattggggattaagtttccaacacaggcttttgcggggatacattcaaaccacagcaatggtggtgtctgtccctggagttttccttagcttgtggtgggaccttggacaagccacctctttccttggatctttaggtttctcattagataggtaattagactcaatggactaattagactaggtaataattcctagtcaccaccttggcaggatcatcatggggatgcaataataaaacctgtgtgaaaagcagtgtcctgtactctttccataacgctgacaggcccagcagaagcaaaatctgtgcctcccctggttttctctgttttctcctccttatctaaaattctaagcacttggtctcttaggaactggtgagacctctgcccattccagcagctgaggcttcattggggacctctctagggattctgaaaccggcttttgttgaaaacaatgatatcattgagtaggtggagctgggccggactttcctcagccggttgaaggagaaatggggtctttatgacttctgtacttgtggctcttttccagcctcttccatggctcccatgtgtctcacttcccccctttcctccttgcagaaaactggcagtctccacgttttctcctcttgcatcagtctccccggggagagggccagaagggccaaggagctataatggctgcattatatcaagcatggtttctttttccaaggccccccttctggagaagggaagggcaagtcatggaaagggactcctttggagggagactggagtgctggggaaaagagtgatctaagtgttggaaggaatgtcaggctctttgtattctagaagctctttatctcttgactcactgatgctagatttggggcttgggtaagaatgcaaaggtcaaactggcctctcagggatatggtgataggaatatgggtttggagaaggagggcagccatgttgagtgagtatccttaattcctgatccctagactggccttgctctctgctctcaacacgcacacatgcatgcacacacgtgtgcgtgcacatatacatcccttctccataactgtgtagacagctttttaggagaaactagaaattggttaccacactggtttgcagctgttccaggaaggaagatgagctgtgaaacagtgccttctggggaccagacagtgacacctgccctctgcatggtgtcagcatttgccaagcacttgggagctgcaggtgccaagccaggagaggggcaggaaacctaggcctgcctcactggctgctgaagccccatcccctagcatagtgcctgcacatcacggacctccatacatgtttgtggagggtgcaagtggacttgcaggtgcagggcctgcaaggcctgatgctcagaaaggtgctgcgtcttgatcaaggacccccagcaaatagtgacgaaatcaagctgtgagaaactctggcctcctgatgccaggtggcctgcagtttgtaccacattacactgcttaatatgcagttattcatgagattgcatgaagagcctttctctctgcctactgggtgtgtctggatggcccaactcttggcttgtctaccactgacatttagcttactctagtttattgaaatgatgggtttagaaacaaaaactgtgtgatgctgggcaagttgcttttgctttttttcagattcttcatctgtaaaagtggaggtcagggttgggcagagagggtggtatataaataatgtttcattgcggtagactctgtaacttacacactaaccctcgcttctcctaaacaatctttttggaaaggatatggggcaacgcatagaatgagggaaaagttgaaaaactaaggtttggaaaggttgagatcctagaatgaatagacggtcccttcatgtactatcatcttgaaattctgagatgagatctgactgtccaggcatatcatgaagcattcatttggccaggcaagggcagggatcttgaccaactccaggtgccctagtcagcaatgcaacgagaggggagtatttctttaaatgcaagttgggccactgtttatctcaagaaggtggcatggatgctgggcaggctctgacaataggtatccactatgatctatgagggctttccaagttctgacatccttgacttatgctttgggtgcggtctgtgtcttagtatgctaagaaacattgggcaagtttatgaaagttactgggatatttaatcagagcttaaaaagggctaagcacctacatttagcaggctggtttgtggtcctcacctacctgttttatgtttgtttgttagtttcagggagtggtccgcttattcccttttttctaagcatattctcacagctccagtgatctcagagggtccttctcttcatttcccctgtgtcttatccacaccgtttttctttatgatatggcagtttcctcataccctcttacattcgtctttcccttcaggttttctgtggtatcggctaatctgatcaacactgtggttatttaccaaaaactggttgctagagaagttgttcctactcaccattttcgcttttagatttttctcagaaattctaaaggtagcacctcatttccccgaactgttcttatctaattccaacaaatacacataatgggctattcgggacactggaaaacaaatttgtgaactcttcttgggtgagccattttgagggccccgcaggtccctgccagttaagttgtctgatctcaagaagtcagctctatttgtgcagagaggttacccatcttcacagaggcagccacgagggaggcctgaagaggattaagtaaagaccctgctggccaaaggagtcagtggtgctcatccaaacatcctttggtatataatgtaaaagcaaaacacaggaccagaaactggtcggaagggtgccaggtcttgtgcggactgggagaagatgtcgtgggaagtggttggtgaaagggagtgttgacttaacgcattgtttggaaacttccttaataggaagttaaagaaaacatactgagtagcattggccttttgccaggcttctggatggcgccatttttgccttcggagtgttgcttccaaagctggtcctctggcaacgatggtgcttattcaagggagtccctgggataggaggaggtcccaattttttactctaggagcaacctccaaagttcccccttccttcgcctttctgttccctcataaaggaatgtgtctgcttgcagccccctggactcatcagtcccttatttggctttagggccatgcctttggcacgttggtttgtttccattcctttggagtcagaggtggaatgagtactgatgtagaaatcttggttctgaagcagctctggctgtctcttccctgcttttctttcagcatcttagaaaacaaaacaatactcactgaatttattttgtcccaaatctagactagtgcaggccatgacattagaatagcactctgcttttcagagacactttccagtacctgtctgtcctgggcattgccatttctgcttgatagaaagggaaactgaggctgagtagtttgtgacttgcaccgtatcacctagccagttaaaaaatattgtcaaaatttacaaacccagaaggagagagactagtattataaacctcagatgcccattacctagatttaacaatgatcaagattttgccacgtgtatatatagctagtgctggagaaaatgatagcaatatttgtaaagcacaaatactttctactttacaaataattctttcacatttgttcatatgatcttcctatatgccaggcactattctaacatcttacaggggcactgtgaagtagattttgtcattctcctcattttatgatgagaaaccataggcacggagaagttactgaccagtctgaattcacacgacttataagagctaggatttgaatgtattttctcatttgatcctcagcatcgctgtgatactgatggtgattattagtctgttcattttgcagtctagaaaatggagggggtttatgtggctcacgtgaaaacaatttttatacaaatacatagtgagcacttctcgaagttttatttatctaattaatgggctaaccagcaagatgataaaactggtttaaaattggataagggaaactaagacgtatttgtgtggcggtgtgtgtgtatttaatagtgaaaaaaggaatgctgagataagattgctaaattagacacaaaactagttaatatcctaggggctgtaaaatcataacctttggggttatcttttctactagatggaaatatttgcatttctgttgtatcttattaagtttttacaagttaacatctgattttacagagtggaacaagggctgtcctaattaattgtaaatagtacatctttcaaagccacactcttcccataaagtccagagaaccgtagacaggcctctgagagtctaaggcttggctgtgctcccttagtgttttttaatttaatgttttgagacagaatctggctctgtcactcaggctggagtgcagtggtgcaatgtcagcttactgcagcttccgcctcccgagttcaagcgattctcctgcctcagcctcctgagtagctgggattacaggtgcgcgccaccacacctggctatttttttttgtagagacgggctttcgccctgttgtccaggctggtctggaactcctggcctcgtgtgatccacctgcctcggcctcccaaagtcctgggattagaggcgtgagccattgcacccagccctggctgtacgcttgtgtgacattgagaggaaccatagtcatcttttgcttcatttccaggctttggaagggcagttgcctagtgcagctgctgcttaaaccaaagcattccgactttccctctatgctgggttagcaccatctttagacttttggaaggtgattaggaggctagaaataaaaaaaagaattaaaaatgttaaaattgctcaaatggagtagaataattcccagaacccgaaaacataaatcacctgaaaaaaaaaaaactattaaaaatacagatttcttaatccttccctagaaaagggaggggattgtgtatttttgaacagtctttccaggtgttgtgcagttgttgggctaagtcgcatggtgagaacattattactaacataggcaggatgaagaccctccaggtgaaataagagagaccagaaaagtggacctcccaaggcatcatcagggtataaatgcctggagactcttggaagaattagatagagaaaggcccagagaaaggaggtgtcagcaaaacttgctactgagatgagcagagtgatgctcgcctatgctgagctcgtctgcagagggtgtttttcaaggtaaatgggaaattgttatcactttatcttcactggtttgcttatctgaagcaggaggaagaaggtttgagctcccagaagatgttttgcaaattcattttagtgtcactgctccttcctctctagagggtggtttagcctagagaggcatttgaaatttgtctgacgataaatagaacttaaaggaattgtcctgagtttgaagcttctgagccttaggaaagacgggtctgagctgttttcaggctgcagtgtactttcagggcctggctgcttgtacaggttccagttcttcttccctagagagtgacctaatgttttatgtccggtatttgggggtagcttattttcctaggtgggagtctgaagatgcaggttttgctcagggactttggaatctaaatgacccagattttgctcaactctagtgctggctattattatgatggtgccgagacatggcagagtgtcctactgatttctgcctgtccgtgggctcctgagcacagagcagacagagcagggggcagcagggtagaacagaaattgcttttcttttaaagctagaaaaaaggagtgggcggaatgggaaatcttgcacagtcctttctcttcctggatgcacatcactcacaagtcgtttcctgaaaatcctaatgcaatccaatggtgagagacggcttcctgccggtctgctgagccagcccctcgtcagggaggagatgagaacaagatgtggtcagagaatggggcagctgggctgggccgggctgctcagtgaccatgtgccctcctctctgtgggacagcagcgtcctttggttctgagagcagcacctggacacatgggcgtatgtggacctagcttgggggagctgcagagttgttcaaacagatggctggccctaaccctagagtttctgtctgattcatgagtctgggtggagcctggcaatttgcatttttaactagtttctagatgatgctgatattgctgcttcagaaagggtgattaggtggaaaatgaaagcggattgttttatgtagattcagaggccagaatgaaggcctgtgggtgccagtgacagaggtgtagtttttaatccggagtaaaacattaaactactgtatgtggtcagaaatggagtgggtagtctcaggagtagcctctccctggaggtgtccagtggtgaatagccatttggcagattcctacacgagataaaaggttcattcattcgtttgcgagtttattcactcattcacagaatgcacatgtactgcctgcttgctaggtgctgggggccggggagaagacttcaaagacacaaggtccctgtttttggggagctcacagtgtaattggggtttgactacatgatttctagggttcctttcagtgctgagggtcagagaggcctgtgatgatggggtaatgtcactgggtgaatgatttctccccccttgctaagtctcagaagaggctgagaatatttttaccaggagtgcattttctgtgggaaaattcacacttccccactggcacctggaatgaactattaaactctgaactcctgaccagctgtacatggcgcagtctgtgaaagcaaacccaggaaatgggctgcaggaatgagcacattgcgttttaccacctctcttaagtgatgtactggagagttcatggctggggaaagttagagagagaaactttctgggttcttctgtcataatccctgttgaaagcaataatgattatcactaacttttacccagctccactttgtgccaggcatggcattaagtctgctacatttattatgttgtttgatcctcatcacagccctatcaaatgagtatatcatcctcttttttgtgtaagaggaaacaaaggttcagagacatacatgtacttgttcacggccgtagaggcagtgaatgtcagagctggaatcaaaacttcagttttccagtctccagaccatgctctaagctgctagtacactgaactactcatccatccattcattcggtaactagttaagtggttttctcattgaacaaatgttaagcactgacataaaccagtgagcaaaactgcttggcctctgccctcatgaggcttacagcttttctccctcaggcaaatgggtgactcctccctcaaatcttggactagttagatgctaaggagaaagagaaaggactgggagacagattctggcaggttagccactgacccaaagtttccatgtgaatgagaatttctcttcacaaagctggggtttgtgctttgctttatttttacattttcctgttgggcttcttttcttcttgtccaaggcgagaagttgaaggccttgacatagtacaggagacaattcttgtggcatttgccttctgaccacacactggggatggagggaaatctgagcgatcccagaacttagagctggaagtgactctagaggaattctagagaccctctgcgatgaccctctcttgctgggaaatgtcacctctttcaaaacctgggttatccctgcagattcctttggctttctgtgctggcctcagcctacattttcttctttttaagagcagttttaaattaaaatttcagttttcaaaacacctctctgacagttaatttaaaagtcaaccaacttcagaaatatgcaacttatattgtaaacatcttctgcaacccctgagataatcaccatcaacaaagggcatttgtttctctctctctttttttttttttttttgagacagagtctcgctcttgtcacctaggctggagtgcaatgacgtgatctcggctcgctgcaacctccaccccccaggttcaagcagttctcctgcctcagcctcccagctaggcacctgctaccacacctggctaatttttgtaattttagtagagatggggtttcaccatgttaaccaggctggtcttgaactcctgacctcaggtgatctgcccacctcagtctcccaaagtgctgggattacaggtgtgagccaccacacctggctgaccttgactttctgtagatcaattctgcctttaatgtggctgaactattaatagttgaaacatccatttgactcttatatttttcttttaatttttagagaaaattctaagaacatttcttgaagttgcctggcctttggtgaggggattcttaacctgtacttcaaggggtctgtggtgagagaaaccaatgtccaagtttagaaaagaaaaaaaggaatttattggaagagtaacatagaattaccaggtctcaggaaatcggaaccactaagtgtccgaaagggcaggcaacggaagcttagggaacccttgtagcaggaacagaagaacagatgcattgcttccatctgttcagacctggcagtatctctccactggcttcgcttgaaatacaggtcaccccttggccagggccaagtaggacaccttgattgacaatctcaccaaaatatgcatcagggaagagttattcccttaaagaaaaattggtctgctgatactaaaaattggtagatccagtgctggaaaaatcaaccacggtacacaacagggttcataggccccgggaaattttgcatgtgtttgcatgtctgttttcccaggacccagacaaatattaagatcattgctttagttctgtcaattccatctagttggagtgatgttcccatagtgatgataaattatatttaatttacattaaatataaaattaataacaaacttatggttttcctttttgttccttagccccttgtggctgcctagtttcttttgtatggagatgcttgggatagtcctgcctggttcagttaaaatcactcgttgttgctaggagggtggagttcatccacttatgatataaatgtctctttttattttttgcaggcaactttttgctccttcctacacagaaacccattatacttcaagtggtaaccctcaaaccaccacacggaaattggaggtgagttcaggtcaacaaatgtctatccagcagctgtcctctcccagccctactcctaggacctcaggagatgcctgatggagttggtctctcctctgaagggagtgtttcccccaagcgaagaccaagggagcaaacgagaagcaaaacatgtatttgatgttcataggtgctcctcctcctttgctgactacaatggctaaagaaacatagactattttagggtaattgcatctaattacaattgatgcaaattactgtgaaatatacatgttctttgctttatgttaattacccacatgttaacaaaagttttagtaaaaggagtgacttactcataatcctgtcgtctcatccaattagatgtttgattagtcctttttaaatggatgtataacatttacagagttgtaatcactgtgcatatacattttgtagtctgctattttaatgtgatttttaagttatgaatattttattttgcttctatattcatattggacattttttccctcaaagttgtttttgagtagggatgtttacgcaatgtcaaagatctttcatttagaaaatggtctttcagatggttacatgtcagtttgctttgccacactccactggtagacatttaaagtagtgaatgatacacatttcatggtggctagctcttcttacagggatgcctattggaatttgtaggctcagaacgttgattctcaaccaggagaaccaatggcgttgccccgaccccgagggacacctggcaatgtttgcaggcaatttttattgccgtgactggcagggaggatctactggcatctacattctataatgcataggacagacccaccactcccccacaacagaattatccagctccaaatatccatagtgcccaagttgagaaaccctggattcgaatgaccattctcaaagtctgggctggtgagatgggggtgaagaagggaagacgcacactggcaggagcagcagtggcctttgcctttggggcaggacataatggactactgaggcacacagactgggagttgtggtgtggagaacagcaggagaggtccctctgcatcaggactccttcagcagcttctcatggaacctgagtgttctaccaggcccattctttaaaatatccctgctggagtgcaagtgtccagcaagataacactggccactatcagtcattaacagctcagattagttcgccagattacccctggatggggaaagggacacaggacaggtaattttgtgtgtgtgtgtgtgtgtgacagagtttcactctgtaacctaggctggagtgcagtggtgcgatcttggctcactgcaacctccgcctcttgggttcaggcaattctcctgtctcagcctccccagtaggtgggattacaggcatgcatcaccacacttggctaatttttgtatttttagtagagacagggtttcaccatgttggccaagctattctcgaactcctgacctcaggtgatctgcccaccttggcctcccaaagtgctgggattataggcatgatccactgcgcccggctaattttgtatttttagtagagatggggtttcaccatgttggccaagctggtctcgaacttctgacctaaggtgatccacccacctcagcctcccaaagcgctgagattacaggccactgtgcccggccacagtttttgatagatccaagagacgtggcgcatagtaactgggtagctcaggggctgtgttttgtggctgaatgtgaagaccagtgctgccttcttaaccaagactttcttggatggggaaggagttggtagtgtggccggtgcctgcagcaaagttggactgtgtcttctcatccccagggaggctgtccagttgtgacttcatattcttcaatgccccttggtcaaaacttttcctctcttcttgagacctctgttctctgcctccaggggcaggggtgggatgggggaacaggcatgcctagaaagctgttagccatgacagcctccttcaaacactctcctctgagtttggatcctgccacttctgtacccacagctcaagaatgggtctcagtccacgaatttgccatgagctcacgcttcctgctatgaaagcccccttggggtggccccatcaggctgagaagctgaggaatgcaatgacttcatgactgatccttgacttgttctttgtgctctctgcttgtgcattaggcagagatgttgtaagggcctttcagaaagagaggattggaaaagaactccccctctcccagaatcccctccttccagaaggtcttgttgactgaagcacatcctagctgaaccttgggatggacaactcattgtttgcttacatcccctgctactagactcttgcaaagctcccacccaggcccatggggttctcagtcagacttcccatttgggagctgagagctcaatgaaaaatgggaatggaataaactactcagctgcccttgacccgaatgttggagactgcactctactaccaaacttggcctggggtagctggagttctgggaaccttatcaagactcatcagtcaggcctttaggcgacagcctgcatctaggtcaggcggttgggggaatgggtctgtgaatgtgttccaacagaaaggatgacagggtttgcaatctgcagccagggttgttatcttggctttaactagttatatgaccttaaacaacccccttgaccacactagtgttgagttttctcatttgcaaattgcatatgctgatatctgactcgcagggctgtggaagggtaagatgaatcactaatttttatgggaattcataagcaactcttccaaccccacattttacagatgaggaaactgagaggagaaggggaaaagtaacttgcccaagttcagttaaccagtaagtggcaaggcttaggctagaacttgtctcctttgttgctagagaaggtggggataaaagagctctgacaagccaagttcctcctttgctactgctgggagaggcagaggatggagcttggggccaggctgctggggttccagtatccactttgctgtgtcaccttgtgaatgacttaaaacctctctttcaatttccccctttaaaacatggcaataataatatctgcctcataagattgtggtcagaatcacaaggaaaaatctgctaagttgttcagcaagcagtaagagctgggtagatgttagctcttttattttagacatagggcctcgctctgtcccccaggctggagtgcagtgacatgatcatagctcactgcagcctcaaactcctagcttcaagtgatcctcttgccttggcctcccaaagcattggtattataggcatgagccgccatgcctggttagatgttagctcttattgttttgtttgtttgtttgtttgttttgagacacagtctcactctgttgcccacactggagtgcagtagcgtaatcttgactcaatgcaacctctgcctcccggattcaagcagttctcatgcctcagccttccgagtatctgggattacaagtgcccgccatcacgcctggctaatttttgtatttttagtagaaatggagtttcaccatgttggctaaggtggtctcaaactcctggcctcaagtgatttgcctgcctcggcctcccaaagtgctggggttacaggtgtgagccaccccacccgacctcttactgttaataatagtaagttgtaggtgtcatcatcacaagagatagtgtatgtgaaagctctgtaaattataaagcatgctacagaagccaggtgctctattttcgagagaactagggctgtgaacactcttagcatccattcaaagataggaagaggtgcagggattcttcacagccatccctgggtttcagttctttcttttttctttttttggagacagagtctcgctcggtcaccaggctggagtgcagtggtgccatctcggctcactgcaacctccgcctcctgggttcaagcaattctcctccctcagtctccgagtagctgggacgacaggagtgcaccaccatgcccagctaattttttgtatatttagtaaagacagggtttcaccgtgttgttggccaggatggtctagatctcttgacctcatgattcgcccaccttgacctcccaaagtgctgggattacgggcatgagccaccgcgcctggcctcagttctttctgttaaccagcgttttgaaactgtagctgatacacgtttctgaactccttgattctctgtcattccaacttctctgagccccatttactccacacaggcccggcccctcttctccccatgagtaatcctgtgctacggggtttgtggctcccctgttgagttctaaggaccaggttcaggacttgagtgcttcatgaggggcctccaaatcccagatcccacgggtaggttgagaagccacatgacaggctggcatttgaaagcagttggaatcctggccaggaggagggttttgcctgccacgccttctttcataatcacagcacactggctttcctttgtgctcctctcaagggtggcatctgacttgtttaaagtccagaagagtttgatgcaaagacaggggttggctctgtccctcctcctgactatgagcttgaatgggcagaggagccacatcgctggccgatggatcatatgcagatgaaagggcacctgtggtctggagaacgaggccgtgttgagtgtcagcttggcctgtatcctttgatctggctgcatggctggctggatatgctggagcattggcacagctagggctttggattcagcctcttggtgggcttccaggcgccttgaggccatattctttgataaaggagaatttcatgattatttggttgccgatgtttatcgcctgccactctcggccaagtactctactagctcctttatgtacgatattctcaccaccactctggggtacagaggctaaagacactgaaggtcagagagagttgtggaactgcgtatgcttggatttaaatatgcctggctatgccaaaatgtttgaatttaattatttgtctatactcaggattagagctgggagggaggtggagccagagaatacagacacacggggtagctgattattgggtcacatccctgtctggtggggacaaagaagcaactgcaagcagcatggtcctagagatgggggaaaagagaaagcttccatgtctgcaactgtgtggtttgcatccatcccttttgagatctttccagaacttggctctaccctgtgggttttatcttctctctgttctgaccagtgcatctctcttgacttatttgggaggaagcctctaggaatgtgtctcttgttgttacccctgattcgttggacaccgtcctgatttcacccccttctgtctggtttagcactttagcatgcccaacagtgcgtatttgcttcctaaattctatggttacctgacttataaaatgctcggccagcacttgaaatggttatttcaagccccttcttttggtttgtaattatatctgtttggatttctcattaatgactgcctctcacaagaccataagccccacgaaggctgaagctgtgactccgtttgctggctatggtgtctccaggggctggcccctggcctggcacagagcggtggtcacagctgtttgtagtgatggagaaattctgacagccatgagacacagtggctggagagcagcagcagacctcacgggcacaggtaccaaatcaagtacaatccagatgtggagggatttgtgtgaaagagcatcttgagctgtggaagagtagggagtgtttgtttcctagggctactgtaacaaagcaccataaacttaaaggtttaaaacagtagaattttactttctcacagtcctggagtctagaagtccaaactcaagatgttgtcggggccatactccctccaagcctctggagagaatccttccaggctcttctagcttctggtggcttctggccatccttggtgttccttggcttgcaacttcatcactccagtctctgcccccatcttcaaatggccttcttctctttctgtgtgtgtgtctgtgtgtccttccctcttgttagaaggacacaaatcattggatttaggaccttctctaattcagcatgacaccatcttttttttttttttccttttccttgagacagaatctcactctgtcgcccaggctggagtgcaatggtgcgatcttggctcaccgcagcctccatctcctggactcaagcaattctcctgcctcggcctcccgagtagctgggattataggtgtgcaccaccacatccggctgatttttgtatttttagtagagacagggtttcaccatgttggccagggcggtctggaactcctgacctcaagtgatccatctgcctcagcctcccaaagtgctgggattacaggtgtgagccaccacgcctggcccagcatgacatcaccttaatttaactacatctgcaagaccctatttccaaataaatcacattctgaggtggacatgaattttagggggattctattcaactcattgcagggggttgcaaagataacattggtggggaggcaagttctttccatggcatgcttttggccacagaaaacactgattcctgaaagagccctgaactaggaaaattctggattttccaatcagcagggagaccttgggcaaatctctttgctcctttgagcctcagcttttcatctgcttcatggagataatgacatcttccctgccccgtctcctaggattattatgggaatcagatgaaatggtggcttggaaagctctttgcaggttgtaaggtgctataaggttgggtaggtatataataagccatgagtcatccatgaccatcctgagatattaacattgccatgcttatcagtgttctttagcctgaccacctcctttctccttgctaggatcactgcttttaccacggcacggtgagggagacagaactgtccagcgtcacgctcagcacttgccgaggaattaggtaagagaccctgaggctgcaggtggcaccgggcactctccccaggaatggaagtttcaagatagacaaggctgaggcaaggaccttgggaaggagtccattgagaatgtgtgcaagccagcccagagaggggctgagcctgggaggatgggcaagggaaagcctaggtaatccagaaatccattgggatttaactttcctgatgaacttgatgttttaaaatataggttttgttattatttaggtatggtaaggccaaaaaatcaggagatgactgccattgaaaagatggtcatactcacagaaaagggaggggcccggctgtgccatggggggcggcacggggaggcactggggttggtcagcgggcagagggagtctggagaaatgtcagcagacgcccttcttgtggtttctgcgggaaggaatgggcgaggcagagaaagcaggtttaggattggctagtttgcatcatttcagcaggctctggggtttatgggctctctgtccttagttgtcctatacctggttctggggtgattagggaagggggatagtggcccagagggtgagagtgcccataaaataaatggctagggtatggactctggattggttggcttgcatttgaaaggcaaggtagctgggaaattgttgaccatctctaggaattggctaatcctggaaggggcagtccctctatggtcagtaagacccagatgtcaaagaaacagaagataaaaaagaagacacatggttaatatgctcgggatggatgagtttgggcatttggttccacacctcctcagttcttctctgggagatgtacttggaggtggtgaaataggaaatggacggttaatgaacagagagtaggaagtgaaaggaaaggcaaggataattttcaagacagaaaatcaactgaaaagttctgaccagaatgtgcttttgagagtgacccttccttctctgagtgagactacctggctttgagctggtagcagtttaccagctgggtgaccttgggtcccagtggtctcatttgtaaaatgtggataaaaagaatatatgcctgcagttgtgaggattcagcttgtgaatagctatcttacctaggaacttgcagtggcacactgtcagcatgcagtgaactcctaggactttgcttctctaggtgtgttccatggatgggcagcatcaactttacctgggagcttgttcgaaatgcagcatctcaggttccacgcagacctactggattttaatctgcattttaccaagactcccaagtgatttgtgtgcccattacagtctgtacctgagaatgtgtgttccttgagaatatgaagtatatctcaaatatctatttctctccaccagcctgccttaatgccttgcttgcagtaggatctacacatgtatgttgacataataagtcttatttatgtagaccactttcaatctccctcctctttttttttttttgaagaaggatgatgatctaaaaaacctggtatctcattgcatatactaattgcctgggttttgattgtctgtactatgtggtgcctctgtgcagtgatagacagtgagctacagtttcccagaatacacaggctcagtgtgagacacttcagcccagtgtaaactggctctatgacaaaaaggaaaaagccctgatttgtagcatctgccaatatgctgacaaagataatcccaccatgatcaatttcaggctaccgatgtgatgttattgaaggcagaattgggaagatatgcctttgattggctctggtgagctgataggaggtggctccattgtgtgttcttcctctcttgactgattgcttcattcattcaatgattgcatttttcattcacaaatagaaattgggtgtcttcctaatgcccataccctacacaggtggagggaaaaccagcactgtaattttggagccctcagtttccttgtcaataaagtgaacatcagtattaagcatggtagagattattgctgtaattatagtacttttaaacataagggtttttcctcctcttacgtcggtgaaaccatgctaagacttatgcaggctcctatacaaatggaaggtttctcacactgcaggtcccaagtgtctgtttataaattgggccatgactttgtttgaatgctgcatggtgagttggctggaggaaatcaggcaggaaatgggctttggatgggaagcaataacagagtggccccaaatcccctctgcttaagtgacctgattgagccaagctaactggcctcgcagtggtatttacaagcccagccaccgccacctgcagtctgcaagtaaacaaagtttgtcccaagaaggaggaaaaagaacatgcaggtgtgacctgcttctgtctgcctcttcctccatcccctcagtctggagcagtgggaacttggcttggcgtcttgtaaatcattccagcagcagtgctgaaagggagggggataccgggtgagctgtccgtgtgtttctgttttgcatgcttccgtctggtgaggtccacctgccttactttcccagccttctcactacacacgccttaagaaaccaaggctgtgggtggactgatttaagagctggagactcatgccagatggttccatttgaaccctggagaaggagcagctgcaacagcagcaacattcaaacccatgtcgtcaaaacactaggcgcctcccaaagctcataaagcactgctgcagtgaaaaatctccatagtgattgttcttctttcctggaaacatgctcccatgattggagaaataggtaggatttctatcaagtgagatcttcaagctgatgataccaagaggaattcagctgagcttctaggtggttgctaggccccctcttctcttcaaagcagttctttaggttactttaattgaagaagtcatgtattatcttagtaaaaataaattcaaaaagtacaaaagagtgtacaatgaaagataacatctctttctcaccccagatttccagattttcccccttcctagagacagccgttgttactagtttcttgtatatccttttaggaatattccttgtgaaaaaagaacgtagatatgtaattgatatggtttggctctgtgtccccacccaaatctgatctcgaattgcaatccccatgttttgagggagggtcctggtgggaggtgattgaatcatgggagcagtctccccatgctgttctggtgatagtgagggagttcttacaagatctgatggtttaaaagtgtcagtttctggccgggtgcggtggcttacgcctgtaatcccagcactttgggaggccgaggcaggcagatcacaagatcaggagatcgagaccatcctggctaacacggtgaaaccccatctctactagaaatacaaaaaattagtcaggcgtggtggtgggcacctgtagtcccagctattcgggaggctgaggcaggagaatggcgtgaacccgggaggcggagcttgcagtgagctgaaatcgcatcactgcactccagcctgggtgacagagtgagagtctgtctcaaaaaacaaacaaacaaaaaaaagtgtcagtttcccttgtgctccctctctcctgccatcttgtgaagaaggtgcttgctttccctttgccatccaccatgactgtaagtttcctgaggcctcccagccatgcagaactgtgagtcaattaaacctctttcctttataaattacccagtctcaagtagttctttatagcagtgtgaaaacggactaatataggaatataatgtctgtaatcttatttgggcccctggaccctttgagaattgattggaagctatgggtacttataaatgacaccaataggccaggcgcggtggctcacgcctgtaattccagcactttgggaggccgaggcaggcagatcacttgaggtcaggagttcgagaccaacctggccgacatggcaaaactccatttccactaaaaatttaaaaattagccatgtgtggtgttgcatgcctgtagtcccagctatttgggaggctgaggcaggagaaccgtttgaacccgggaggcagaggttgcagtgagctgagatcccaccactgcactccagcttgggcgacaaagcaagaccccatctcaaaaaaaaaaaaaatgacaccaataaaaagatgtggcatcccatctcactggggatgtcaagtttcattctcccaagcctgtctcagattaagacattctctaaatatctatactgggttaaggtgtctctgactgagcctgtgtgttctgggaaactctgtgtgtgagtctgtagctcactgtctatcagcaggaagtgtatctggttggtaagttgtttacttttttaaaaatttttttttgttaaaaattatcattatataactatacaggtttagtgttaaatgttcaaatcatgcaggaatgtgtaagctttaaaaagtgaaagttgtttatcttgtcctacccttccaaccaatcccattctccatctgttattactgttggaggtatccttaattactgttggaggtatcctttattgaaatacataattgtgtgtgtgtgtgtgtgtgtgtgtgtgtatatatatatatatgtatatatgaacatatttaatccaaatgagatcaccctatgcatacagttttgtattttttttccaacttaagcattatgttttaggtatacatagatctatctcattcttttaatggttgcataatatcgtttgtactaatgtctggcacgtttcattatatagaaagtctttcagaggtatgcaataaatcatccatagtggtctatttgatggatcacccttatattacagcagccctgccttcgaaaacatagggctcactctcactgtaattacaccttaaccgtggtccctggactcagattctgtgagagagggagagagggagaacatgagattgaaaatgaatgcaggagaatgtgtaggaaagtgtgcatgatggcctggaataagctcaaaatgtaaagtcaagggatccacgtttaagatctagctacatacttcctggctgtgtggatctctgtgttttcctctccccattaaattttttccttgtctttgctgtggccaggctggtccctccacaggcccctactctatccaaaaggtggctaagtcctgggagtggggtgggtggtcagtgggggtgaggtcaggggcataccccagagtcatgaacctgaacattaggagagctgggattagccccggctctcacattaactggctaggtgagcttgggcaagttcttttttgggtgggctttcctcttttctgtaaaacaagagtagaccagaccattaaaagcttccttctgtgttggaagtcctgggatgcagagaggttgggcagagtctcagggaggtgggagcctggggcagaaggaggtggctcatatacacacagccagccctggagaagaagtggcaagtcctttccacctttgaattccttgccttccttctgcagaatggatcataaatgctacctccgtgtcaggcattgcacagattaagccctcagaggacagtgttattaagttgtgatgaatttagattctggagccagacacttcctggtttaaaccctgccaagctacttaagttctcaagtctcagttgtctcatccataaaatgggaataacaatattgacatcactggtggatttacaataggtgaggagtgcaaactccttgacagcagggactttgctttgatcatgctatttcccgagctgagaacagttcctgtcacacactgggttctcagtacagatgtgtagaatggctatcgaataaaacactttgcgctttgcttgatgtataatacacaatcaatgaccgttagctgttcttttaaaatgctgctttggttattagtaaatattgcctattcagtccattatcacagcaactctgtgagatgggcagtgttattacatcacttaccacacagctaggagacagcacagccagagtttgaatccaggtgctatatgggggcaccctgtccttgagaaagtacatgacctacaagccttctcttctcttttttgcaggctttggagttccctgtaactccttttggatggatataatttgcagagaaggggagaggaaagaagggtagcagggtagttactttttagggcacctctgggtatagggatgtagaatgtgtcccctttggtttagctctgaatggacaagtccccaggaagcagttgttggcctagttccttgaagaatgcatttggtgaatccttcagttatgcaggggttaggcatgaattgcttggtgcctgcctggcctggcctgcccgggttttcctatacaatttcatttgtatccatctcttaacgatgagcaataggatggagaacagaatggagaatggcatgtgaggctggccacccagcctcctgggccccagctcatgccttctggctgagttctgcctttgccagggctaacattcagcaaattagatcaaccaaggctcctagaaggataaacaactggtggtgcttggaagagggcagctaaaggaattagggttgagggcggggacagcccctggaaccacattctcagacattcccccagcaacaaagctgcagtccactgacagtgctggggcttgtgccagcctctcctccatccccaggccgtctgagaggattgcagtcgtgacatgggcaaataaccaggaacagcagttggaggaagggagggaagtggccacagaatcctattgctggaacgaccttcagggtccttctgagcctctgtttctctcaaattgtaatctgcccactccctgaatcagaattactatgggcctggtgaaaagcaggtgcctgctacagagggtggtctgtaggccaaagttcctgagtgtggctaggcagggaattactcaggcctgcagctctgcgttttttaggttgggccctgtattagtccatttgtgttgctataaaggaatacgtaaggctgggtaatttataaagaaaagaggtttattttggcttacagttctgcgagccatacaagaagcatgacaccagcatctgcttctggtgagggcctcaggctgcttccactcatggcagaaggtgaaggggagcctgtgtgtgcagagatcaagtggtgagagagaaagtgagagagaaagggaggaggtgccaggctctttttaataaccagctcttgaggaaactctcatgggaatttgctgagtaaaaactctctcattaccaccaggatgcaccaagccattcatgagggatccaccccatgaccctaacacctcctaccaggcccacctccaacaatgggaccacattctaccgtgagacttggtggggacaaataaaccatatccacagcagacctggatacctatgttttcaatacactgtagaatattctaatagatatccctgagacctctgctcctagagatctctgacacttaggcttggaactcactgatggaggcagaaagcacagaggctaaggggatggggtccagagtctgtggaccttaaatctttgacttcagattacctagtccccatgcctggagcccacactgcccttaaccatgagagcttgttatttaatgtctctgagccacagtttcttcatctataaagtgggactcatgagggtgcctccttataatgatgatgtgggaatgaaataagaataacatttgtaaacacagtgcctggcatccagttagctcaatcaatggcatctgaaggtgaaaagtaggctgcatacctccttcatcttttctcttaggaaactgaggtgaggccaatcacccctaagaagagagctgctggcaccatcactggagccatctgtagactggtggtatctttctaattcactctacagggtatttttttttcttttggagatggagtcttgctctgtcgcccaggctggagtgcagtggtgcgatctcagctcactgcaacctccgcctcccaggttcaagcaattctcctgcctcagcctcctgagtagctgggattacaggcacccgccagtacgcctggctaatttttgtatttttagtagagacaggattttaccatattgcccaggctggtctccaactcctaagctcaggaaatccacccgccttggcctcccaaagtgctgggattacaggtgtgagccacagcgcccagcctctacaggactatcatgattgaggcagtggaaggtcagggtaaggttgtgggacttggaactagaatgcttccattcaaatcccgactcctttaatacctaggtgataggctgatctgtgcagcaaatcaccatggcacatgtttacctgtgtaacaaacctgcccatcctgcacatgtaccctggaacttaaaagttgatgaaacaaaaacaaaaaacaaatccctactcttactcttactgtttgtgtgactttgggttaattaaccttgctgagcctttgttttcccatttgtacgttggggacaatatttgtaaggatcctaggaaggtggtgggaagaataaaatgctcacttagcacagtgccaagtccatagcaaaggctctataatctgcagccactatgaggattcttatttattgtgcaccacactatggcttggtctctgtcctgtttagctcacaggcttgttcaagtgatgccagatcagttgcgccttgtgaacctccattggaactttccctgattcctctatggaactttccactcactgggtgtaatcttggcaaccacaacctggtgcacacagaaccatcagctggttggtggtcaagccctctgtgttcccaaagtgtgtagccgttaggggaaactgaggtgatgggagaggccttggttggctgagatgaaaagataacttgggaacaggatgcgtgcagcagctctctcctctgccctttcctggctggattagggagtggatgcgacccttgctccttgccacgctcccacccccagatgttcagggagtaccttagatgtccgtcagagggggtgattgggtactgctgcgtcagactgggtgaggcaaccaggaagtcatcaggcttcctggatctggaatgaggtcagccagggatgggatccgggaaaggctgctgcccatcagagcctggcgctgattttccagagagcatcacaggctcttcccaaagggcaaaatctgggcaggaatcccaagtggcggttgtggtggaggtggaagctgagataagctaagagagaggtcctgccaatttacagtggcaaagactgggttggagatgctgtaggttctgagctctctgcatggatgagagcctgcctgaggttttagagcatacaaaatgctgctagagtccatggggcttactcctgggcttcctcctcccactaagccttgattacatacctttacaatcatgtttatctcattgtatcaaggttggcagatatctgctgcctgggccttcactgatcattagcaatagcaattgataataagtcatggtcctctttcttgctgaggctagaaaagccctcagaagccttggtgatgtaacagttgaagcagctgcctccagtccaaggggtgatgaaactttttgctctctctgttatacattagagtgacttattccaatgtttacactcaacgcttcacaagggtaggcacttggtgtgtcttgttcgctattccgtcctcagcaactggcatgatacctggcccgtagcaggagcccagtaaatgtttgtgactgtcttccagaggactgtgagtttctcaaggacaaggattatgtctagattatgtctaggacacatgagtttattctgagttcagtgctagtatctataatcaagggaggaaaaaaagtagtccctcatgcttggtggtggatgtcacttcaccaaataactaccgtgctgacgtggggcaggtgggacaagtaggcgtgtcatcactgatgcatctagctctggtttccaagcacaaagacccttgtctttccacttaatcatccagtagtcttgataagttatcattgccgtgttagggatgaggaaactgacgcttggagagatttaagatgcttgttgaagagcatgtgacaattgaatgttggagctaaatccagaacctcggtcacctcacttgcaggccactgttctttctctggccactgtactgcttttcctgagtctctaaagttttgacccatgatttgtcatatgccatgttttggtttgggaggctttttggaatcctggacctaccatccttcataagttttaagtgtcacaggtacagccttcttagaactttttgagatttcccagtccagagacttttaacctggagtctcacgatgagcttggtggtggtggttgggtggggtgggggttggggtggaggtccaagtgccctgagctcatgcaccactttttatgtataagtgcattcctctagagaggaagtgtgagcttgcatcagagtctcacgaaggggtacatggccccataattaggttaagaaccaatgatcaaaacccactatgtcattttgcatatggagaaactaagacctacacaagggactttttcagaaccataatctttgaccagagattctatttctcctctcaacagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcagggtgagttttgaggctctcagtgcagaaatcaacctggggacaggcttgtcccctctgaggttgcttactttgaatccaggagtatttctaaattgaaggtgatgcctaagaaaaaggaaatagtgtttttcttttattctgtcattgttgagtgtgaaataccctcatcatagaataactgcttttgggggaaaacactactacctttaaaacactcagatgctgacttcagaaagcttaaaaagtgaaaagaaggctgggcgccatggctcatgcctataatcccagcactttgggaggctaaagcaggcagattgcttgaggccaggagtttgagtccagcctgggcaacatggcgaaaccccatctctactaaaagtacaaaaattagctgggcatgatggctgggtgcctgtagtcccaactactttgggaggctggggcacgggaatcacttgaacccggaagcctgggtgacagagcgagaccctgcctcagaaaaataaataaaaattaaaaagtggggaaaaaaagtatgctttccctattggagtagacactacaccatatgcacacagtcctcatattgattcatactgaaaatggcatggtgtttcgaggtttcgaggttctgtgggaacgtggtggttagcacactccctctcatatgctggcctctgtcctgcctgtgctcatcagctcatctcagtattttctgagaataaaggactgaatccagggtcccagagcagcctccagcaataaccaaatggcagtggaaggtgttatatgagtgatggccaccacagccaagaacatctctagtgccgaatgacaaaatcattacggaggtagctgctgcttatccagcagctctgtttcttagcagttttttaaaaatgaggccaagtccactatttctacagcgctgatctgtttctctttcttagatgaaaagggaagatttaaactccatgaagtatgtggagctttacctcgtggctgattatttagaggtaagggggaggcaatgggtcttgcagaaaaactgctctcttgatagcttccattccaggctccagactgctttggggaaatgttgcccattcatctttctccagttcatctatgattttgaccttaaatctcaccaaaggctgggcgcggcggctcacgcctgtaatcccagcactttgggtgggcaaggcgggtggatcacctgaggtcaggagtttgagaccagcctggccaacatggtgaaaccccatctctactaaaaatacaaaattagctgggcatggtggcacatgcctgtaatcccagctacttgggaggctgtggcagtagcatttcctgaacctgggaggcggaggttgcagtgagctgagatcatgccactgcactccagcctgagcaacaagagcgaaactccgtctcaaagaaaaaaaatctgaccaaaggctcattttgccattttaaacatagttggggggaactcccccaactccccccgccccttcctcccccacctccacacacagctaagcctctcctggcttgttacatcagtcacatagaaaatcaagacagttgtctgattaacatttcttgtactgggtctgaagacctttagattctggtgtttattctgaggaacccggaattgtctatggaaattctaaaacttttttttttgcaaagatgataaatatattcccagtcatccgactgaaaactgtattcttgcccatgtgtgggtccatttttataatcatgttgatgccaaatgatgacctaaagccatggtccccaaaatgtggtccccagagcaccagcatcagcagcacccttgtgtaagatgcaaattctcgggccctgcccccgacctcctgaatcccagactgtcagggtggggtccagaaatccatgttttaacaagacctctgggcgattgggttgcacagtcaagtttgagaaccactgacctaaaggcatagcagttcagcctttaactccatgttcctcaaatcagacaggttctaagaatttgaggaaccctcacctggctcatcatgtatttcatttattcatcagtgatctcttgattttctattatgtgccaagcacctggatatatagatctcaagaagacagaccctccccaggcatcgcagagtttgcagtaacagcacacaaacctgtaggtccaaagtgtgataagcactaagatggaccattaggagggatgaaagtgcagataatgggggattcaacatggttttgggaattagggaaagcttccctgacattgaagcagacacctaaagagtgagtttaggccccagagcccatatttgcctaaattagccagctgttacctccaattctcactttgtttagtgactccatcatataagtactaagtgcatcttctgtgcattggatgtcattatgagctgagcgctcgctgtgttcgagcagggcagacactggccttggtctctcctgaggatagagcccatcacaactccagtctgtctgtatcccatccacatagtttagctaccatcttcccaaagagctcattctaaggcagctgtacctagtcacatttccaaagcatgtgtcctggcagcagggcctggtggtggggagagcactaggctgcaggccagaaggtctttgagtgttagtcactggatgttagcagcagaaggaggtggcccttgaagctgtcttaaaagacaaggaggagttaactgggcagaggagtggaggtgaagggcattccgggccgagggaacattgtgctctgctttgaaaagcgtttagatttattttaactgatgttgatattggtttttccaacagctgtttgtgtgtgtgtgtgtgtgtgtgtgtgttctatgttttctgtttcctctccaaagactagtgtgtctataggatgggggaatagtgtggggagcaaaatccaaagctggtttaaaagccagctgaggctccatagtcgtgggaggagataactgactctggcctgccctgcctgactgcccgtagtgggaggactggtggaagaaaactgagctcctctgactctgggacatttttccacttaagttctgcatctgtgatcatctgatacaatggtcttgagtcatttttttcagctacagaatcctttggttacatggaagttcctgggaaccccagtagttaagcatatagagcccagctgctctgtttaaaggtggggtgtttctcccctttggccttgcattgttctcagaggaatctctgtgcaggctttcaaacccactgggtgtgaatctccagcagctggagaagtgggaagcatggtgggaggcagggattaggcatcttctatctcctgacctccagagtcacagcacacctccagagaaaaagtgtccactcaaggtgcctccaggactctggtgtcagctagagccatctttctcttacaaaggagagtgtctcagcaacagccctgggttcccaacagggctgtgattcatgcagctgtggtggataagggaacgtgctcatttctcagtcctggacacccctccgctgaaggctttgaatgattcatttgagggactggggtgggggtgtgtaacaggccaggctgggttcacaggctcacgaatcatcccctctccacctgtctccatcctctgcagacagaaatatattcttgacaattaattaattaatctgagaggatgggaaggcaggaaaggggagggctgctttaccatgatttataacctgctgcagagacagagccttggggctctgaatgcagagcagaaagtggagacacagatagggagagcaagaccctgctgctgcctagagagagagttgtcagcagtaaaaatgagcaggcagctcctcgctccctgggcctaggtgggagcttctagggtggttctcagtttattcattccccaggtggaacggaatccaggtggggataaagagtaaggtgggctgttgtaggagtagacaggataactgtaaacacaggcctgtaaaggacttccatgatgctggcacagtgcagagtggctgggaaaggatggtgctgcatgtggtactcactgtgtcaccctagaaaatgtaagtttgagacagtcctttctttacatcaggggtctgcaaactataccccatggtcacatccagcctatcctgtgtttttgcaaacaaaattttactggaacacagccaggcccattggtttctgtattatccaggcttctgtattatatatacaggtgtctgtattattctgagccaccactgcacagttgaagagttgtagcagagactatggggccgcaaagcctaatccggcctttgcagaaaagatttgctgactcctgcttcagaatactctggacaacagaattcgctccttaaattatggtggtctcattgggcagttctttgaagagaagattaatatttttttgaaagacaatgaaatctggccctgatgttctaataaatattactaaatgaatggaaatgctgcaacgctgtctgtgccgagagaccaatttagaaacaggaggcctctataatgagaaactcctggattaacaccttggaaaggtctaagttacagtgtcacactgaatctaactctagaaagcagtggtaacagattctcttctggtgagtggcagttttaaggaagcctaagaatgtccacaagctgtggtgaaagggaaatggtggatttcttccctgtatcagggctggtacacacctctggccaaacaaataccccaggttgttttacttggctgttcttgttctttcttgcttagatattctcatgggatggggtggaggaaggacgtgaagattttgaatcaaaataacatgtatagtgggtacctaagataaattagagaggacccagattctgtgtaacaatggcagtgtacaggacatgcccatcatttttaaatgtaatttgcagttgtagcaggttttctctttacactgtgaagctttccttcatcattgcagctcagagagatctatctttttgaggcaggaatggtaaataggaggtattcatactaaaatgtcctctttctggtacccatggcagatatttctaatggaacacagctttctttcctgtgcttggttagaaatgtctgattacggccaggcgcagtggctcacgcctgtaatcccagcactttgggaggccaaggcagatggatcacttgaggtcaggagtttgagacaagcctgaccaacatggtgaaaccccatcattactaaaaatacaaaaattagctggccatggtggcgagcacctgtaatcccagctactcaggaggctgaggcaggagaatcgcttgaacccgggaggcggaggttgtaagccgagatcacgccactgcactccagcctgggcaacaagagcgagactctgtctcaaaaaaaaaaaaaaaagaaagaaatgtgattgaatcgatgcagtctcataattcttctcattcttctcactgtagaaggcactgccagtggatctgagtggtgtgcaagatgaagcctatttgccagtgtcttatggtcctcctcgttggcactcatgtcattcacatgacctcccactgtggttatttctgtgcacgttttcccggcaggttttctcaaccatttcagttctatactccttaagtacagggtctgtcactcagcatctgccacagttatttctggccctctctgttttaattgaagctcctctaggctagaaccaagatctcacacttctttgtgtcctacatagtgctaagcacaatgccttgcccatagcaggcattcagcagcaattcgatgattgttgattgaccacatgtagggaagcctcgtgagatctgtgtaatggtggcttcatgttggggtgatgaccacggtgaggattggatcagtcctcctaagccccagtgggagtttgccagaggccatgtaattcgaaggacaggagaataagatgtgcttcaagggttagaggaaggcaattctactccgtgcataattattgcatgcctactgtgtgtgctgcgctgagctagtagctgtggatatgaagatggatgttgacaggtcctaccctccaaagctcttactgtggtggggaagacaattgcataaaaatgatggctcatagaagacagaagaaaataagagcaaattcaaagacaagtaatggggcgcaggaagcatcctgtgagaggttctgggatctcacatggttctgcttgtcccatttagtttcagaagaatcgacgagaccaggacgccaccaaacacaagctcatagagatcgccaactatgttgataaggtgagaccaggtgtgtactttgtgggaaaggtgccaggtgccagcacttccaagggcactggagctgccttctgctggattggctgccccagccatcttctgaaagggaatgagcagtgccatagaggcccagggcggtcatgacagagccctgaactacgtacccttaggcaagtaactcattttctttgtgttgcatttttttttcttttgttctgttttcagcttataaatagaaaggctgtcgtaaatcaatgtgtggtttttttttgttatttttattttcctggtggaattttaaaaaatgaaatcttatgccaatatctactataaaagttagatgaaaacagactgctctaagtgggagctggggtgaggacccagaacactgtccttctgaccccttcctcttacccctgcagtggctcccgagcagcttggggcatggaagagcccagtttaagaatcctttaaggttctttaaggttccttccagatacaaagcccagggattctctgacttaggagggaattgaggtaggtcagggtgggaaagacacacagccttaaaagttgagaagtgggctgtttgagaagtgggttgcttgagaagcggattgtctgagaagtgggttgcttggggctaatctataaagtctccatctgtaaagttatcctaaaattatgtcttgtctcttaggaaggatgtgcagtggttaactttcctaggtcaggaccttttacaagatgctcttcggaaatacctacatttttgaattttactagaacgggctggtctgggacttggaagtacattgtgtatatgaaagaagatatttgttatagtacaaaatgcagaataggtaacctagaatgacagtagcctcttggtaggctagtagtatatagtttttaaaagtagtttttcatgtgtttgggatcaaaagtctctttgagaatctggtaacgtttattgcacaattttagaatactcataacattgatgaagcttaactttgggcctgctagggattcatgaattccaggtctaaagggaaaatcattttttcctaaacactagagaatataggagatcacttaaaatatgttttagggattaataggcaaatgtattagttctgaagtcatcagatggcagtttccatgcccatggtttttttctgccctagatggctctggaaacaaaggtcagtggtcagtgacaggtgaaagtcaaacactggcatttcctggaaggacagactctagggacacagtccagtcctccctctagctcctgactcactcaagaataacatttaaataatcctacaacccaaacatttgacatctgggaaaacaagggaagcttgtttccctggggagaatatgggaggctgactctgctttcccccatgtgacatctattgtttggagacctggcaggttcggacttggctgggtatcccctctgtggggtatgtgatggaaccaagggcgctggtgacaagtgaagggagaagagaggcaccagcaagccccagtccttactgaaagccctaagcctgggtggcccatgcatcctgtgcagccgtcttggctctctcctcgcggctggtgttagtcactcctggcgggtaagggaagccacgcccacttctctggagcttgctgacctagctacttgaactgaactattgttgaactaaaactggaatgaattggactcgtgctgagtcatgaacccaatccaaaatgtttttctgtaactgtgaaaaaaagccaagtttacttccttcaaaagctccctagtaaagcaaattcaaattggaatctgaaccttttattttctgtaacgattgaactggcacaaaacagaaaaatcaaaatttctgttgaaataaactgatatttcactgaatctggagcccatcttgaccagcgtttcttggagcgagtggattatctggatgtgtaggtactgcagcactgaagtagtaaagggtcacaaataggctctgaggttgtaatttgggccttcatcctggctccaccatcttcttgctgagactttgggcaagttccttaacttctctaagcctcagtgcctagtacgtaaaaagtggtggaaaaatgttggtgctatgattattcttttcagctggggcagtacctaccaattttggataaagatggtatctcctgctcattatgtcctctccatacatggggctttttattaagtcactggctcagtatttgtagggtggacccatcaaagaacccgttgtatccacaccttccagtggtttagctttaaagaaaaccctcctcctgcttatatttgtatgaggtgaaaaatgccagatcataaagattagatgtagctctagcctcgaggaggtcgagtcagatcttgggtatagaatttcaggatctctggtttggacaaaaccctgaagattaccaagaacgtctgtagtctattgcttgcaacctgcttattccatccttgacaaaacctgagactatccagggatggggaagaaaatttgaagagtaagcatatctgtgcacttttatgtcatttatactcatttacttccaaaatgagtgggagacattttataataaaatatccatgtattaatataatttggtatatccatacgaaagaatattattcagcaataaagagaaatcataaacgaatacactctaacacatggatacatctcaaaaacattatggtaagtgagagaagccagacacacaaaaccacatattgtaaaacaaatgtccagaaaaggcagaatagaaacaaagtagatgcacggttgcctgggctgagggtgagaatgggaaatgactatcaatagacatgagggatctcaccgatgtgatgaaaatattctaacactggatgatggcgatggctttattttatttttatttttttttgagacggagtttcgcccgtggcccaggctggagtgcaatggcacaatcttggctcaccgcaacccctgcctcccgggttcaagtgattctcctgcctcagcctcctgagtagctgggattacaggcatgcgccaccacgcccagctaattttgtatttttagtagagatggggtttctccatgttggtcaggctggtctcgaactcccgacctcatgtgatccatccaccttagcctcccagagtgctgggattacaggtgtgagccaccacgcttggctggtgatggctttaaaacttggtaaatttaccaaaaagcattgagctgtacacttaaaatagatgggtattatggtatgcaaattatacctcaatgaagtggctttaaaaaatctatatacaagagaactttttagatacccataagaaagataaggctcacataaggaattgggagaaaaaaattgtaccagacagcctggccaagggcactgattacagaagacagcaaagctcagctctgagctatctcatgaccagctttgtttgaaagccttcttcctattttaaaatgaaatttatgttcctgtctgttttacctattgacctaagccctacttgaacatcatgcagaacaactttttccacatgatagacctattcatatctgaaagcaattttatgtcctatctcagtcatctctaaacaaagtcactgcagttctgccaccagaatgtcctgctctctctcaggatctcattttccctttctaaaaaatgtcagtaacaccagttgcctccttctgttggagccatgggcagaagagaaatctggtatctgtgctctgagttcttaggctaggaaggagctttttttttaaatttatttttattttttagttttagtttttttctttttaatctcaagctccaccagaatgaaaggaaggggcttttaaatcccaggtggtattgacagatactgtggtttttctgtgtcctttcagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgtaaatagcctttttccatatgttgtgttgtccttggctgcaaagcctctgcccacccagcacatgctcagagtttgccccatggcgagtgttggttgtacaaggccattctgactccctggtccagagaatcaggcatttcctaaacatgcgctctgtacccagcataccccagaaaatgtttaaaagcctgagtcacattattcctaagaaatgtttacagtctaatgggaaaattagacttacacatattccattgagcatctgaaataattgtgtatgtatttgggaagggactgactgttggtcaggtcttagactttctaagagactcatctcaatcttcctggcgctttgttctaatacatgagctgatctcccaacacaggcacaggagagcgggctccttgtgttgtccttcacttggttcccaaggggcacaaggctgagtgcttgagagagtccaagtgttagacagtgcaggaactgagggtttggttggagggagacattgaggagggattgtgctagattttcatcagcctgggagagacagtgatgggggtcacatgtgacagtgccccagggtgattatttggtatttattagtgttgacttctgaaggtattttgaggcagttacaacaaaaggcatatagataataaaaccatttgtcttcttttcttttttttttttcttttttgagacagtttccgtctgtcacctaggctggagtgcagtagcgtgatctcggctcactgcaacctctgcctcctgggctcaagcaattctagtgcctcagcctcccaagtagcaggcatgcaccaccatgcccggccaatttttgtatttttaatagagacaggattttgccatgttggccaagctggtcttgaactcctggcctcaagtgatccgcccgcctcggcctcccaaaatgctgggattataggcgtgagccacacatgcctggccttcaaaccatttttcttctgttccctaaatatagctgagttaataatcatttaaactttggcttatccttttaaagaaactgggaaaaataactgtccccaaaacctgggctgtaaatagttactacatttgcctaggaagagtctttggctattagaacttttggcctgaactttggaacatgtagaaaataactagtaggacttcatatcaatttgcatagattttgcatatttctttgcagattgtttctctgaagataagtctgcctgtaattcagcaaacatttattgtatacccactatgtgtgagattctgtgctaggttctacgatcccaaaatagttaagatagtcttgctgtcaaagatatcatggtctagatgagaagacaaacgtggagataagtaccacataatgaatttccatataggttctttaaatacattacatgtttgtggcatgcacagaaacactggtagttttttttttcttctcctctaccctggatgtatataactgaaagagggatgtattcaactggggaaaatgaagcttgctgctggcagattaggatcccattgcaaaacaaaggcagaaacagctcattcttgcatccaactgcactttgtgaggctcctgatggggcacagctgtttccttggcccctgagtatgtgggaatgaagcatcatcggccccacagctgctgccccgatgcccccacccctaccctgtgggactcacaccacagagccaggggtaaggtattggatcccggcagctggtggaagtgggcatgattcacttcagcatcagaatctgtgccacccttccatcaacctctccttctgaccttttcctgtgcagcaggaatgcaatgcagctttgcaaaccctgcccatttccttccaaggaatcagctatgggtatattgtgggagataaacgacctttctctctctctttgtgttcctctggagtcatgagggagtaggtgagaggaagtgagaggtgtggtgagctggaagttgtccagttggcctggttacaagggcctctccccttgggaatgacctgggaaagtcagcgggtccagggaaccccgtgatggccacttactcccaggcacattggaacagccctcttagtctcgtccccggtcaccgtctctccttgcctcctgcaggggcatgtccttccacggcaccaccatcggcctggcccccctcatggccatgtgctctgtgtaccagtctggaggagtcaacatggtgagtctcagcccgtgtgtgtgcgctgcagaaggcgctgagctgcctttcaagaccagaggtcatcttttgaataataagttgatatttattattgtagcagaaaaagctttgacatcaggaagggcaattgtttaaaatgaagtcattaagttctaagagatggaggtactgaagggtgaattttcatttattatagttcattccgtatcttcaagctcaggaaccctgaagagattacatgcatacatcactagatctcatatgttccaaaccaggggctggaaaatagtaagagagtagaggttaaaagtatttttatttcaggtcgtgtgctgttatatatgtcattaagaaacaagaacctgtctcaaagtcatggttaggaaattactgccttcttttgaaattcactctgacttcatgagactatttgttttgactcttcatttctaacctgtgaagtgcatatcaaggaagacttgtcttcatctatttgtctgtccctctatccattctgtatttatcgacaaagtagcataatggccaaaaccacaggctctagggtctgagcctgttgggttcaaagaacagctgtgtgattttgggtgagttaatgagtgttctcagctgtaaaaaacgcatagttttacagttgataatcataggataggaatgggaattaaatgaaataatgcaggaaacacacttccatgtttagtaaatctctttctgctgcttctttcctgctgggtttttttcctcttgatttctttagcttttgcatcatcagacagtacaccaagtgctgtgcctggagtgtatctgtcttgtgtggttttctcaggaaacactaagccaagtacaccctatgtttgaatcaaggtcgtgttttctatgttgatttccttatgtctggagaaatatatatgttcagaagaagaatggggaaaaatcttcctcttttatttattctgaaagcatttattggtctggaagttcatccataggtcagttgtggtctgcaacctttgagaactcaggaaacatggacttttaaacatttgatttcctcctagtgacagcagattcagccttgctgtcagaggcacatatggagagtctgtatgctcagtgacagtggaattggtggagacctgcaagacttggctaaggataaggcagggatggggggcagaggcagatctgtccccttgaccttgacctcaactctgtcttctgagcaggaccactccgagaatgccattggcgtggctgccaccatggcccacgagatgggccacaactttggcatgacccatgattctgcagattgctgctcggccagtgcggctgatggtgggtgcatcatggcagctgccactgggtgagtcaaacagcaagagggaggatggggaggagggcgggcacacctggacagtgtgacccaggggttcctcccagctggccccactgagactcccttaaacttctgatggggccaaaaaatgtagtttttacaacaaagaaattgagagaagaccaaggcaaatgtgcagcaagaacttaactttccagcaggaggtttggtgctggtgtaaccctagatttatttaatttctgttttaaggtgttgagttataaaattggcttggccatatgtgtcttttttatttcatgaattttttatgaggacacattttgatcatagccacagcccttaattcttctatcccaagagagttggatcagtgctgtttcaattccaggcttcactgaaagctccgatgtaacagaacaagttgaagaagagggccatccacacaccccacagtgacttctcagggagtttgcaggccacattacccatgaggaacagggtgaggcagctgcatctccctgtggtcatgaggaaatttttttttttttttttttttgagacagagtcttgctctgtcgcccaggctggagtgcagtggtgtgatctccgctcactgcaagctctgcctcccaggttcacaccattcttctgccttagcctcccgagtagctgggaatacaggcgcctgccaccatgcccggctaattttttgtatttttagtagagacagggtttcaccatgttagccaggatggtctcgatctcctgacctcgtgatccacccgcctcggcctcccaaagtgctgggattacaggtgtgagccaccgcgctggacatgagggatttttaaaaccagagtctctgaagagaattagggagtttcttcaaaggacttgtcttctagcatctgaactcaggcagcacaaagcattgggttcttccaggctctttggaaggcatcacgttgggaccttgtgttccttcaccccacaccattagggcctgtttatgattcttagagaatggtgtttcaatgtctccaagaaacagtgcagctttcttagagctctggtgtcaattttttaaaattatttctcagctgtgacatggaaaggatgatgttggctgggtgcggtggctcacgactgtaattccagcactttgtgaggctgaggtgggcagttcacctgaggtcaggagttcgagaccagcctggccaacatggtgaaaccccgtctctgctaaaaatacaaaaattagctgggcgtggtggtgcacgcctgtggtcccagctactagggaggctgaggcgggaaaatcacttgaactcgagaggcaaaggttgcagtgagccaagattgtgccactgcactccagccttcagcctgggcaacggagcaagactccgtctcaaaaccacaacaacaaaaaaagaatgaggcaggatacagcttcacagtcatgcctggatccctataagctcatggttaagctcacccctttctctctcaatctaaaaagcgtatctgaagacaaatgattgagagttatattgattactactctctttcatttttaaattattcacaaatatggatagtttaacaattattagtaacaaattccttggagcataccttcccactgaaggaaaagctccagtttcttggagggtttaacctttaattggtttagagaattgggagcaggataactctccttttgtagacccagatggctgtactatttgtccttttcaccaatggtgggacccaggaccttccatactcctgtgataaagagcatgcgtttatgagttggctggttgagtttggaatgccctctgcatccttagaacagcaatgagatcactggcccaaaatgaaataaaacttatgatcttggcctttttttggcctggtcctctgtcacaagagaatattcacctgatatcagcttcaggaaaagtttaggttggctggtgttttcttcagtgctaagtctcaggagacctcttgtaacacactcacaaccctttacttatcgcagccccctcatgcaatgggcagaaattgctactcctgattctcaaatgctttctgcatgccgactaagaaaaatagaatgttatggggtggttaatatctcatcactaaggatgaaagaattcttttttttttttttatactttaagttctaggatacatgtgcacaacgtgcaggtttgttacatatgtatacatgtgccatgttggtgtgctgcacccattaactcgtcatttacattaggtatatctcctaatgctatccctccccgcctcttgctaccctacaacaggccccggtgtgttatgttccccttcctgtgtccaagtgttctcattgttcagttcccacctatgagtgagaacatccggtgtttggttttctgtccttgcaatagtttgctgagaatgatggtttccagcttcatccatgtccctactaaggacacgaactcaagggatgaaaaaattctaaattaatgtattggtaaatgttctaaggggccagaatgtatgtgtgtgagacaatgggggtctgaacccaggtggagtcagccccacgggtagcaggagtgacagcacgagtgacacctgcctgactgctagatgctcaaactccccactaattccagccttgtcctctgccaggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggtgaggggtcacaatggtgctagtgggaggggaagaatttgcattggtttcaaaactcaaggtcaaagagaacacaattgaaaatttcttagtcacaggtgtttcctacatataactgtccaataccccatgaaaaatcagatatgaagaagccttccagttggagtgtttgtgccgcctctgctagtttgtggccagcatcgctagtgtccaggatcagttcttcttatgagtgtctggtctaaccagaaaccacgatcacgtggcatgttgactctgtcttcctcagtggagctgcacatgcctgcttgccctccagctgcacggaatttattctggaggccacacagccagatatatgggcttgaacaggggccttatgaggatgcttaaaataacaagctcatgctgtttaggctggaggagagatgatggaaaggggatgtaggaagtgctgtcaagtcccaaaagggctgctaggaggaactgtttatgtgtaaactctctccttccttctgatcttcacagtgagtgtggagggtacacggcagagcccggtcatttttaacaaatgcatgtggtttctgcagaaagcagaactggattgtttcgtctctattttttgaaggctgaaaatatgtatgtttatacatgcataacaatttggggtagataacaagtaacagtaaattatgggggtgagactgaggttctgtataaatggaaaaaaaaatctgattttatggccttctctctctcactctgttgcccaggctggagtgcagtgacaagatctccactcactgcaacctccacctccagggttcaagcgattctcctgcctcagcctcctgagtagctgggaatacaggtgtgtgccaccacacctggttaatttttttttttttgtacttttagcagagacagagttttgctacattgaccaggctgttctcaaactcctgacctcagatgatccacccacctcggcctcccaaagcactaggattgcaggcgtgagccaccgcaccctgcctgtgacctctgtgatgtgatttttctttttttaatgccagtatgtcactttcagaataaaacaagaactagtcaaggatgccacccccaccaccatgagcccagagagatcaacacagacccatcagaaaggagggagtggtatgaacatggagggccactggggttgaggaatggcctgagagtgggcatggccagttggcttaggttctgagcagttgctcattcaacaggcacactgagtgtgggctactgtgtctggtcctagggttaggatgagtggcaaaaatgacatagttcctgtccttggggagctgatagtctagtgggagaaacacatattgaaataattgcaaaagaatatatgtacagtccatggcaagtgctaggaagacaaatgacacagtgctctgaacatatataatgtgagggggaacctccttgcttgtgtgggaggtgacctggagcccatatctgaaggctgcattaggagttagtgaggcacgcaggagggaaggcacatttcaggtggaaggggagcctgtgccttcgtgggaagaaatatggtacattaggaaggcaggaatacaggtcttcctggagcccaacatggtgggagaataatgggaggaaagtgttctattccttctcttaggggagacaggtggacaggtgtctgtggtcaggggatgggatgtggctctccaatatgctagagccctggacagttaggggtataaggttgataaacatgaggtaggcctcaggcagacctgacttgaattcagcaggtgtgtccctcggccagctactggacttgcctgagccacagcatccctgtctgtggaatggggtcaaggctgcctcataaggctgtggtggagagatctgtggagccccgtacacttttcatcaatggctgatggattggcctgttaatactgtaagagtgtgatgaggacgctcagggtcactggaacgcctcataatcttttaaaaatctcaggctgggggagagcaaggaacccatggagatcttctgttccagaaaggtccaggccaggaagggcttaggaagagaagcagatggagaaaaaaatctaaggaaacagacccaggagttgacataaactgtttggagaggttgttccagcagactcttgcaccggcagccccttttcatgagataagaaagcctaggagggttgggggcaggagggcacccatgaaagacagggtgtctggatgttctactggggattagaaaaacaaaacataaaatttccatatactctgctaaaaagtccattttagaagactacatggttacagggagaaatacgcatgttatattaagtaaaaaaacactgtggatactatgattttgtaaagtaagtataaatatatatgtatgtgtgtagaaaatgccttgaaaaatattcatactcaaaatgtagctgtgtcctagcggggcatggtggtgtgtgcctgtggtcccagctacttgggaggctgtggcatgagaattgcttgaacctaggaggagaaggttgcagactgtctcaaaaaaagatgtagctgtgtccaagtcatgttactaatgattgtgcatatatatggttcttgtgacaagtacacattagcttagtgacgaagctgtcacatgatttttgaggtcaaaagtttccaggccaggtgcggtggttcatgcctataatcccagcactttgggaggccgaggcaggtggatcacttgaggtcagaagtttgaaaccagcctggccaacatgacgaaacccaatcgctattaaaaatacaaaaattagccaggtgtggtggggtgtgcctgtggtctgagttacttcggaggctgaggcgggagaatcgcttgaaaccaggaagcagaggttgcagtgacccgagatattgcatcactgcactccagcctgggtgacagatcgagactccctctcaaaaaaaaaaaaaaaaaaaaagagatagttgctagagagctggggttccaggggtgtgtgggcaagggtggggaaaatgttgggggtggtgaaggccctcccccactcacacccaccccactgcctccccaggaatgtaacaacccctgctgcaatgcctctaattgtaccctgaggccgggggcggagtgtgctcacggctcctgctgccaccagtgtaaggtaagtggcccttttctccacgccttgggccctggcctgacagtgggaccacaggactgctctgctggggtggatggctggggatttgcctccatcctggggctgtgatggcaacagagtttcagaaacacagagcggaaaaggtgccttgaataaaatttactattcctatactgggcctcactgaattcagatcatcccagaggagggtggcgcttctttggaaatggtacttttttttttcttttttaaagaagtatccagagagagtgggcttgattttattgagctcataaacaataataattatcatcatttgtattgacattaatggacctcttagtagatgccaggcactgtgctgggaattttatgtacgttatctcattctctcctcacaaaaaccccataaaatatatgtgactatccttattttaagatgtggaaactagagcttataggggataagaggtttatctggaatcaggcagtcaggaagggactgaatccagctttccctgactctggtgcccacattcctaatattgatgtgagagataaattgtctgttgctgctagtgttaccgtagaaccacaatctctcttccacaattctgaaattaagggagttctaaaagctgaaaaaaaatgtaaacacatttggtggcaaaacttgacctgaattgacatgagatgaattatagtctttttaaaaaaaaatcactcctaaagtgaatatttatattgcattacagaaatattaatatgtttgatcagaaggtgttatccccagccttgctggggggttatgtaatatacatatgtagttatatatgcggacatatgtaattatccatatccatatatatatatatatatatatacatacacacatgtgtaattatatatgtacacacatgtacatatggacctatgtattacaatatctgctttctaaatctgaaaagcctgaaccccatctggccccatcattttaggcaggaactgtgggcctgggcttctgcctagcacttgctgagtgctcgttaggggccagataccattcacatacttagttctaactcacgtttaatcacccattagtgggttattatcctgagttgtgggtgagtgagcacacacaggttacacagcaggtgcccaaggccccgctgccggttaaggagctgggatgtgtgcccaggcaggctggctgtggggcaggtcctctttgcctccacctgcctctggatggcagaggtgtgtcctgcagcctcctcctgcatacaccacccatgcccacacttgcgactgggcatccactctcagcaagctgctcagctggcccagtcttggcctgagagtggccggtggagaagcctgtctgccttctcctggaaggaccctgtgggtgggaggagtggcccaggagcaggggagggggtctgttctcagtcactggtttccttgcctggctctcggaatgtgcacggcatctggtttggctgtgcgtccccctgggaggctgtgctgggtcaagttcttccagtcttggcccaaggcctaagcataagcatggagtggaccccttcactccacacaagaatttccgtttgagcctcagaaaggattccctggtgtccaagactgacttcaaaccctggttgtgtgatttggggcaacctattaactctctgagcctaggttctttatctgtaaaatggaaagagtattagtaacaccgactacccagggaggctgtaagactcttcgccctttgccccaggtgtgctgttgatcaacttattgatctgcaaagtgggacaaatagcagtatctatcccatggaagctgtgaggatcccacgagatacgtgtatgtcacacactcagcccagtgcctggccccatagtggggatatattattgctgaggtgctttgtaaactcacagatgttatgtgaatgctagttttgtgtgtgtgtgtgtgtgtgtgtgtgtgtattagtgggcctggctcctctgccacttactatgagtctttggatgcatcgtctaacctctttaagcctacagattttatcatctgcagaagggataattatatcacacaggactgtcatgaaaactaagtgaagtcatatttgtactggacacttaagtgggagctgcataaaagtagctgctattactaaagcatgtaggaaactgtaaattgttgtataggtattatttcttgcctctttcttaagacttctatgaagagaaagtgagttagcatttgtgaaaacagcttgaaattctgtcagtattcacatgagaaggctgaaggtggtttgggctaatgaggtcatgtaaaaagtgctgtgaaatcatggtaatggaaaattctgttctatgagagtgatccttatgagcccttgggcaacagggttgagggtggggaggagattgactgtgttttcctctcattccttggctcagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggtaaggctctcctggggagcacggctctccccagcccaccacttcccagccagcctcccctggccctcagggtagtttggaatcttggcttcaaatggcacctctagatactacctctttcatccccttgactcagggtagatgttcagggagaaccagaggacagtgttccttcccagtcccttgatgcttttatttctcagagtggacaattgaataagagtaatccaaaagaaaaatgagcagaggatggagacagagaagcaaatgcaaatggcccttaagctatgaaaagacgtttaatctcagtcatattaagggaaagcaaagtataattatgatgaggtgagatttttcatatatcagattgcaaagactgaaagttaagataataataatataacaacaataataatgatatagtgttgtggagggtgtgaagaaacaggtagatataaccactatggaaagcaatttggagatatacttagaaatgcagctaacacttgcacatgtatgtgaggatatatttactatgatgtttactgcaccattgttagccatagcaacaacaacctatgtgtccttcagtagggaccaattaaattaattctggtacattcatataatgcaatgctttatggctaaataaggaggcagccctatatttactgaataaaatcatcttccacaaaaaattaagtgaaaaatgcaaggtgtagaacagcaaataaaatatgctttcaagccagatttggtggcttgcacctgtaatcctagctactcaggtggctgatatggtggcttgcacctgtaatcctagctactcaggaggctgaggtggggggatggcttgagcccaggagtttgaggctgcagtgagccactccactctaggactccagcccaagcgacagagggatgtaccatctcaaaaaaaaaaaaaaaaaaaaaaaaaaagactgggcacagtggctcacgcctgtaatcccagtactttgggaggccaaggcaggtggatcacctgaggtcaggagttcaagaccagcctggccaacatggtgaaaccctgtaactgctaaaaatacaaaaattagccaggcgtggtggtggacgcctgtaattccagctactcgagaggctaagacaggagaatctcttgaaactgggaggcagaggttgcagtgagctgagattgtgccactgcattccagcctgggtgacagagcaagactctgtctcaaaaaaaataaaaaaagaatatgcttccattctttattagatagattatctctagaagatacacacagaattatacctaggagatacagaaattagagatttaagtatctttagaaaatatactgttaataagtgctattcctccaggatgtagagaagtaggaactggatgactacaagaaaaattttccaagacatacttatatctttaaaatattatgcatgtatgacctattttttaaaatcttgaatcggaacatggcttcttcattagagagcaggcttagcatgcaaccctccccacacacaaatataaatcctcaataaggtaggaagaatttacataaaacaggccaggtgtggtggctcacgcctgtaatcccagcactttgggaggccgaggcggggggatcatgaggtcaggacttcaagaccagcctggccaagatggtgaaaccccatttctacaaaaaaaataaataaataaatacaaaaattagccagtcatggtggtgggtgcttgtcatcccagctactcgggaggctgaggtagagaattgcttgaacccaagaggcggaggatgcaatgagccgtgattgtgccactgtattacagcttgggtgacagagcgagaatccatctgaaagaaaaaaaaaaggatttatataaaacattattctctgagtagatcttgttgagaatatggggatggagtaacctggagggaacaggaagaagaggctgagtattccctcccagaaaatattcttaccttcatgactttaccaaagatacctttgcccttgggggcttctgacagatgagtatactgatagatgttgcttgcccacccaggagcccgacctgcccctgacctctgcttcgagaaggtgaatgtggcaggagacacctttggaaactgtggaaaggacatgaatggtgaacacaggaagtgcaacatgaggtgatgaccaaagggcaggcctcatgaaatgaggatgaacaagcagtttctgctctgtcctcactgttgcccaactcagcagtgtgactggccccagagctgcacctttacgtcaatcagttgaagtcagtcatctattctcggccccctgtttgacaatgcacttttcagctctgaggaagtcagaggagggtgtgggtggcagtgcttcctagaaagctgatcgggcttcctttggggaccatcttacagtagggcagggaatcagcccttttgggtcatttctgccaaattctaatcatgccctaatttgaatagctcctcattcattaattcactcattcattcatttattcatcattcattccaaccaaccatccactcatctgtctacccatccatccatccatccatccatccatctatccatccatctaccacccactcacccactgatccatccatctatccatcctccaccacccactcacccactcatccatccatccatccatccatctgtccgtccatctatccatctactatctattgaagatttactgtctatctactatctattgaagatttaccatgtgcaagatattgtgctgagtgcatggaacttctaattaacaatatagtatgacaatggcaatgtggagagagccatccaacccatcttagtgtgtcagagtggtttcccaaaggaagttatacctacactgagatctggagcagttacctcggtgaacagggtggaaggtggtgctggtgcataggagagtaatccaggaagagagatgaatagagaaaaactggtggttgaaagaactgagaacagtttgatacagttaaagtataatgttggggtgcaaaggagaaggtctgctgagaaattagcctggatagtttagcatggaccagatcatgaaaagcctcaaatgcatggctaggggagtttagattttagcttgagagcagtgtgaaaattagactcctatgaggcagactggaggcagggaaatcaatcttctgcagaccaggtaaggggggtggggcagtgtgaattaaggtagatagataataagatagataattaaggagggaagattgatagggtttgaaaatggcttgagcccaggagtgagggagaatggggagttggagatgaccccagatttctagctggaactcctgggtggacagcggtataaggggcaaaaagggaaagattgctcagctcaggtggctattcttggagttaaggacttttcgaggccagttctctggtctagatttgctcagggtcaaggagcctgttctcttcccttggtgtcagtccacatggaatctctcctggtgggttccaaagcacatgactgccctaaacctttgccccaccccacgcaagcctgctgtcttgatcaagaaagactgaagctctctggtgccccagctcttcctctgcctctgattccgcttccttccctctctgtctcttgtgcccagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatgtgagtcccctcccctgctcacctaggagccagctgcagagcagagtgattgagaagtgaggtctgagggaaggatgcctgggctcagatgccacctcgccaacctctgagccttggtggctcccttcatgaagcgtgtatagtgacagcaggcacccaccccagagaactgtcggaaggattaaagaaaatcatcccagtaaagcacttaggtggcctagctagtgccactttcatcctcatcgctaattatcataggaattaaaaatggactaggagttagggaagcctgagcaaaataatagcacagactctatcctccagagtcgattctgataatgaaactatggaaaacatgaagcatttagcatagcacctggcacagagtactgtcaccatcattatttttaaatataatgttaaaattgatacatattaatgacaagtaattaacataatcaacataatagtcctttaatgtgataacacataaataatattgtattgttaaatatgatactttaacaatatatttgtcgttttctccctaatcacaaaagtaatagcagaatttagttggctgttgtcctgtccttagcgttgtgggctgttttccatttttcactttgatagtaacctgaagtgtgctgcctatttgggccctcatactttttttcttttaagatggagtcttgctctgtcacccaggctggaatgcagtggtacaatctcggctcactgcaacctctgtctcccaggctcaagcaattctcctgcctcagcttcccgagtagctgggattacagacacaggccaccaggcccagctaatttttgtatttttcgtagagatggagtttcaccatgttggccaggctggtcttgaactcctgacctctggtgatccgcccacctcagcctcccaaagtgctgggattacaggcgtgagccaccaggccgggccatgggtcctcatatgttccaagtgcaaaatcttgcctcctaactcccaaccagcatccctcccattgcactgatcgttctgttttctctccgtgcagatttgctttgaggggcagtgcaggaacacctccttctttgaaactgaaggctgtgggaagaagtgcaatggccatggggtgcgtgctgggttctggcttctctgtgtcatggggacgtcatgagggcaggccctgtgggtggctgatgctctctggggtgctgatgcctctgccctttctttgctccaggtctgtaacaacaaccagaactgccactgcctgccgggctgggccccgcccttctgcaacacaccgggccacgggggcagtatcgacagtgggcctatgccccctgagagtgagtgccagcctgctggggccactgcccgcttttgtgagaagagcgggcatcaggggcaggtggcatgttgcagagcatccacattgaatcagcttcattgtcctgattttgtagagaggaaatcaggataaagacagaccaagagagaggagcgactgctcatagtgtggtgtggggacacggttcagtctctcttctcccatcctttctactgaggagggggagcccgcttagtagagtgagagtaagagagactgtaggtcattgaatgttcccattctttttaggggacacggtgactatttctctttgggcacttaaaaataatcatgaacctgggacacattatggtggtttagatttcctctgatggacacaagttaaaatggagaaccagacactcagaaaattttatagtattttagtggatctctcaaggattctagcactatgatttctaaagttttttttttaaaaaaaatagcaaataactttaaaaaaaaagcaccaaaatctttcaaggaagaaaccccaatatgtaaaactgataaaaagtagtgttttgttagtacaaatacgttctctatatttacattaaccacttgagagaatattggggtagttttgatgaaaccaaatgttaagttatggattatgggtgagatgtctagtcttaaatctgtctgagtcttttcgtttctttgttttttttttttttttgagacggagtcttgctctgtcacccaggctggagtgcagtggtgtgatctcgacttactgcaacctccgcctcccgggttcaagtgattctcctgcctcagcctcctgagtagctgagactacaggcatgtgccaccacacctagctaatttttgtgtttttagtagagacgaggtttcaccatgttggtcaggatggtcttgatctctttaccttgtgatctgctgaccgcggcctcccaaagtgctgggattacaggcatgagccactgtgcccggcccataatgtgtgtttttaattataatttgtaagttaaaataagtaatacaaattaaatgcaaatcaaatgcctgaagaagaagcacgaatacctattttgaaatctgctgtagccgagacagcttctaaatctcccacttgggttctgtttctggaaggtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcaggtatgacagggttcaatggaggactcagggtcaatttatgggtcacaaaggtctccataaatggtacttagcaaaagtgttggtgatagtgggtctaattcagggaagacaagtgcaagatacatgctgccctctcccctgctatgactgtgacaggcattactagttgatcttattgtaagtactctactgattctggtcatcactcctgagttcttctcagcagaatatccccaaccaaatcaagttgaaatataaaataaaatctatttgccatcctttgtctagttgatttattccccattttattttatttatttttgagatggagtttcactcttgttgcccaggctggaatgcagtggtgcaatcttggctcactgcagcctccgcctcctgagttcaagcgattctcctgcctcagcgtcctgagtagctggggctacaggtgcatgccaccatacccagctaattttttgtatttttagtagagacggggtttcaccatgttgaccaggctggtctcgaactcttgacctcaggtgatctgcccgctttggcctcccaaaatgctgggattacaagcatgagccaccatgcccagccccctctttgtctttttaaccactgttgctttaaagtttgtttcatctggtataagaatagctactcctgctcgcttttggtgtcccatttgaaaagtgatgtattattttggatatggaagatgtacagtctctgagtcacctattaaataacacttgttctggaggggattttaagtcccaggtctttctggatctatgcctgatggggattggttgatggctcgtgacacccttgtgtctcctcacaggggaagggtcttaaaagggtgaagagaaggtgctgagagagctctgctttgtataaggccaactctgtttccttgagagttctccattggccacacgtttttctacttaggaagatgtggttcgagaagaccaatcccactccctccagagcagacttgggaaagatttagctgcttgctggccgtgcttgggtcaaagggaactcaggcactgtcccctgctgaacatcgtcccctttcttttcctcccccatttcttgtttctagttgtcccttcagggtttctcagaacagcgggactggtcatgccaacccaactttcaagctgcagacgccccagggcaagcgaaaggtaagagctttgcaccactgaactttgctacttttcctttatccctcagggccatgctgtatttttctttttgagatggagtcttgccctgtcgcccaggctggagtacagtggcgccatctcagctcactgcaagctccgcctccagggttcacgccattctcctgcctcagcctcccaattagctgggactacaggtgcccaccaccatgcctggctaatttttgtatttttaatagagacggggtttcaccgtgttagccaggatggtctccatctcctgacctcgtgatccacccgcctcggcctcccaaaatgctgggattacaggcatgagccaccatgcccggccgccatgctgtgtttttctaagagcctctgtgggcccatgggattggtaataaaagcccttttattggctggagagacatgttatttggttctgacatcccctaatgactttaaaggttgcatctgacttctgggatcctcaggggtttaatagattggtgtgtctgttctccctttgggctctggtttatctcaaagagacacacaaggccagccctgagtgatttcttgtctcaggtgttccttgacttgtgcgtacaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggtaagtggataatcagcaaccttgggctgggaacattgcttttaaggccactttcaatgggtaatggcaaaggtggggaaggtgaaacttgtggggtcatgagctgactgccttttctgcaattcagtcaatacgggggcgcacagcaggttagagcaacgaacgtggggaaatagactctctaagaagctcctaaaccatgtggcattttctcccgggttggcctattttatgacaagccactacccaccttccaccccatattaacttctgtcagttcccccatgctcgtctgcctgctaggtctttgtaaatgctgcttgttctgcctgatacgctccttctctccttggtggggccacctcctgctcatcctcagatctgctcctagatgccgcttctcccaggaagtctatcctgattcctcaattctgaggttgatgggactgtacttctctcatcatagtactcttcctaccaaattgtacctattggtaccttctactgattggaaagtcttagggatgtatcctgatgccttgcccatcccaaggggcaggtgcctctgggaggtgagagtggggtctagactctcccccaccagccctggtgctcttggaggcatagcctgcccagcagcctgttcccactgcgtgtgtgtgctctgatggctctgaccacaccttctgcaggagatcccccagtgcagacacaggtgtttcctgggtggcggccgggtggggtgccttctggaactggcctgtgtgttttgggtgtgacccctcaactgagactgctttctctgggtgtaatccagagggctccatggaacccaagctgtctctgaccctaaggactctggggttggctgcaggctttggagggtccttgggatgtgtggcagtggtacagtttgggaaggctgagggcatccattctgtttctctgctgtgaaactgctgctctccccttccttttatgtggggcagaggtaggatggaaaaatccatgcagaaagagaggaaagattgacagggagagagaaggaaagaggaaaggaaaaaagcaagagaggggaggagtggagagagagaggtggagagtgtactcgtgtgctgagggtgctatagcagagtactgcacactgggtggcttcaaaacagacacttattttctcacagttctagaggctaagagtccaaggtcaaggtgctggaagggttgatttctgaagcctctctctgtggcttgcaggtggccgccctcttgctgtgttctcacgaggcctttcctatgcacttctgcctccctggtgtctgcctgtccaactctcctcttcttatgaggacaccagattggattaggtggcctcattctatcctaatcacctctttaaagaccttatctctaaatatggtcacattctgaggtactcagggttagggcttcagcatatgattttttttttttaaatgatgagtgcacagttcagtccctaacagagagatgaaagaaagggagaaagcaggcgtgtagagacttggggttacaggagaacaggagtgccagcagagggaggagggagtgggtcgggcgagcagtccactcagactgttgttctgaaaaacccacactagaggcatgttcagagaacacggggccagcctcacccctgtcacccctaggtgctgagccgtaggtcaggaagtgtcagggacagcggggacccagctgtctgttaagtggtggaggctgtgcataccctgcacctgcacccctgggactgctggcaggagtcccgggtgcaggaagctgcccagccagtggcaggcaccccaaaacacagcccccaagcacagcttctcctgggccccgggtcccaggtgggtgtctctctacaagcgaacagtgggaggcagctgctctgagtgggggctgctgtgatgacattgggctgccacctgcctcctcacagccattccaagaagggagttgctgcagccctcatttctcttggaggttgccaggcctcataggattgaagggacttgcccgacattgcacagttgtgagtggaggagctaggacttgaacccaggtctcatccagctgagtgagacagcctcctgccctggggccactcacagtctccagtctgccatcaaagattccccacctcctagctgggggacatggaccccctggagaagtgatagatgaaacctcatcacttcttcagttctgctattctaaaccggcttatgcacctgcactctgggccaggcaatgacgaggaaggcagatggcagctttgcctccaggagctcacattctgctggggcagtgactctgggatatgtgtcactgcaacagtgatatgtgctgtgaaggagaggctcagggtgctcagaagagagtaacgaggatttgacctaatctgggaaatccaggaaggtttccctgaggtggtgacatttgagctgagacatgaaggaggaacaggacttaaccaggctgtgagggcaagtgatgaaggagctttcctggtcccaggacccactagtagggaggctctgtcatgggagagggccctgtggattgaaggaacttaaaggtttgtgtgcttgggtcccaaggagctatgagatgaggctggaaagccaggaggagcccgtctatgcccaggccacatagccttggtcaggactttggtctgtattccataggaagaggacagtggtgacatgatgcaattttctgttgacaaggattgatcactctttgggatatctttaggcaggagagaggtgtagttcctgcaaggggcccatagatgcttctgaagctgttaatctactgtttgacctgcatggggattacttagtgtattcacgttgtgataattcatctagttgtatatttatgatttgttcgcctttttctgtgtgtattatatttgaatttttaaaatagttttaaaaaatgaaagtcactctagaagcaaatgggtgtcctagttagaagatttaaaggttgtcctgaagaaagatggtaaaagcttggagcagggagtaggcagggctgatgaagtgaagctgatgagaaatgtgcagaagagaaaatagataacgagttgaagatccattgcttggcaggggatgacgccccgtgtcaggcttgtgcaatctgattgagtaagatgccatcccttgtggaagggagcatgggccagagtagctgagggactgtttctgctctagaaaaaggaaaacagtgctgggcgagggccctggtagggctgagttggatcatcgcagatgtggcctgtggctggttgccctgggaggcccagtgctgacatgctgatgaggctcctgcccaaactccagcccctcagtggctcatttgcacagctcccttgggagcacagcctttcccagttgcaacctgacatctgcacccagctgtcacctgccccagaaggtctctatcctggcttccagcaaccattgcaacttggcagctattctgagctggggaaggtggtggtgaagggggcgggttgtattgtccttctagatagagctgaagaacatggctttttggccttaagaatttgctttagtttctgattccatgaagcttcttggggaaaatctcggctctttgtgttattcctgccctctctatgtgcttgccttttgtccactttaatacgtggtagtgaccctctcgagaagggaaggaagtcaaggggagcaggcactggaactcccttctatgcagttggcttccccttaaaccccaacagcttgggggcctgcgggtgggacagtcattctttgccccttaaaaaacaatggatcaactaatacgtgttgagcacctactgtatactaggcactgttctggaagccaaagatgtatcagtgaaccaaacagatacggaccccacactgcttccactctagaggggaatggagagacacaaagtaaaaatcaactggataagtaaataaattatatatgttgtaaggcagtaagtgatatgaaaagaaaagaagaggtatattaggataaaaaggtcagggaatgtcagggtgggggctgttgtaattttaaataaggtagtcagggcaaagccttgtggagatggtgagaacatgaaggtaatagtaacacaggaaggacagaatccatgaaatgtgccacacacatggacaaccaacatgaacaaaatatagctgctgctttgtttaaattttgttttaatcttaacaggcaatacacgtacatgctcttgttaaaaaaaaaaaaaaaggaatgttcaagggctgggcgtggtggctcacacgtgtaatcccagcactttgggaggccaaggcaggcagatcacctgaggtcagagttcgagattggcctgaccaacatggcgaaaccccgtctctactaaaaatacaaaaattagctgggcatggtggtgggtgcctgtaatcccaactactcaggaggctgaggcaagagaatcgtttgaactccggaggcagaggttgcagtaagccgagatcatgccattacactccagcctgggggacagagcaagactccatctcaaaaaaaaaaaaaatggaatgttcacctggaacacacccctccccttttgcaccccatcccagtgtaatctctttggtctgtatccttccttttttctgttacagacatttctattaggcggtgagcgtgctgacttattttatgtcaactatcctctacagcttgtttgttccacctaacaactcttgaacatctccccacgccagcccctatcaacctacttcattctttttaagtgctatatcatctgtcactttataattttagttatttttctgctgatgaaattttgcttatttatagtttctttgctgttacaaacagtgctgcaaggaacaaccttgcagtttcatttttgtgcacgtgtgcaaatagttctctaacataggtcagaagaagtagaattactagatcagagaacagttatttgtaattttttttattatactttaagttctggggtacatgtgcagaatgtgcagatttgttacataggtatacacatgccatggtggtttactgcacccatcaacccgtcatctacattaggcatttctcctaatgctatccctcccctagccccccaccacccaacaggccccagtatgtaatgttcccctccctgtgtccatgtgttctcatttcatgttcatctcccacttatgagtgagaacatgtggtgtttggttttctgttcttgtgttattttgctgagaatgatagtttccagcgtcatccatgtccctgcaaaggacatgaactcatccttttttatggctgcatagtattccatggtgtatatgtgccacattttcttgattcagtctatcattgatgggcatttgggttggttccaagtctttgctgttgtgaatagtgccacaataaacatacgtgtacatgtgtctttatagtagaatgatttataatcctttgggtatatatccagtagtgggattgctgggtcaaatggtatttctagttctagatcctccctatttaataatggtgctgggaaaactgtctagccatatgcagaaagctgaaactggatcccttccttacaccttatacaaaaattaactcaagatggattaaagacttaaactaagacctaaaaccataaaaaccctagaagaaaacctaggcaataccattcaggacataggcatgggcaaagacttcatgactaaaacaccaaaagcaatggcaacaaaagccaaaattgacaaatgggatctgattgaactaaagagcttctgcacagcaaaagaaactatcatcagagtgaacaggcaacctacagaatgggagaagatttttgcaatctatccatctgacagagggctaatatccccaatctacaaagaacttaaacagatttacaagaaaaaatcaaacaaccctatcaaaaagtgggtgaaagatatgaacagacacttctcaaaagaagacatttatgcagccaacaaacatatgaaaaaaagatcatcttcactggttatttgtaattttaatagatactgccagcttgctctcctgacttcctcttgagaatataaacacattatacatacagtttctttctaaatgggaccatacagtatataacttttatctatctgattttaacctgtaagatatcagggatattttctttcaaacaggcctctggccttcaagtgaggcttattgctttctctccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactatggactgtgctgctgccttagcagggaagggaagagggaggggtggctggtcagcttgagataggggcacctaccacaccccttcctgcagggctgatggtctgggtgagtggacacatggatggacttcacaagaagcctttgttctcagtgggtggtccatccttccttctaaaatcgggaggatggctgcccccttgatcccattgatcagcatcaagctgatgtctctctccctcccttctttttcttcccagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtt

SEQ ID NO: 37315 - DNA, 12950 bp, Homo sapiens
aaagagagattgttattattcctcacgatgacccgacagtctctgctttctttttcctttcttccagaaggagatttaaccatagtagaaagaatggagaactattaactgcctttcttctgtgggctgtgattttcagaggggaatgctaagaggtgagtgggggaagtcgattagagcctggttcacaatgcctgggaggacaggggctgaatcgctgagagtggtgagtgggcatgcagggagagtactcacccagagaaaggggtgtgtgcctgagggggtgcgcacgcacacatgtggacacatggaaaggggagaagtagtgcaaagaataaagacctgcagagtttgggatttggtgaagaaatagtctaattgcatgttcttaagaacgtattgtagtcagaaaagggcaaacaatctttaaaatctgttctggacaactcaaggcatctattctaagagattctaaaaagaggtgtcctttatagattcatatgtaaatttgttcattacagaagtattaaaaatgtagaaaaacctgaaccagcatacatatacaacaggcgggggatagacaaacaatgcatggttcaatcataaaagagatttccatgcagcctttaggaatcgtgtttttaatgaagggcaattatttataattttagcaatgttagatccatacattaaaccttgttttaaaatcttttaggaacagtatgtgtttttccttttattcatcatttcccccaaacctaacgaatgctatccaatggatacaatctatttcattgtatgaatgtacaatttttttgtttgttttgagatgcagtcttgctctatcacccaggctggagtgcagtggcatgttctcggcttactgcagcctctgcttcctgggttccagtgattctcctgcctcagtctcctgggtagctgagattacaggtgcacgccaccacacccagctagtttttgtatttttagtagattcggagtttcgccatattgtctaggctggtctcaaactcctgacctcaggtgatctgcccacctcagcctcccaaagagctgggattacaggcgtgagccaccacacccagcctttaaaattatttttaaacacttccctagtttggactatttctcttttctgcatttggctattgtagattttactgtattgagcagcctaaaacataaatttttgtcttagttcctgattttcttttttctgcaacactaattcctacaagtggaacatttgggtcaaagcacacaccttttttttttcttttaatagccattccttagcaaagcatataactttttttaaggccctttatatatatatggtcaaaatacttccagaaatatttaccttttcactaccaaagtatatgactactactatagatattttattttatttattgattgatttgtagagatggggtttcattatgttgaccaggctggtcttgaattcctgggctccagggatcctcccatctcaacttcccaaattgcaaggattacaggcatgaaccactacttaaacttgtattcctttatgctttttttcatttgcaatattgactataatcaggaaaaaaaatatatcctttatgaagaagaaaaacttatgtctcattctaaggacagcagagaaattgttaactcagggaaaatgataataaaaatgataccccctctatagcaacataaagagcagtttcgaggagcaaaagatgtggtgaaatgcattgtttactctgggtgggtgcaagatccaggcaggggtgaagcatggccggctgcacagatctctgttctcttgtttcctttacatccctccccacctccctctgcagatcttgttctcagaggccattcccagacccacagcaagagggattatggctgcaggcctcatgctcctttgttttggaagaaactgttgaggagttagtatttactgagcagctaatatgttcccgtcactattgtaactcataataattattgttaagtaatacacgaaaagttttaaatttaaagcattccaatattttaaaagtaaagggaacaaaaggccaagtgtcccttcactcactaacctctgatcttcagattagcatgcgtcttttttgagtttttcaggcatttacataaatagttatgcagaaatggatagctttgcttctgttcttcaattgaatctttagtatagttgtgcaaggtgttttttgatcacttagtgtgtctccgttatctaggttcatgacaacaaatcaactctttttacctgctgcattgaattccctccgagggatgagccgtcattcctctaagcagtctcctgatgggtggctggttcagttggttaccatttttatactttaaaaatagtgctgcagtgtcattctcacagaggcttctgtctgcacccatgcaagtactttgctcgacttgacatcaggaagtggaactgctgggccaactgtgcaattctaaatttcacacttcatgatattgtataagtaaataaagttgcaatggttttgtcccatgtctgagaccaaagagcttgtgaatcttagagcctttacttattgcttaccctctttgtgtccctaacccttatatcatgggcctggccccttgtgggtgcttggtaaatatttgttgaatgactttatgaagggaagaaagaaaaggtaagtaaggcctggtcttatttgcagctctgtgatcactagccttggattaaatgtggtgggttcagcccctgactgacttcaggtcccccaccaagcagtcttccttaatcctaccaggagtccactaggccatgagttgaccatggtgatggccaagagttggggctttgaggagtccacagtgtgggacacccacagcggtcgaccccggtggaaccagggagcccagtgaagagtgtcctgcatgaatcagagggggattgtggtgggttggacttggcaggggaagtttggggaagtcataggattctgaatattgttaaacagtacagtgaggattttctgatcgaataacagatgtgcatttcacatagacatgtttttacaggtgattttcaatgttgggactcaaaggtgaagacactgaaggacagaatttttggcagaggaaagatcttcttcggtcaccatacttgagttagctctagggaagtggaggtttccatttggaattctatagcttcttccaggtcatagtgtctgccccccaccttccagtatctcctgatatgcagcatgaatgaaaatggcaagtttcctggccttccttctgctcaactttcgtgtctgcctccttttgcttcagctgctcatgcctcactcaggtagggaacaattccacgcttgtttctgaagcagacaattacctaattatgtcctcataggacttttgactccttcccaaacctgaagtccatcccgatctgaaggttcacccgtcactaagagacaaatggtgcttctgttaagatcagtttcccccaccagtttctttgtatctcgccttccctgtctgagaagcacccttcctctcatgaccccaactccaaaaccctctgacagatcctcccccttgtgcctacagctcagttttctgtgcttggaccctctgggcccatcctggccatggtgggtgaagacgctgatctgccctgtcacctgttcccgaccatgagtgcagagaccatggagctgaagtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcaggtgagcctccaggttttgttctgagaacatttctctgtaggatctagagcagatgcagagtccctcttgcaaaagcactgcagacactcctggctgctcactagcaattgcctgcactgcctcccaacttagcttctctgaggcccttgagtaagacacaggttttcctttaggaagaattcctgctgtaccctacatgctcaagtaaagaactcctttcctctggccaccagagatataagggaagtgaaggacaagggatagaaagcataagaaatcatctcttcagtgactagtacacagtcattcgtgtttagttctgtactggatggcttctgtggctccactaggtacatgctattgtgggccctagaagactgggctatctggactgtatctgctgccaatgttcttgagccaatgaccctagaatacacctgtagtcatgggagctgtgtttcttacttgttgcagtgaggaagaacacatatcatggggagctgtggtggagtctcagtaagaagctgttagagcagacttagtatataatttgggcttgtgttaggggatttgggaggagggtttatagactttggcctctgctctggatgagacactgctaggaaggtgtgggcaggttaattctatgagtgagaaccttaatcaatcttatctaggaagaaagagaccagggtgagactaaagctgtaattgatgaagggacagcaatccctcattgctgatgggggttgtttggtcactgctgtggtttggacaatgttcatgtttttctctgtgctcacacatgatgtggggtggtcttgtttttcccatgatccatcatagtcacaaagtgccatcatctgatgctggtgttctgtgaaattgcttttgttcaacaggaggacactgagtcctgttgctgcttccagataaagggactgctcttttctttcttagtgcaatgcttttccctgtggcttctgtttaagggtttggtcagcagggatctgtagcagacgatgaagggagggagagaaaagagagatctgggtgcttagtccctggcttccttcctgcaagttaccctcaggctggctgcattgccttgctgaaggtcattgcccctctcaagaaagtccttaatgcataaatctcttcttttgtgtcttcaaaacagctccctctcctcctccctctggtaactgtggtgggtgggaatagccccactgttactgaccctgggatactgcactcattcatgtagctttctcctcactaggaccacacttttgtaagcagctctaaaatgaaattgttcttgaattatggaatgtgagtgtgccatgattccttttgagaccctctctgatacaggcctctcaagaatttaggctaattcatccttccacagcactgggttctgatcttcacgttgatgtgaagggttacaaggatggagggatccatctggagtgcaggtccactggctggtacccccaaccccaaatacagtggagcaacaacaagggagagaacatcccgactgtggaagcacctgtggttgcagacggagtgggcctgtatgcagtagcagcatctgtgatcatgagaggcagctctggggagggtgtatcctgtaccatcagaagttccctcctcggcctggaaaagacagccagcatttccatcgcaggtcagtacctgcttggcctcaggttttctgagctgggctgtggcagttgaatgaagggggaggtgttagtgtctgcagtcaacctgggtctctgcactgaatataaggcccaaagcacagacctggaggctcctccttgcaccgggggagcttctcttctccataaagctgttcatgacgcaaacatttactgaacatttcctgtctgccagaagtataacagtaattggaattaggggataattgttaagataagctgcgtatgtaaagtcaaatgacaaaaggggaaagcatatatatatatatacaaactcatagagaaagagccaatctccttgagacagaagattttaaaaactgagtaaaaaattttaacaaaggtcataaattatttaatttacagaaaaggaaataactcacaaaagagtgttcgttctcattcattagagaaacatactgaatcatttttcacttatggtattggcaaaaatcaaaacaaacatctgttggttgataacacatggttatggcaggaatgtaggaaggctgtgactcctaggcatctgctgggatgacttgtatttttggtgtgcattagcacaacctctgttgggggctatataacaatatctatccaaactacatctttagtgatccaaaattccgcttctgggaatttatttggtagataagcttgcatttgtatgagatgatccatgtaaaaagttattttttatagcactgattatgactgcacaaggttggaaactatgcagatgttcactgctggagaactttcatgcaatggataccactcaactgtgaaagaaaaaagagataattctctctatagtgaagtggaaaaacctccaagattaactttgcacagaaagagcaaaatgcagagtggtgtgtatggaatgctatctttagtgcaaataagaggaaaaacaagaatatatttttatttacatttttttaagttaacaagtaatgtcataacactcactaggtgtcaggcactttataagtattaatttaatccttctaacttcaggagaagggcagtaggaacagagaggttaagtaattagtctaaagtcacactgcaagtcacctaaaggagccagcattgacacccagggcctccagctccaaagttcctgttcttaagcatcatattaagcagactaatttgaagttaagaaagggagggtgggagggaggactgggtggatgggagacttacgtgactttttatacatgtattttagaaccatgtacatgtgttacctattaaaaagttgaattagaaaaaaatatgtttgatatcctcaagtcactcactttccacatgagaggcagacgtctcaagagaagtaatagtagcagcctctagtgggggtttatcaaagtcttacccactgtcctctgagattttagcatgagaaagattatttaacctcatgagatagattccgtgccctgtgacctggggtgagcagctaacacttggggcgctgcagtctggggaggctgagtgcaccggcccccatgacccacagccgttgccttcacagaccccttcttcaggagcgcccagaggtggatcgccgccctggcagggaccctgcctgtcttgctgctgcttcttgggggagccggttacttcctgtggcaacagcaggaggaaaaaaagactcagttcagaaagaaaaagagagagcaagagttgagagaaatggcatggagcacaatgaagcaagaacaaagcacaagaggtagctgaccttgggagtttatctgagcccctggcttacgggccaaagcccaaagacctcacgcccatccccaccgcagagctcagttgcttttaaggttaattttttagaaaaccccctcacctgtaacagttcattattatttctgcttattttccagtgaagctcctggaggaactcagtaagttcccattcccccagagacccaggcatgtcttcctgtccctgctttatgcgccttgatgcatcttcccctgttccttccgttgcaggatggagaagtatccagtatgcatctcgtaagtgcctctgacattttctctgaatttgaatctataactgtctgtgcttgaatagtttccactcttaactctttccccaaggttgggaagtggtcttagatccctttgactaaggaaagaaaatagatgtgccaattcctagtcattgccaaaaagaaaaaaaaaaaaaggaaagagaagaaaggaaaaaagaaagagtgtggctgattggagtaacacccaggaggagtgtttctttctccctctctttctctttctcagctggtctcgaagaaaagatgccttcaatttatctctaccaggggccacagactctatagccctgcaaagcactgaggaatatccaggggcacatttgtaaaggaagggggaagaggtagatgaagtgcattctctatggcaggaacttcactagtcattttacataatctataggctccagagaagaaaaagaataaaagataataaagaacaagaaaatctgaaaagagagagggagaaaagtgtgtctaataaacaaaagtggcctgaacagtcgctcagttggtaccaatttattctaactgacttcaaacactagtccctgaaattgctcattaaatttcccaaattcttttcagagtaaggtacgaaattagattgatatagaaggatcttgcaaacacacacacacacatacacacatttaaatatatatatacacatatatacatatatacacatatatatgtgcatatatatgtatatatatatgtgtatatatatatgtgcatatagacatggagacacctatgcccaggtacaggtatatagatacattccaaatagatcagctgaacaccatcaggaaggaactctcgcaatgtctgccatgtcactagcattcgactgatgttcctggatttgatactaagaacaacacaatagaaagaattgaacctgcagaggaggaagatacaggtggtaaaaaaaaaaaaaaaaaaaaaaagattagatggatgtaaagttaagggaatggggccaaatcaaaaatggcaagttcaggtgacatctctatctttttttcattgtagggggagagagacattcagcctataatggtgagtgaacctgatgctctctgagtttgctgggacacgtgccatgaacatttcaaccttttctctgctgtgacccattgatgttctcatttgcatgaatcagatttaacccaaagactcaatttgtgtgttgtggggggttgatttctgcttttctggagaatcagagagactcctgaccctgcacacccccttgcaaagcctggccttgcagcctgtacccttcattgcagagggaacagagctcaccatttttgagaaggtaccacccctgatccatcagagctgtagaagagggaggctggaccctggaagagactctgaagaaaaggagagaaaacatgtagtgaggggagagtgcagtggggaaaagtacaagaatactgaccttttccttatctgtgtctccttcctttcagaatggaaaaaggccctcttcaagcctggtgagtaaatcactgtgtgttccctggaccaacaacctgagggactatattcctttttcctttttacttctccaactgttgtgatttggggaagaaaagctcccatgactaggagaatttggggtaggcaacattaaattccaatctgaaaagtgggcccatctccaagaccctttctgctgagagcccagggaaccagggcgaatagatctcttgcacttcctcagaccttcctgggaaggaagacatataaagggtggatctgaggggaaggagacacacactgagtaatactgcagggagagtgaggatggaaatgccaaggaaaggaggcgatgcctgcccaaagaacttagtccttcccagacttctcatgccacctactgtcagtgccttctcaaaaaaacttaatgcttctgagctttggcctccacatatttaggtgatgatttcaatctgtgtttgtgggggttgaggtgaagactgaaggaataataaatatccattggtcaaaaaccttaagaaggagatgatgagttcaaactgcgtggttgaaggtttgcagaaaggagggttaagggaaagcaacaaggaaaagtgcagtgcccccatggttcccaacagtggggagctgtctccactcctacactgggacggctagggaggggaggcagttactggaacccagaataagaagtagctcaaagagagggctccctgagaagagtcttcaggccttgttagagcagcagcagctgctgctggcagggaggaagcaggaaattaaacggtgtgtctctcctttctttctccttccaatctcctatcagggcctcccattggccaaacccaacagcaaaccagaggacaagggagcccagtggcactgtctcaggaatctgcccagaggacagattcctggggcccagaagagggtggagaaagctgaagggtggagagtgaatctagggcatataaggcaccacatagagcccagcacagagacggccttgcagctatcaggaagatgaggagcttccttcatggcctgctgtgggctgagtaaataacatgattgccttctacagcgctagagattcatttgtttatccccatttttcaggtgaggaaatgcttcagatgaggctccactttgttaaataaattggatgtatggaaaaatagactgcagaaaaggggaactcatttagctcatgagtggtcgaatgaaggttgaaaattaacctctgagtataaagcattagtgggcagagtgaatatggggagggaaacaagaaaaacgtagaaaggatccttgctgcttcctgaggccgcgtcagggtattgggttaggcagagatgctgaggcaaccctcatttcaccctcctcttcccctctggacacaagatacctgatacctggggctttctctcctgacatcgatgagagagtcacatttagggcagactagggacaccaggctttggactcagacctcctcagcatggcccaggccttgcatgctgaggctctgaaatccaggaaaaatggttgacctcatggacacttcctcaaactctctgcagcggatgtgattctggatccaaaaacagcaaaccccatcctccttgtttctgaggaccagaggagtgtgcagcgtgccaaggagccccaggatctgccagacaaccctgagagatttaattggcattattgtgttctcggctgtgagagcttcatatcagggagacattactgggaggtggaggtaggggacaggaaagagtggcatataggggtgtgcagtaagaatgtgcagagaaaaggctgggtcaaaatgacacctgagaatggattctggactatggggctgactgatgggaataagtatcggactctaactgagcccagaaccaacctgaaacttcctaagccccctaagaaagtgggggtcttcctggactatgagactggagatatctcattctacaatgctgtggatggatcgcatattcatactttcctggacgtctccttctctgaggctctatatcctgttttcagaattttgaccttggagcccacggccctgactatttgtccagcgtgaaaagaagaagagagttcctccaattctgaccgagtgctgatcattccctagagacaccagtaaccccgggcttagctaacgaaagtggggagcctcaggctgaagtaacttttctctgcttctccctgcccagctcagagctgagggcctccccctccacagcaaccaatcacaaccataaagctacaagcacgcactgaagcactttactgatactcattcaattattcatatgacagttgtttgagtttggtaccatcttattttccccttatacagataaggaaactggggtgcagaaaagtgaattgactacaaagtagacatgactagttaacaacacagctgggatctaaacagcaataactaacattaatggagaacttaaaatgctctgagtgctgtgttatgagctttggtggatgtcactcctttaatcctcgcaacaccctgtcgggtagtctcatttagcaagtatggaagttgaggcagggcaacattaagcaacttacataactcatgcagtaatttctgcagttgggagatgttcagcttcagtccccggccctatggccgttcttttccaccctgtttcttcccccataggaagaacccacctgtagccctgaggttcttttcccaggatggctccaggataaggatcactgtaggtggttgtggagttgacacccctgttgactccttcccagctgattgtcagagccttagacccagcacgccttggattagctctgcagagtgtcttggttgagagaataacctcaccgtacccacatgacacgtgatttggaaagagactagaggccacacttgataaatcatggggaacagatgtgttccacccaacaaatgtgataagtgatcatgcagccagagccagccttccttcaatcaaggtttccaggcagagcaaataccctagagattctctgtgatataggaaatttggatgaagggagctagaagaaatacagggatttttttttttttttaagatggagtcttactctgttgctaggctggagtgcagtggtgcgatctcagctccctgcaacctccacctcctgggttcaaacaattctcctgcctcagcctcccgagtactgggaatataggtgcacgccaccacacccaacaaatttttgtacttttagtacagatgagggttcactatgttggccaggatggtctcgatctcttgacctcatgatccacccacctcggtctcccaaagtgctgggattacaggcttgagccaccgggtgaccggcttacagggatatttttaatcccgttatggactctgtctccaggagaggggtctatccacccctgctcattggtggatgttaaaccaatattcctttcaactgctgcctgctagggaaaaactactcctcattatcatcattattattgctctccactgtatcccctctacctggcatgtgcttgtcaagttctagttgttcaataaatttgttaataatgctg

SEQ ID NO: 37316 - DNA, 2093 bp, Homo sapiens; identical to SEQ ID NO: 37018

SEQ ID NO: 37317 - DNA, 2157 bp, Homo sapiens
acagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggtgggtcccggcgccctggggtccccgggccggacgcggctggggtgggcgccccgcgccgacagccccgctcaatcagcgagtctcttcttccctaggagcgcccctggccactgaactgcgctgccagtgcttgcagaccctgcagggaattcacctcaagaacatccaaagtgtgaaggtgaagtcccccggaccccactgcgcccaaaccgaagtcatgtaagtctcgcccatcgctgccgctgccactgctggggtccccgactctcccgctgccccaaaccctgtcctcagcccgacctcctgtctcacgagattcccttctctctgcagagccacactcaagaatgggcagaaagcttgtctcaaccccgcatcgcccatggttaagaaaatcatcgaaaagatgctgaaaaagtaagttataatttccatgtacacaggcgactggagctgttggtcagaaatactggcgtctgccccctaaaaagtaaatcaggaaaacccagggttagctgcaggactgaaaaaattattattttcacaaagttgccattaaggttattaatctgttctggtgccagaggatattcccagtgcccagggtcaccacccaggttcttccctcctgccagtgaatgtaggtaaaactgctttcatgtaaggtctcattggagtttgccagttgtgctgaagtgttttccacctgttaaaaaacacaagcttcatttcccctagttcctactgactttcagacctgaaaagcagaccccctggttttttgtaaaagtttagggttgaagtgcagagatttcacaataatattgcactgggtatataactggttgccaccacctattagccatgtcactcagagacaatattatttagtttatctgagactcagcaaaacagggaaaataatggtagctacatcatgaggttgctttgaggctcaagtgaggcccagtatgacaaagagcaataggctctggctgttttagccagtaaaacagtgtagactgccactcctccaccccacgtcacccccattcctaaaagagcatcccaagcctagaggtccttgccacacagcacagctgtcacaggcagtacccacttgggtgccaggctggggaaactgcattcagaaaactctagagcctggggaaacaggacaggagaagactgttgtgcagtcagctttcctgagcacctactcagggcacccattttctcattacagtggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtgagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaatat

SEQ ID NO: 37318 - DNA, 27086 bp, Homo sapiens
ctcatgcatatgcaggtgcgcgggtgacgaatgggcgagcgagctgtcagtctcgttccgaacttgttggctgcggtgccgggagcgcgggcgcgcagagccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccgcggcgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggtgagcggggcggcgggggcggcgggggtcgcggacggggcacaccgggccgcccctaggggccgggcgggcactgcctggggccgccgtggttcggaagccctcgaggctgcgcgcggcggctggggctccgggcgggcgcggctgggtgggggcggggcggcggggcctgttcccccacccctggcgcccggcccgccgaccccggcccgcgcctccctccgctctcccgctgccttatttttaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccggtacgtgcgctccatccctcgtgctccagcccttccctctctctccgcgccccggccccgcgcgcttcgcgacccccaacacctgcggccgggtctgcgtgcgagccgcgcgcgcccaggcggggcggggccggcagggggcgcgtgctctggggacttggtccgcgcctggccacgtgggcgcgccggggccccggggccaccgggagcggggtcgcggcgggggcggggcggcggcgtcccgcgtgcgcggcggtgtgcggcgtgtgcctgcgtcgccctgcgcgtgtctgtctgggtggggaggcgaggcgaggcgccccggtcccgggcaggccgcggtggcatgtgcgcagcgcgtgctggggctggtctagggcaggccctgactgagccgccccgggcccgtggccagcctgcgcctgccctgcagtttcctggatgcctggggggcacgggcgggcgccgtgggacctaggcccgggagagcctaacgcctaacgcttatgtcggcagaagcccccgatggtgacccaagatcgttcagagacagagatagtggatcctggtgcagtgaccttctgtggcactgccctgtttgtgggtttttttggttttgttattctggaggggcagaagctgagtcggggctgtctggtctcccctggcaggtggccagtcaggcaggagccctggcctgggcgtgctgggaggaggggtggtaggggtccagtgtcactgggaaacaggtactcatcccagtgggctggcaggtgggtagtggtaggtgggcaggcccaggcctcgggcgccttacctcattgcctggagcacggccttgccctggtgcccagaggtccttccctgcttggtcattgtgctgggggcctggaactgggtgagtgcgggaatgagagcaccatgcagacctgtgatcagggagtagatggatctgggagccaggaagtggctccagtcagcaggaggcaccggagtgtgcccacctggtatcctgggccctgaagtgattgtgagttgagggcaatccctgccgagctcacgccagttgggcctgccgtgtgtggctcccagtcctgtgctgtacctttgcagccctggctggcagccttgcctgctgcccccatcctcaccgcttcctgagctcccacccgtggaagctggccacagtctcctctggccatgtcctcaacccgtgagcaccccgccgagtatcccttgaccaggggggccccagagaggggaaagtgtcccccagatggaaaaggcaggggcgggcatgggagggcccaggcagttgtgagaagcccagcccctcgcccccacggcggtgcagcaggcaggtctgagcagggcccgcagcctgtcatctgcacctgggcctgagccagcgtggccccacatcgctacctgaggatgtgttttctgctcgagttggcagcagtgggtgtgggggcagggaggtcttggaggaatgtggcgggctatcgcgtgtccgccctggctcttcgccccgcgggccagccggtcaggtgtgggatgggaccgggtaggcccttgccttccttggagtccgggcactgggtttcggggccagctcacctccctgcctcttgcttccagccggttcctcgaatgccccaggagggggcaggcggcctgtctctgggttgggggccagggcagagtcatagctgcgtgtttgggggcagccctggtctcctgccatgtggcctggctgccgggcgggagctgtgccgtgatgccagcaccctggtatttgcactcgggcggcggcagtccctggccatgctgccctggcttgctgaggtccagctctgtgcggtgagctgaggtgtacttggctgtgatgggaaggcaaggaccgagttcaggctccctgggacctgaggaggggtttcagcctggaggctagggtggcatcctgcccaggcccgtggggcttttgggctccttggagtaaagggaatgagagggccttgtggaagaggagtgggggagtctgggctctgcattcgctccctccaccccctgccccctgagtgactctcccaccttgtggtctctgctgttgacccaggcctggctgggtggccctctgccccctggcctggcttcttgtggccggggtctgtgtgctattagtcatggatctgtgctggtctcgggctcagcttccctcagtgggtgggcccagggtcttgaatgtggagaggtggtggaccacatgccagcaggctgcctggctgcccctcctctcctggctccacccccagacgtccccaggaggccggtgtcagcctgggttggttctggtgcctggcttgtagctggcagggtgaggccacattctcccagctgcgtgtgtgcacgcaccccgggtgctctgtaggcatggcaggtggtgatggaggtttggggaggagtagtgtcatgctgggggcagcagggagctttgctctggggcctggtaggtggcaggcccaggggacacctgctggctgagggaggagcagggtggtggcagttggccgtgacctgggcagccagggccccaccctcagaggtgcagctggaagtcgtgcctgcctggctggcccatctctggagccaggagcccaggagcctgcctgccagcgagggtctttcttgttctgtcttggcatgtgtgtgctgggctccagggcagctgtgcggggtggtgtggctggagcatggtccccgtgacagatctgggcttatgaggagaacgggatgggtgaaggccctgtagatacaggaggtgggcctggggctgaccctgcgtctatcagctcaggaggcctgaggtcctgggccatcagaagggctgagcttttctcacctgtgaaaggggcacactgccgctttttcattgcaggtctcacgaagtcagatggggctgctggactcccagctcgggctctgcttgtgcccccagcccggctcccagacctgtccagttcctccccttcccagccttccctaccctctcctttgccccctagggaggaaggtttttacagagcccaccccctgcatccagccgccctagggctcaaggtgggccaggctgaggtctgtgcctggagctacctaagctgctcgtggcaggtgtgaggttcagcaccactctgcttcctgttttttctgagcttgggctggggatgacagggccctggcctccccaccctaccttcaggggatcctgtctgcacactggggaccacccccctccttcccacaccttcccagtagggaccaggagagctggctggtctggtatggaatgtgggcatctgggttcctgtgttgggtgggcatcggtctgttcctcctgccatggccctggggcccagagccctggggagaactcagggcatgtccgccttgtacattgggggtctggttcaaagctttggtatgggggcagggtggggcattcagtgcccaggcaacacggggaccattggagccagggaggactgcccttggccagggaggattggagagtgggctgggggtttgtcgctggtccctgagggtgggctgaagggtcaaagccgcagcacgataggaaggctgggaggtggaggggcgggttggggagcaggcggcaggcctgggtgggaggggactgctgctctcaggggccctcctgggctgctccatggtgtctttatgaggggagcaagctaggccagtgaaggggtgcttgtggagccaggcttcggcctgagctgctgctggtggtggagtgggggcaggaagacaaggatctgcaatcccaggccccagccacagtcgctatccccagaccccaggcctgagcggggtccctgtccccagaccctaggcctgattggagtccctgtccctagaccccaggcctgagtggggcccctatcctcaggccccaggcctgagctgggtccctgtccccaggtcccaggactgagcagggtccctgtctgcagacctgaggcctaagcagggtccctgtccccagaccccagatctgagtgaggtcactgtccccagaccacaggcctgagcggagtccctgtcctcaagaccacaggcctgagcggaggccctgtccccagaccacaggcctgagcggagtccctgtccccagaccacaggcctgagcgggattcctatccccacatcccaggcctgagcagggtgtggctggcatcagttgtaccctgggctttgtggcaggtgctagccggccctggctgccaccgtcttcacggtgggggacctgggacctagagggggtgtgctggggagtgggggtacacccaggcaaggccctggctggtctctggtgtggagcatgggtgtgtgtgttcctgcgtgggatgggctttggtctgctcctcctgctgcggccctggggcccagagccctggggatggtgtttgcccccaccccttcttccctgcctcgggtgacaatggtggcagaggcctgggcctctcagaagctcaggtttcaggaaatgtatctgtgcttggagctcctggcgcctgcaccaagcgctgtgctccgtagggggcgggaggctgatgcgggaggccgaggagaagaaaccaagtcggggcgttggtggggcagcaggtctaggaggctgtgttgtgttggcctggaccgtgcagggccctggacctgggggggccgttagcggggcagcagggaggctgtgttggccttgaccgtgcagggccctagacttgggttgcctgagttttgggatgctgtagattggggtacagtgggcagtggggtgccgtggacttagggtgcttggcatttggagtaccctgggccatgaggtgtgctgggccatgcagtgccctgggctgggggtgccctggacctggagtgccctgagctttggggtgccctggactgtgggtacactgggccatggggtgcacaaggctgtggggtgtactggatctagggtgccctgggcaggagggtactctgtactttgggtgccttggacctgaggtgtcctgggctttaaggtgccctggaccttggggtgtgctgggccatgcagtgctttggggctctggggtaccctgggctttggggtgccctggaactggggtgccctgggtcttggagtatgctgggccatgcagtgccctgggctgtgggatactctgggctttggggtgccctggacctggggtaccctgggctttgaggtgccctggcctggggtggaacatctattgtcttgtctgcctgtcctctggcttgtgccactgctgttgcccctgcctggggacaggaggaggggtttagacttagccttgagggttcgggctggggaggaggcaatcagatggtgggagatgaagttgggctgcgggtctgcttgtgcggtgggggtgggtcaggccgggcttgtagggagaggcttagctgggcctgcaggggtgaagcccttcccccttggcctccagagactgggcaggggcatagccctgctaggctggccttgagggagggcctgggttcctctccctgcttgccggggaacctgggcaggtgatgggtctctcacctgtccccagacccccagcccacacatcgcctattgcccctgccagcgccaggcccacatccccacatgtcccagccccgttcctagaagggcaacatgcccgccaacccccgcccaatccaggccctatagtccctcctgtgttctaggggtttggtgttgacaaaaccctgtcccagatcgtggcccgccaggcaggaaggacaggggtgagaggttgctattcgcagaggaggcaactgagtcctggaaggacaggggtgagaggttgctattcgcagaggaggcaactgagtcctggaaggacagggatgagaggttgctattcgcagaggaggcaactgagtcctggaaggacgggggtgagaggttgttattcacagaagaggcaaataagtcctggaggctggcccctagggaagaaggggagctgggagagctggcaggtggggtgaggcaggtaccgccccgtcagccagctcaggttcactctggatgacttcctgccatccaggtgtagggaccccagctggcgggcggtgaggccctctcggcgggcgggcaggcacacgtccctgcgggagcaggtaaccggagccctgggctcaggcgaaggtggcagtaatcttacctgagtggctggcatgaggtttcctgggagtcgagaggaactccctgctggccctgaagcccaggtgtggctgtgccgggagaccgggtggcctggcttttctctgcctgccccgtggccagagctgctctcagacccatgctggccccatcctctgacctcactattgctgcttcctggtcctgctggttcctgtccagcggctacagtgactgttaaagcctggtgggtcccagtcctcactcagacccccaacaacagacctcactcagacccccaacaacagacctcactcagacccccaacaacagacctcactcagacccccaacagacctcactcagacccccaacagacctcactcggacccccaacacccgaacagacctcactcagacccgcaacagtcacccacttcgcttagcctcaggaaggaagtccgtggtggggtctggatctgtggtatgaccccactgtccccgtgggctatgcgttctcagcccctgggccttcttgtgggctctgccatgcagctccttcacttcctcatgccctgcagcctcaatctcaatgccacctgttcaaagcctggcctggccttttttttttttttttgagatggagttttgccctcgttgcccaggctggagtgcaatggtgcgatctcggctcgctgcaacctcggcctcctgggttcaggtgattctcctgcctcagcctccagagtagctgggactacagacacctgccaccatggctggctaatttttatatttttagtagagatgaggattaaccgtgttgaccagactagtctcgaactcctgacctcaggtgatctgcctgcctcagcctcttaaagtgttgggattacaggcgtgagccactgtgacccgttggcctggccttattggaacaacagcccctgccccctgttgctttccccgagccccgctggctataggttgccgtccttggtggcagaggcatgcctgctgtacacttgatgtgaacgaaggaaggaaggaacgaaggaaggagccaaatgccagacgcctgggaagcggctgggtgctccaggtgttaccgggggtggggaagggcttggccaggtgcagctgcgagggtggtgctccaggcagatgggttgataggctggggtgggtgggtgggggtgggcaggagccttgggaaccccaagggtgctctgagctgagagggcgtggacagagtcctggtgggggtgtggatggagccctggggggtgtggatggagctgacgggggtggtttgtggacagagcccttggggggtgtggacacagtcctgggggtggtgtggacagagtcctggggggtgtggatggagccctgggggggtatggatggagcatgttggggggtgtggatggagctctgggggggtatggatggagccctgggggggtgtggatggagcatgttggggggggtggacagagctctggggggggtgtggacggagccctgttggggggtgtggatggagcatgttggggtgtgtggatggagcatgttggggggtgtggatggaactcggggggtgtggatggagctctggggggtatggatggagccctggggggtgtggatggagcatgttggggggtgtggacagagctctgggggggggtgtggacggagcatgttggggtgtgtggatggaactctgggggggtgtggatggagccctgggggggtgtggatggagctctgggggggtgtggatggagcatgttgcggggtgtggatggagccctggggaggtgatggagcctgttggggggtgtggatggaaccccgttgggggatgtggattgagttctttgggggtgtggatggagctctggggggtgtaaacagagctcggcggggggtgtggacggagccttgggaggcatgtggatggaactctggggattgtctggcgcctgtaggcagaggtttgcgggccctggtgacctcagggagccctggagatgggcggggactgggccccgtggcctggcggggccatggcggatgtgggaaaacgggtttaaggggagcttaagaggtgggattgagggtctgttgtcagctcgacgtggctagggagggttctaggagcgggttggggatggccccccacttccatcctgtgctcctacctgggtgagcctcctcgggccgtccccgggtgttctgcaggcaggggctcgggggcggggccggggttgcccagctgtgagtgaggcccagggtcagcagtcatgttgggccctagttgtctgtatttgagggacagtcggaggtgtggggcgggggactgggtgggggtcctggaggctgggctgggtgtggctggtagcacgttggttaggggaggggctggacgtgggagtgcagtcttctgagacatcttgggaggccaggcctgtccttagctggatgaggccgaggcactgggacgtgcgtggggtgggcggcgggtgaggaccagggaagggctggcaggcgtggggttgggccttgctggggaagtgtggttttccccagcttagccaggccttggggctggttggatggggtgtgctgagggatggagtgagcctggcctgcctggacactgcccaacgcagcatccccccggggtgggaagccagcaggccctgaggtgactcagccccagccccctcctctgggccccacctggaaggagccagggctgggctcaggggtcaagagcacaccaggggtagactggggggttcctgggcagtgagggctgagaggctgtggaatgtgggtacccagtgctgggtagtacagggcatgtcccgggggtcccacctgtctgagcatgtctgtgagtgacggtctccgtgggctgcactaggcggagcagggggccagccctgtggtctctttgcttggctgacagcatcgcctgtcgccatggctggggtacaagggccaggtggcccgggggcagagggggcatagtggccatggtctgaggctgtgctgggcagtcccaggacctcttggcctcagtttccccaactgtaccgcaagggcccctcctgccacctgttctgtgtgagggtggaggtaggtgtgggtttgcctgtgtgctgtatgcctgcaggacctgagctccggcctgttggggcctctggctgggcgccctgtacttggccaccccgtgcacttggtggaggccgccagcgtggtgatggggccccacgttctcccccgtggtcacccccagtgaggcaccaaggggcgttccacaggaaacgctcgggtcccggctgcccatggggcccctgtctgtggccactccagccaggctgccctttgcccacctctccccccggtcgctcttcctgtgctccgtgctgacttgagccagctcagggcaggctgggcctctggcaccccaacggtagggagcccaggcccctgagcccgcgtggcctggaggggcagtctccctcccttgagctgggtcatttttgggtctgcagaggatgtggcctgaggatgaggagggtggtgggtccctggctggggaggaagggccagagcctggcagacccaggggcagcgtctgagccctgggccttgtcccaccctgaacgaggcaggcaggtgtggcctcaggtacctgacccgcctccccatgtctgcagcgctcctttaccctcatcgtggaggcctgggactgggacaacgataccaccccgaatggtgagtgagccctgggccaggtggcagctcctctcagcttcagcgtgcctgtggcagggcccagctcctctgtctgcttgggacaaagccttgctttaccctgaggatcatgtgtgctgtttccctttttgctttggctgccaggaagctctgccacgtttgggacttgcagagctgtgcatgcactctcttccccagtcctggctttgcctatgttgttctcctcttgggtgtgctcttttggggcccatggcagtgacttagtggaggggacacccttgagtgtgtctctggctttgtggccccctctgcttgtctgtactggagcatggagccttggtggccctctccctgaggcaggggctctgcagggccctgcaggggtaacgggatgacttccatgggtgaatgcagaagcacccacaggccaagggagcagctcgtgtgaaggtctgggcaggagcgggctggctgtgcagggggagcagccggggctgggctcagatcatggaggctggcaagccactgagaggacacgggctccgcctggcaagctgtggctgccttatggagggtgggctgtggggccaggacacagaccgaggaggagctgccacgtgaatctgggcgtgtcagggtgacttggaccaggggcagtctgggggtgagaggggctctcagaagtggaggcatggggttggccaatgggttggaggagggagagcggggccagggcatcctggctgccagcagagtggaggggctgttttcagggcagggacggcggtgggggtgcccaggtggggagcagcagttgtggggaccccagcggctcagggcaggggtgtttcctgagggggtggcagagagacaggtgggctgagtcccaagcaaggtcgtcagggctcttgacaacgtgagcctggagaggctggggcggccgggacgccccttggggagtgggccagcacagtgtcctcccaggccttggcccgaggcgggagaggtggggtctggaggacccgttcaccttttattgtgcaaaacgtcgagcctgtgcctaagcgcagggaccggcatcacggactttgcataccagcgccagcagctgtggtgcccctggcccctggtctcctggtggcttacttaaagtgaggcttagacagcgggtcacgggacctatgcctgtcttgggggcctgaggggaggcttgtcttaaggtggggacggtagtggtgtttggcacttctgggagcaagtcacagcgcaggagaggggagggcaactgagcaccatgtccgtgctgtcgagggctggacacggcgcaggtgggtgcaggtgttggagcagggctgcaggtgggtgggcacaggtgtgggacgtgagactcacgccctggcagcagccgtgccttctctgtggagcctgtggtctcagcagccctccctgcagggcccctagcccctagccgggccccccgaccctctgcgtttagggtgggagcggggcgcaggcttggtggcgggagggagaggcctctcggggccctgagctttctgtagcagcctggccgggggccctgccctccgtgtgctgctgcctgctgtgccccggccttgcagcagccgcaggcttctgccccgtccccgttgttcctggaggacccctggccgggctggtttctctggcctgtgctgactctgccgcctccccaagaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaaggtgagggggccgctgggctgcgtggagggcagggagggcctcgggcagggccccgggcacaggccttgcggccaggctggctgcagctgtgcctctcgctcctctctgttcgcagctgtgtgtaaacaagggtgtaatttgctccacgggggatgcaccgtgcctggggagtgcaggtgagtgtgccgccggcccgtctttgccctcccaacctttgccctcacgtcctcactggcacacacagccttgctgtcaggagtcgcccggagctggctggaggttgggcacacagctgtgagagccgggccctgagctcgggaggctccttagtgcagtaggtgcgtgtctgagcatgggatgtgtctgatggcggcagccatgtgaggacagtgaggagagactggggaggctggctggacagtcacgtcaccgaggggcagagacccggaggctgcaagccacccagagatggggcatgggcagaggacacggtaaccctgcccatggggagggggtgggcggcgagcggccggcaagtgacaccagcaggcgaggggcggcagagcagaccagtggtgggagctgaggcctgcaggaccagggacagaggaaggggctgctggcaggtttgtagctgggcaaggtgggtggaagggctgtggtagctgttgagtggggaagcaccagacgggaggctgtgagggggaggccgctgtggggcatgtgggggtggtgggggaggggccagcgggatggggagggggtcagtggaagggggagaggcgcacgggtcctgcagacatcctggggtggagcccaggggtttgtggatggatttgatcaagcaggaagggtgtggagtcagggagaaccccaagctgctgagtagcagagccatggtggcaggaggaatgccacagaggagcaggcggggccggggttagctggatgtggagaggcgatgcctgccctgtccctggagacacccagaaagctcgtgggagaggcctggcctgcgccacgcggggcctgtggggggtggcattcaggcggtgacgggaaagtggggaaggcagagaggagggaggccaaggagcaagtcccggctgccacaggtcagggcggatggatgaggagtcagcaagggcctccacaagggagtgtccggggtcttacagccaagtccagatggtggaggcctctggacccagaccagagtgtgggggatccagccaggggggctggcagctttgccctagagtggagcagagaagtcagcagggcaaccagaggggctggggcccagggtctggggtgggcacgggcttcgagccgtggcgctcactgtgcgtgagcaagctggggagcccgagagaggggcgcgagcgggtggagagacagcaggtggaggtgagcaccgccctccagccagccttggattgcaggggtcccaggacctccctctgtggagtgggtttgcctccatgggacgaggacactggggcacagagagcctactgatttccccagggtcacacagcgtggcgttttggagaggagtcggggagtttgggaaccagctgagttgggagccaaggtggggaggtgggtgacccttccacaggccccacggttgagtggcctggagggtacagtgaggagctttcccggccagtcccagagcggggaggcaagcagggctggggccgcccacccggtcacttgcacacacagggattcccggcaggttgagcgagtcccaagtcagctcagaaagtgcaacaaggtggacctggtctgggcagatgtagatgtagatctacgggagtcggccccactcaccctcgcctggcccagtgtgcatcacacaacctggatggcagtgccaccctccctggatggctgctggctggcagcttgaatgtcacaccaaggctggaggaaggcagcagagaagttggccatccctgccctttacccgcaggaagatgagccggagtctggggggcctggtgggtgggggcagtaggtgagctccgcctgcccctcttgctggccctgtcggggaggcccagctgttgctgacagcctcggctcaggttccagtgcaggacgcccccccaccggatgctgcggagatggccatgccttcctgccgccgcctctccagggccctggggctgctggctggggaaaccaggaggtgggggcctggtgtgggctgccctgcccagggtcgagagcacgcccttgggacccacgaggtctgggctctgagcccggctgtggccgctctctggccgatgacccaaggtgtgtcacagccccgccctgagcctgggtctctgtgtctgtggaggagggattctaggcgggatgtgaggccacccacgcggaccactgtgcatgctgggctggatactggagacacgttcttcccggcctcagtttccccatttgtggcagctgaactgggctgataggccttcggtgctggctgtgtggcttgagggcggctcaggaagggccgtggttctttccttttacaaaaataaagtgtggcgggtgccggtgtggaagtgacgtggcctggatgacattcccgtcctgcaggaccggagagttctaggaagggccccccgggagtcccggcagggcctggatggcagcctgctgagccttggggtcgttgcaggctctctcccctgacggaggcaccctcaagtcaggccatgttctaccctggccacctgccctctcctgggggactcccaagacaggacgttggccgatagcctggggcagggcgagtcctggtggttgtgtcctggggggtgcagctgggggtgcagctggagctcctgcagaatcaggaactaccctgggcagggctggcccaggccagcctgtgggcctcagtagccccatctgtgagatgggtaccttgtgggactttactgggagcgagcgaaatgactgcctttgaggtgggggcgagggcacgtgctgtgcccagggccacatggccgaggcagagccaggagtgctcccctgctgcccgctggcctacccagcccctggtgcctcccggccctggcagcaccttgtgagtccgagccggcattctcatccccggggtcccggcagggccttcctttcctggtgcctgctctcggggcccagctcacgggtgaatcccaaaatagctcagggaggagtgacgggacagctggggctgaccgtcggcagccagcggccgggaatgcccgtgacagtggggctggccggcagggctgcaacccctgcctggctggggctgctccagttcaaaggcctgaggccgcccgccggccctgggtgtggcgtgggtgactgtgcctggctcccctgccaccctttcaggcaccacagctcactgggtcttgcgcccctcctccttcccccaggtgcagctacggctggcaagggaggttctgcgatgagtgtgtcccctaccccggctgcgtgcatggcagttgtgtggagccctggcagtgcaactgtgagaccaactggggcggcctgctctgtgacaaaggtagtggtagggggcggcaggcctaatgctctgccatcgaagtgtgggttgtgggggagcggggggccggcttttcccctgagcatcccacccctgcccccagacctgaactactgtggcagccaccacccctgcaccaacggaggcacgtgcatcaacgccgagcctgaccagtaccgctgcacctgccctgacggctactcgggcaggaactgtgagaagggtacgtggggggctggccacccaaattctggccaggcagggactggttccctggggagccggtcaggccccatccctctggcgtcctgtgtggtgggcccctgacccccagcttgggaacctgtgggcttggggaggagtgcttgtggaaagctgggggcctggctgccagctctgccccctccccgcggttctacagctgagcacgcctgcacctccaacccgtgtgccaacgggggctcttgccatgaggtgccgtccggcttcgaatgccactgcccatcgggctggagcgggcccacctgtgcccttggtgagtgtctgcacgtgagtaggggactcctgcctagtatcagtgggggtctgggagtggggcaactcgctggggatggggtgcagtggtcaagtccacacgtgtggctgcggctggcttggcgaggacaaatggcaggaagacccaggcttgcagcgccacctgcccatggggaccttattcccacggctcacactgccagggccccacctttctccaccctctgcagacatcgatgagtgtgcttcgaacccgtgtgcggccggtggcacctgtgtggaccaggtggacggctttgagtgcatctgccccgagcagtgggtgggggccacctgccagctgggtaagggctccgagcgagtgcatgggaacgtgggccgcgcatgcgggctgcgggggctgctggggctgcgggggctgctggggctgctggggctgctgggctgcgggtgccaggtgcccgtgctgcagggggcaggcagggcccgagccccacggctcccaccttgtctctttcacagacgccaatgagtgtgaagggaagccatgccttaacgctttttcttgcaaaaacctgattggcggctattactgtgattgcatcccgggctggaagggcatcaactgccatatcagtcagtatggggggtgggcgccggcgggtgggccgaggcacatgggaccccgcctctgaccctgctcctctgcccccagacgtcaacgactgtcgcgggcagtgtcagcatgggggcacctgcaaggtgaggcggggccaggagggtgtgtggcgtgggtgctgcggggccgtcagggtgcctgcgggacgctcacctggctggcccgcccaggacctggtgaacgggtaccagtgtgtgtgcccacggggcttcggaggccggcattgcgagctggaacgagacgagtgtgccagcagcccctgccacagcggcggcctctgcgaggacctggccgacggcttccactgccactgcccccagggcttctccgggcctctctgtgaggtgaggtctgcctggtcaccctgccccacctgctgctctgggagctgtagggcaggcctcgtcccctgaccatggggcctgagtgacccaggggtgctgcaggggaagttgtccccaaggcgtcccaggctcagctctccactgggtgccaggtgggcaggcggggctgtcacaggtcaccaggcttggccccctgtggccattgcttgttgtgatgggtttcctggtggcctgggctaggagcccccgggctgctggctgcccaggcctatctgtccatctgtgcactccctcgggactggagggcagggggctctggtgggcagagcacatggggtagggtgggtgcctgatggtggagaggtatacacctgtcataggtgagtcctgggtcggagtgggcatctctctcagggctgatgctctcgcctccctctgaccatctgttggtactggaccccctcccccaacctccccttcccccctgcctccaaagtaacctgccttcccccttccccaccacccctaccacccccttccccacctcccccttccccacctcccccaaccctgcctccccccacccacctcactatcacccctcccctacctcccccaaccctgcctccccccacccacctccctaccacccccttccccacctcccccaaccctgcctccccccacccacctccctaccacccccttccccacctcccccaaccctgcctccccattacctgcctccctaccaccccctccccttacttcccctttttccctgcctccccccacccacctccctaccaccctcggccgcccacgatcctgccctggccttggtgcagaggatgggcctcctgtccagagggcttcttggggcccagggcaggggtctgacctcaggacctgcaagcatggcagtggctggccctggaaaagacccacagtcttggctctgagggtggccaggcagtgtgtgaggggctcaggagctgtccttcctgccagcagcaggggccaaggccacactcctcccgagggacagtgaggaagctgggctgcagtggaggtgggggtgggggcccacaggtatctgcgttcagctaaggcctgggcagtctcaggtgggcaggggtcttgggctctggctggcactgttaggcccagggcggaggggcctgggggtccccagggatctaccttcgtatggacagaggcctggcctgtgttcccggcctgggcctgggcctaggctctcacaggcaccccccaccctgcaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagaggtgctgggtgcggcatggggtggtgggggaggtggtggggcaggggcgggcctgactcctgactgtactgcctgccatagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagagtgagtggccacgaacggcgggctggtggtggggctgggctggcctgaggccctggctcaccccgctcgcctctgcagacattgacgactgcctgggccagccctgccgcaatgggggcacatgcatcgatgaggtggacgccttccgctgcttctgccccagcggctgggagggcgagctctgcgacaccagtgagtgttccagcacccgcccacacggcctgtgcctccacccctgtgggccccttatcaccctgagatggaccgctgtctgggtgcggcaggccccgtacccagaaaggcctggccagggggtgctgccaccatggggtggagtcccaggctgcccccatgcccgaggccagctcccccggcccgacgctcctcccccgcccctctctgtcctcacctggcccagctccagtgcttcctcccccgggaagccctccctgagcgccggtgaccccccgcccgctgaccggcgtcctcgcccccagatcccaacgactgccttcccgatccctgccacagccgcggccgctgctacgacctggtcaatgacttctactgtgcgtgcgacgacggctggaagggcaagacctgccactcacgtgagtgtccgcaggccctggccgcctggggctgcccccaggaccctggccctggcggtctggggcctgcctgctgagcggcccatgtgccaacaggcgagttccagtgcgatgcctacacctgcagcaacggtggcacctgctacgacagcggcgacaccttccgctgcgcctgcccccccggctggaagggcagcacctgcgccgtcggtgaggagcccccgctgcctctgcgaccgccgggcatatgccctcccaggcaccgctccctcgggcgcgatgggccgaggggtcttttttgagggccacacctgccacctgccccctgccccctgcccccgggtctgtctgccctgtctgggttgggggcgcggtatggagacccagggccagcccagggccaggtgagacgctccctcctcctcctctccttacagccaagaacagcagctgcctgcccaacccctgtgtgaatggtggcacctgcgtgggcagcggggcctccttctcctgcatctgccgggacggctgggagggtcgtacttgcactcacagtgagtgtgggaggggtgtgggcgggggccgctttcctccacccagatgacatccctgcccccgactcgccccccagtcccttctgccagcccctccccctgctgcccctgcccccagcaaaaggcaccctccttgatgaccctccccagccccacagcctgatcacgccaagccagcctggacagtgcctggcacgcttggggggtgggtactgatcccctgcgttctcttctcccaaaccagataccaacgactgcaaccctctgccttggtgagtggcaccctgggggccacagcaggggtgggtgggacttggcataccacggggggccacctgatgcccaccctctgctctgcagctacaatggtggcatctgtgttgacggcgtcaactggttccgctgcgagtgtgcacctggcttcgcggggcctgactgccgcatcagtgagtggccagacagccccagccctgggagcccctcagcccagccgcggtgtcaggagtctggggacatcaacgtccacgtcccttgaagggcagtgtggccacaactacttcctgcctctcttctgagcctcagtttccccacatgtctgtgccctgtggggttcctgctgtataccctgccaagtgattaagtggggagccccagcctgggggaccagtccggggcccagggagctgtgggggttggagcgtgcagcctgacgtgggctcctctgtggccgcagggctgttgtccctgggtgttggcccagctgtctgtccagcaccccttggctggtccgacgcagcagctggggctaatccaggatgggacaggcccactgcagaagcagacggaggagggtgctgttgggccagggtcaggctgggctcaggaaggcctcaggcaggcagcagcttgggctcgggggcaggggctgctcctcattgtcctggggcttgcgcctgtgtgccactggctccccgctgccctaggccatgccggtcctgcggtgggcgttggcctcactgcactgagcagcggtggctctccctgcagacatcgacgagtgccagtcctcgccctgtgcctacggggccacgtgtgtggatgagatcaacgggtatcgctgtagctgcccacccggccgagccggcccccggtgccaggaaggtaggccccgtgtgattgccctgggttggggcgggttggggggcatgggtgacacccagccccgagggccagatgcccactgctgaccctcgagccccttctccccacagtgatcgggttcgggagatcctgctggtcccggggcactccgttcccacacggaagctcctgggtggaagactgcaacagctgccgctgcctggatggccgccgtgactgcagcaaggtgagggcagcccgtgagccgccctgccctacccgaggctggtgcacgctgaccctggccactctgtgagatcaggaggcgggtgctggggtccggatggactgagagccgtctgccctcagggacacccagggaggcgagagctcagccaggccccatgcttcgatgtgcagttgggaaaacaggcctggtctgggtcctgccttgctccgcctgccctttctgatgtcgagcttggcctgcctccctgggagccctgggtagggggtgggctgggccctggggctcacagacttgggcggtgtccctccttggcatggggcccgtgcctgcctgtgggttctcatctgtgtgcctgcatctgaccctcctgtgcgcctgcgcctgaccctcctgtgcgtgcctgcccaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccaggtgaggggcctggtggcatctgagcttgcagaggccacacgccggcatctgctcgtggcatggcgaaagcctagccccgcagggcagggaggccctggttggctgagcagagtcactcttggtcacagagagtggccctgtggggtcagatgagaggggcattgggcctggtgctgggtggaggtggcagaggaggctgggagagcagccagctgggggtgcctgtttgtccagctgccctgagggcctggactgacggcgccatggctgcctggccccagctcttgggctgtagctccgtgggcagttttgccctggcctaggagccacctttgcctgctgtgtgcttggagctgggcccctgtctcccaggaggggctcagaactggaggagacccactgtaccccgccctgcctctccttcccccactggcctgcaggtggagctgggtccgccctgaggatgggcgggtgggcaccgtcactcctgcctcctggtatagggcacagccgggtgggaagctgcccccccaggcccttggcatccttgctgtgctctcctgggcgggctgtagggtgtgtcccacgtgtacccacagcgccagtccagggatgtaggtgtcaggttcacggccctgccctgcccacgcactgcctgtctctgcccagggcaccacggtgggcgccatttgctccgggatccgctccctgccagccacaagggctgtggcacgggaccgcctgctggtgttgctttgcgaccgggcgtcctcgggggccagtgctgtggaggtggccgtggtgagtgcccagtggggagcagcacctgggtgggccctgggtcccgtactatgcaggtcctggctatgctggacagaggctctggcgaggctagtcctggtgcggaaggactgcgggcaggcctgtctccctgcggcccctcgctgtccatgccgcagacccgtggaactgctccctgggcctggccagcatgagggagatgcagggctgtggtgtggagcccgcttcccctgcagctgcatcctcgcccggtcccctgctctgtttttgtctctgtgtccctacgtcacaggcagcaggagagtccgtgggcttagtctgccctgggaggcctgctttgggactggcacctgccctggacctggggggtgtcagatgtgaatggataccaagggggtcgggtgagactggggtggagacatgcccggagaggggagggaatgttctggaacatggtgggtgggtgtgcagagcagtgggtgtggccatggcacagtgtggctggtggaggccatggccaggcacaggaaggacgtgcagtgttttggtgccctgaggccgcagagggggtgggggacatggatgggtgctgctgggtgatggaagggcagtaggggcaggggaagatgtaagaagtgtgccagcacaggtcagggcgccatcagggatgtggtggaggcaggggcacagccccgggttgctgtggcctcgtgaaggcactaggtttgtggtgcccctggggtgtggcccataggtgggggtgggggctgggaactgacaagaagggatggccatcacggagcaggtgtcagcgaatggggccacacacctccccaactcactgcctggtggcgaggtccccaccgcaggaccccgggctctcctgtgtgcccggacggggacaccctccacccctccacttccccccacccctcactgcctgctggtgaggtccccaccgcaggaccctgggctgtcccgtgcgcccggatggggacatcctccacccctccccttccccccactgctcgctgcctggtggtgaggtccccacacctcaggaccctgggctctcctgtgtgcccggatggggacagcctccacccctccactcctccccccgctactccccactcactgcctggtggtgaagtcgccactgcaggaccccgggctctcgtctcccgtgcgcccaccttgctccagtgtggccagggcctcagtgttgggggcaggctgctgggagcctggagccctcgagccatccccacaatgccgttctttgccgcagtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtaagcgcgggaggtgggcccctgggaaggcaccaggcaggcaactcaggcattgggcacagagccggccgatcctgccgatcctgccagccaccaggaacacagaagtccctggcacctgctgccccagccgcccagccccacaacctgaccttcccagcccccgtcctgggaccctccccacgagccagcaaccggagggtggggcccggccgcctggcccgcagggccctcccaggcctgggtgtgtggctagtgccccgcaggtgcccaggcctcattgcccaccggctcttctccccggtccccaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccattgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggctggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 37319 - DNA, 62950 bp, Homo sapiens
caagcagggcctacaagccgaggagggctgtttaaaggcgcaggggccattttacctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggcaagccgtgggggcagggagggctgtttcatcccgctggggcggccataaccaagtaccagggattgggtgcaattaaataacaggatttctttttcttttttattttattttattttatttatttatttatttttttttgagacagcatctcgctctgtcgcctaggctggagtgcagtgacgcgatctcggctcacggcaagctccgcctccggggttcaagcgattctcctgcctcaacctcccgagtagctgggattacaggcgcacaccaccacacccggctaatttttgtatttttagtagagatggggtttcaccatgttggccaggctggtctcaaactcctgaactcgtgatccaccccactcggccttccaaagtgctgggattacaggcgtgagccaccgcgcccggctaggaatttattttctaacacttctggaagctagaagtccaagatcaaggtgttggcagggttggtttctcctgaagcctcttgcagaggccctaatctctccttataaaaccaatcaggctgggcgcggtggctcacgcctgtaatcccagccctttgggaagacgaggcgggcggatcctgaggtcaggagatcgagatcatcctggctaacacagtgaaaccccgtctcaactaaaaatacaaaaaattagctgggcgtggtggcgggcgcctgtagtcccagctactccggaggctgaggcaggagaatggcgtgagcccggaaggcggagcttgcagtgagccgagactgcgccactgcactccagcctagggcacaaagcgagactccatctcaaaaaaaaataaaataaaataaaccaatcaaaccaaattccaggccaccctcaggaccccactttaacttagtcacccctttaagagcctatgtctggccgagtgcgatgactcatgcctataatcccagcgttttgggaagccaaggtggaaagctctcttgagcctaggagttcaagaccagcctgggtgacataacaagacctgatctctacaaaacataaaaaatttagctggagatggtagcatgtacctgcacttccagctactcgggaggctgaggtgagaggctcgcttgagcccaggaggctgaggctgcagtgagccacgatcacaccactgcactccagcctgggtgacaaagcaagaccctgtctcaaaaagcaaacaacgaaaaagaatcctatgtccaaatacagtcacattctgaggttctgggggttacaagtccaacatatgaatttggaggtggtggggggaagctgattaatttcataaggggggtcttgaaactgccttcgcagaaatgtaagtaatgagagaaagctaacatgactgaccatcttgtttctaacctcacaggctagatttttttttcttattctagtgcagaggccaaaattaccatgagaggaatttaattcatagttaaactttgagacaaagaaaactgacccccagtccttgttgagagattgaagccacattcatttactttttatttatttatttagttttgagacagagtttcactcttgttgcccagactggagtgcaatggcatgatctctgctcactggcacctccacctcctgagttcaagtgattctcctccctcagcctcctgagtagctgggattacaggcgcccgccatcatgcccaggtgacttttgtacttttagtagagataaggtttcaccatgttggccaggctggtctccaactcctgacctcaagtgatcctcccacctcggcctcttaaggtgctgggattacagccatgagccactgtgcctggcctgaagtcacattcataagacaaggttagaatcatgaaggtgctggaactttgctaaagaacagtcgtgggttgaagaatgacctgccatcccttagcttccttttctatatgtgctccagagtcacgtaaccaggggtcgcatgatttataacttccccagctacttctataaataatatcactgtcgtgaaacacagaactcagctttttagtggggtgtggtagctaacacctgtaatccccacttcttgggaggctgaggcaggaggattgcatgagcccgggagaatgagaccagcctgggcaacatagtgagacctcaatctctacaaaaaaattaaaactttgccagacgtggtggtgcatgcctgtagtcccagcaacccaggaggccaaggcaggaggattgcttgagcccaagagttggaggctgcagtgagctatgattgcgccactgtagggaccagccctgcagggtctgtgggtctttctccccatgtgcggagacgagagatcgtagaaataaaaacacaagacaaagagatagaagaaaagacagctgggcctgggggaccactaccaccaagacgcagagaccgatagtggccccaaatgcctggctgcgctgttatttattggataataaggggcagagtaaggagtgtgagtcatctccaatgattgataaggtcatgtgagtcacgtgtccactggacagggagcccttctatgttaggtagccaaggcgtagagagagaggatagcttatgtcattatttcttttatgttcttttcagaaagatcaaagactttaatattttaatactttcactaattctgctactgctatctagagggtgcagccaggtatacagagtggaacaggaaagtgaaacaggagtgtgaccactgaagcacagcatcacagggagatggtcaggcctctggataactgcgggcgggcctgacatcactcaggccctccacaggaggcggtggagcagagtcttccctaactcccccggggaaagggagactccctttcctggtctctaggcactgacgcaaccgctagaccaaggtccgctaggcaatgggcatcttcccagacgctggcgttaccccaagaccaaggggccctctagtggccctattcgggcatgacagagggctcacacttgtcttctggtcactcttgacctcaagtgatctgactgcctcggcctcccaaagtgctgggattacaggcatgagccactgctcctggcaataatgtttcgttttgtttttgttttaaaaaaaagaaattgtctttgagatagttttcagagtgagcattttggcagaccaagagctaccacctggtcctgagacccgctcccaggaactgactcagctatacaaagatagttttggacacacctgtgatttcatccatagccgatcaattgttccctcagccccttgcccaccaaagtttccttaaaaaaccctagtctcaggtcggacgcggtggctcgtgcctgtaatcccagcactttgggaggccaaggcgggtggatcacctgaggtcgggagttcaagcccagcctggccaacatggagaaaccccatctctactaaaaatacaaaaattagccgggcatggtggtgcatgcctgtaatcccagatactcaggaggctgaggcaggagaatcgcttgaacccgggaggcggaggatgcagtgagccgagatcatgccaatgcactccagcctggtcaacaagagggaaacttcatctaaagagagagagacagacagagacagagacagaggcagagaaagagaaagagcgaggaaaaaccctagcctccaaattttcagagagacgcgcttgaaatatttctcccattctcctcgcttggccgcccctgagattattaaactctctctctttgctgcaacacctgctgttcgcattggttttgtctgggcagtggacaaggagaacccatgagcccgtgacagtcccagccctcccccactgtctttgctaagcccaacagtgggcacaggactaagaagagccatttctttggcaggaggactgagaattttctgaccgcagtgcaccatgggaaggtaagtcctcttagagctgaccactatggggaagcagagcatttgtgtaatggaatgcatagtgagtgtcaagaggtgagggctgtgacagttcctctcgcttggtggagatagatggaaagagctgaaggttgggcatggtggcccatgcctgtaaccccagcacttttggtggccgaggcaagaagatctcttgagccccagagttcgagactagcctgggcaacatggtgaaaccctatctctacaataaaagaaaatatttttaaaaattagccaagcatagtggtacacacctgtagtccaagctacttaggaggctgagacatgaggatcacttgagtcccggtgttcaaggctgcagtaagctatgattgcaccaccgcactggtggtgggcaacagagcaagaccctgtcttattgttgaaccggggaggtggaggttgcagtgaactgagattgcgccactgcactccagcctgggcaacagagcgagactctgtctcaaaaaagagagagagaaagagaaagaaagaaagaaagaaagaaagaaagaaagaaagaaagaaagaagggagggagggagggagggagggagggagggagggagggagggagggagggagggagggaaagaaggagggaaggaaggaaggaggaaggaaggaaggatggaaggaagggagggagggagggaggggagggaaggggagggagggagggagggagggaggtatgtcaccatgttggccaggctggtcttgaactcctgggctcaagtgatccacccacctcaccctcccaaagtgctgggattacaggtgtgagccaccgcgtctggccccaaaattaaccattttgaaaagtgaataattgactggcattcaatgcattcacagtgttgtacaaccatcacctctatctagtttcagaatattttcctcaccccaaaaggaaaccatgtacccgtgggctggtggctacctgcttggacagcccagttctaggtcaaattctgtgttttatcccttttccctgtgaattttctggacttctttgtgttttctcctgggaagctctgaagtttccataattcctgggctccagaaagaagaaaaggcggccgtggagagacgaagacttcatgtgctgaaagctctgaagaagctaaggattgaggctgatgaggtaagtgaggggaggagggtggccccagagatcccagaatcgccccctctgtgcccagtgtccagggcccaactcagccagggagagctggaccgaaggatatgaacttctatgggatagaaatagaaggatatgaacttctatgggacaggcattgcccctgcctaagggagatcctaggtctcctccttctcctcctcctcctttctttttcttttcttttctttcttttttttttttttttttttttgagacaacgtctcgctctgtcacccaggctggaatgcagtggcatgatcttggctcactgcaacctccacctcccaggttcaagctattcccctgcatcagcctgctgagcagctgggattacaggtgtgtgccaccacacccagctaatttttgtatttttagtagagatggggttttaccacattgaccaggttggtcttgaactcctgacctcaagtgatccacctgcctcggcctcccaatgtgctgggattacaggcgtgagccacggtgcccggccccaggtacccttcttcttgttcccacctccatcctcaggctctaaacctctgatcgattttctccccaatgcctaggccccagttgttgctgtgctgggctcaggcggaggactgcgggctcacattgcctgccttggggtcctgagtgagatgaaagaacagggcctgttggatgccgtcacgtacctcgcaggggtctctggatccacttggtaagcatcactcatgtttcagattgctttctgacacataaatgggattatttttttcctcctgacaccaaatgtgtgtggttttttccaacgctgcttctcgagctctctggtactagctgggtgtcctacaattctgagcaattctgacgctggctacctggagttcacatcagattccacaggtgaaaggggctcagtcccaaaaaactgctcccacttcagacacgagttgcaattacctagccgctggtgcttctgaccgactggcaatagtttggggtttcccacagcttccgcctcatgttcaataatttactggaatagctcacagaactcaggaacacactttacttacaattgctggtgtattacaaaagatgggccaggtgtggtggctcacgcctgtaatcccagaactttgggaggctgaggcaggaagatcgcttgagtctaggagtttgagacccaggcggggcaacatagcaagaccccatctctacaaaaagtgaaaaaattagccaggcgtggtggtgcatgcctatggtcccagctactcaggaagttgaggcaggaggattgctttagcctgggaggctgaggctgcattgagctacaatcacaccactgcacaccagcctgggtgacagagagaccctgtctcaaaaaaaaaattttttttttctaaaaaagaaaattccaagggttttaggaactctgcaccaggaagcaggggaaaacaccaagtatctttctttgctacacaaagccatggacaaagcataataatactaccttctgacattaaaggaggatttacatgttcaggtgcacttttcacactgcaggtggatagaatacagcccttttaacttatcagcctctatgataaagtattgcattaatccgtgtaggactgtctcattcaggaggccccagatggcaggtatgaaacactcatgtctgcatgtttgttgccaagcccagggcagacatgactaatcgatcttggcacattttcagagcaggaggtaaggctaggcagagcagcagaggctcgagtgtgagataggcagggcagaggcatgaatgttgagcctggctggcctgatttgttttcatttctgtgctcaaagtttgatctggagctgggttctgagctggatgtggaggatgaggttcctggaggcgacagcatgaagagcagagctgcagagcttgggagtgggaaaggtcctgcagagtcacaccggacccctctattcctccaaggctcatctaacatgttgagtgacatggcgtgggggtttagctgtactgcacattgcagaactccagggggcgctattgagataggaaccccatgatttcttctggaatctttccgagactgctgtggttaaaaaggcaggcctggctggacacagggactcacacctgtaatcccagtactttgggaggtcgaggtgggaggatctcttgagcccaggagttcaagaccagcctgggcaacatagcaagaccccatctctacaaacaacaacaacgaaagccttatatttcaacagctttgggttagttcctggagctgtcctttgtgggctgttacgagcccagacatacttctttgtgccttggtttcctccgctgttgagcattgtaagtgtggacgatgaagactgggaaaggatgtgtgtgaggaggtccttcacaggaacgcctgcctcatggagagggcgacacacagaggaaatggaaaatttacatgaaataaatataactgcagaacggtcaagttcaaaggagcactcaaaatcatctgggacagtccttccatttcacaggcaggaaaatgagagcacgatgggagaaaggcctcatcagagtcaaatgttttttgcagccagcatttattaaaggtttacatgtgacagcaacaaactgtgctgatctcacagggctgtttgagaattaaatgatgaaacacatgcaaatcgtcccaacctgagctatcaagtagagctatgtaacatgagccacatctattctatcattttaaattttctttctttcttttcttttctttttttcttctggagacacagtcttgctcttgtcgcccaggctggagtgcagtggcgcgatcttggctcattgcaacctctacttcccaggttcaagtgattctcctgcctcagcctcccagttagctgggattacagacgcgtgccaccatgcccagctaatttttgtatttttagtagagacggagtttccccgtgttggccaggctggtctcaaacttctgacctcaggtgatctgcctgccctggcttcccaaagtgctggaattacaggtgtaagccaccatgtccggcccattttaaattttctagtagcctcttcaagaaggtaaaaagaaacagtgaaatgatccattttctttaacccaatatatccaaaacattagcattttgacacatcgttaagaaaaaaattgttaatgagatatttgacattccttttgtcagactaggtctttgaaagctgctgggcgttttatactgagcgcattccaagttggatgcagaagtctcattagatgttaaaggaggcccggggcagtggctcacacctgtaatcccagcacttcaagaggccgaggcaggtggatcacctgaggtcaggagtttgagaccagcctggccaacacggtgaaaccctgtctctactaaaaatacaaaaattagctgggtgtggtggcacgcacctgtaatcccagctacttgggaggctgaggaaggagaatcacttgaatccgggaggcagaggttgcagtgagccgagctcgaaccactgtacttcagcctgggtgacaagagtgaaactccatctcaaaaaaaaaaaaaaaaagatattaaaggaaagaacttttcatacccagcttgttccaaacatacttcagagtttcccaataactgaatggagtaccagtgtttaaatttaagctaattaaaatgaaataaatattttaaatcatgctagccacacttcaggggctcaagagctatgatgtatgtttaatacattggatggtgtgagggtagatagcacccgataagcagcattaagaacatcaaaaatttttattgagcccgggcacggtggctcacacctataatcccagcattttgggaagctgaggtgggaggattgcttcaggccacaagtttgagaccagcgtgggcaacatagtgagactccatctctacagaaaataaatttaaaaatgagcagggcatggtgatgcacctggtgggtagtggtcccagctacttgggaggctgaggtgggaggatcatttgagcctgggggtttgagactgcagtgagccaagatcatgccactgcactctagtctgggcaacagagcaagacctgtctcaaaaaaaaaaaaaaaaatatatatatatatatatatatagactctatgtgacacaccagctcccttgccttctgccatgagtagaagctttttgcaccatgcttcttgtacagcctgcagaactgtgagctaaataaacctcttttctttataaattaatatatataatatatatttattgagtgaacaaatgaatataaagtcttttttttctttttttttttctttttgagatagagtcttgctctgttgcccaggctggagtgcagtggcgcgatctcggctcactgcaagctcagcctcccgggttcacgccattctcctgcctcagcctctcgagtagctaggactatagtagctgggtctgcaaccacacccagctaattttttgtatttttagtagagacggggtttcaccatgttagccaggatggtctcgatctcctgacctcgtgatccgcacaccttggcctcccaaagtgctaggatcacaggcgtaagccaccacgcccagctttttttttttttttttttttttttagatggagtcacgctctgtcgcccaggctggagtgcagtggcacaatctcagctcactgcaacctccacctcccgggttcaagcgattcctctgcttcagcctcctgagcagctgggaccacaggcgtgtgccaccatgcctggctaatttttgtgtttttagtagagacagggtttcctgagtatccggcactagaggtacccaccaccacgcatgccaccacgcctggctaatttttctgtatttttagtggagacggggtttcaccatgttggccaggctggtctcgaactcctgacctcaggcaatcctcccgcctcgtcctcccaaagtgctgggattacatgcatgaaccaccacacctggccccgttcattgattttctaggattatgtgagttaataggtataaaagactaaagacagtttgttgctgtcacatataaaccttttaataagtgctggctgcaaaaaacatttgactctgatgaggcctttctcccatcgtgctctcattttcctgcctgtgaaatggaaggattgtcccagatgattttgagtcctccttcgaacttgatcgttctgcagttgtatttatttaatggaaattttccgtttcctctgtgtgtcgccctctccatgaggcaggtgttcctgtgaaggacctccttgcacacatctttccccagtcttcatcgtccacacttaaaatgcccaactcactctcttcctctgtcctccagggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaagtaagtcattcccagctggggacctggggtgggggtaggagcaaggggtctcagggtgtggggttaccaaagatgctgaccagcaccaccttttaagtccttcaggattttcaagtcatcaaaatctgggcacttcggttgatgcctcaaaactaaagtatatcaggattactgtggttgcaagtgacagaaattgactctgattcgtttatgcaacaaataaagtgatatgatttactagaaagatacacagacatccagggcaagaagaacaatgaggacttatgatggaataaggcagaaatagggaaagtgtcagacccaagacaactttcctctccatctctgcttggccatttgatgtcttgaattcactattttattttatttcattttatttttgagacagggtcttgctctgtcacccaggctggagtgcagtggcgagatcatggctcactgcagcttcgacctcctgggctcaagcaatcctcttgcctcagccttttgagtaagctggggcaacaggcatgcaccatcgtgcctggctaatttttaattatttttttttttgtagagacagggatcttgctatattgcccaggctggtctcaaactcctgagctcaagcaatcctccaactactgggttcaagtgatcctcctatctcagcctcccgaagtgctgggattacgtgtatgagccactgcatccagcctatcctaacacatcgggtttttgttgttttttgtttgttttgtttattcttgagacagggtttcactctgtcgtccaggctggagtgcagtggtgcaatcacagctcactgcagccttgacctcctgggctcaagcaatcctctcagctcagcctcccaagtagctgggactacaggcacgcaccactgggcctgacaaatttttttttttttttttttttttttttttttttttttttagagatagggtttcgcttttttgctcggggtggtctccaaatcctgggctcaagtgatccttccacctcagcctcccaaagtgctgggattatgggtatgagccacagcacctagcctatccaagcactttgggtggctgaggcgggaggattgcttgaagccatgagttcgagaccagcctgggcaacatagcaaaagcctgtctctatcaaaaaataaattagccgggcatggtgacatgcatctgtagtcccagctacttgggaggttgaggtgggtggattgcttgagcccaggaggttgaggctgtagtggcccattattgtaccactgcactccagcctgggtgacagactgagacccctctaaaaaaaaatgtggcctacgtgcagaggttccaccctgtgggacccacatgcctccctcacactgtcttggcaccttctcccaaagctgccggagtctcatttgtccaatatgaagaagcccgtggaagaagggacactaccctacccaatatttgcagccattgacaatgacctgcaaccttcctggcaggaggcaagagcaccaggtaagcaaacatttagagggagggagaggtagtaagggatggaacagcacggagtggaatggaagaatgtttccctgccctccccttggggagcccaggaagagggaagggctcaggattgcagaaaacagggtgctcagcttagacgagagaagagggaagtcccagaagtgaccagaggacatgcacttgctttgcatggatcaagaaaacctttaagaggccaacatggtggctcacgcttgtaatcccagtggtttgggaggctgaggtgggaggatcgcctgaaaccagaagttggagaccaccctgggcaacatagtgagatcccatctcaaaacaacaacattaaaaaacaaaacaaaacaaaaaaacacaataaattagccaagcatggtggcaggaacctgaagaatctacccaggagactggggcaggaggatcactggagcccaggaattcaaggcttcggtgagctgtgattgcaccattgtactacagcctgagtgacaaagtgagaccctgtccccccaaaaagaagaaagaaaaaagaaaacagaggagaggagggacaaaagacaaaaaggggccgggcgcagtggctcacgcctgtaatcccaggactttgggaggccgaggcgggtggatcacgaggtcaggagatcaagaccatcctgactaacacagtgaaaccccgtctctactaaaaatacaaaaaattagctgggcgtggcggcgggcgcctgtagtcccagctgctcgggaggctgaggcaggagaatggcgtgaacccgggaggcggaggttgcagtgagctgagatcgcgccacagcactccagcctgggcgacagagcaagactccgtctcaaaaaaaaaaaaaaaaaaagaaaaaagaaaaaagtaaagaaaactgtaataagggatgtttgaaggatggcggggtgggtgggtggggctgtctctcacttttttttttttttttgagacggagtttctctcttgttgcccaggttagagtgcaatggcacgatctcggctcaccacaacctccgcctcccaggttcaagcgattctcctgccccagcctcccgagtagctgggattacaggcatgcgccatcacgcccagcgaattttgtatttttagtagagacgtggtttctccctgttggtcaggctggtctcgaactcctgacctcaggtgatccacccgcctcggcctcccaaagtgctgggattacaggcatgagccaccgcacccggccatctctcactttttagatgtcttccttctccataggtccgattatcacccaaatgctggcagctctccagacattccagtttctcttttgagctcatctctctcctgagatccagacctccttaccctatttcctaagcataaaatgcactcacttgttcagcaactgtgtcctggtaagttctcacgatacatcaggcaatgttaccagttacctgtggttgggcgtctcctggcatctcaaggctcagaagcccccagtgtgaatggtgtttgtctgtttgtttgtttgagacagagttttgctcttgttgcccaggctggagtgtaatggcacgatctcggctcactgcaacctctgcctcccaggttcaagtgattctcctgcctcagcctcccaagtagctgggattataggcatgcaccaccacgcctggctaatttttgtatttttagtagggatggggtgtcaccatgttaatcaggctggtctcgaactcctgaccttaggtgatccactcacctccgcctcccaaagtgctgggattacagacgtgagccaccacgcccggccatgaatgttttatctctctcctcggtgtggatccttgtgctgttttctcaccagagcagatacagctgactccgtcctttccataagccccacaaattcagtcattcccagacctagaaatcaccccctcctcattttcatcctttgtgctcttctacatcatccccagaccaggtctcccagtctcctgggagactcttgtaattagttcctcactggcccgcccatcccaagctgtccacctccttccctggctacctgatggaagtttccaggatgaaaatctgatcatgtcattttcttccctggaatattctaatgactcacattggaatcatgcattagatttatgcccacagacaatcctccatgcaatcgtgtggctacactcttcccttgcactccaggattccatggagttgcagccacaatgagatggaagagagaggcagggctgagggttcaagctctggaaaatattggaaacaggctgctgtggaagttatgagctgccaccagcagcgtagactcaggtctgaggatgagatccccagtggtttctgataccacacagtccatctctaacattctcctgtcatggttgtaattcctcattaatagatttctttttcctgcatacctgctacattcctggttctgtgctgggactcacttgccgttgtatttcctctgcagagacctggttcgagttcacccctcaccacgctggcttctctgcactgggggcctttgtttccataacccacttcggaagcaaattcaagaagggaagactggtcagaactcaccctgagagagacctgactttcctgagaggtcagcgctggggtcagaggggattaaaagggggtgggaagtggaggagaggcaagaattttccttctgagggtctagtttgcccagctcttaaatttcttgggggaaagaaaaggacttggtaggcttccagaaagaggaatggtgtattccttctgctgagtcttcagtgtctctcaaaggtctccttaatgcggcagatacctgatatcctatcaaacaatccaggagagggagcttaatagaggggctcaagtccagggctgtggcttccaataagcagattcagaatgtgtttgggattacatggtgctttgggaggctgacctgggaggatcccttgagactgggagtttgagaccaacctcggcaacatagcaacactgtgtctctacacaagatttaaaaattagccaggcattgtggcatgtgcctgtggtcccagctactcaggaggctgaggcagtggaaggatcacttcagcatgggagttcaaggctgcagtgagttatgatcgccccactgcactccagcctggatgacagagaaagatcttgtctcaaaacaaacaaacaaacaaacaaacaaacaaaaaactagaatgtgttttgggcaccagcaaagcaaggggcatacaattttttttaaatggggtatttccagaaaaaattacaacaaaaaccaaaaacaaaacagtcatagtgagtaaaatcagaacttgattaaatgtccttgactgtagcttacacactggtatcacttttagttgtggcttcataatcttctcagcattcagggtctgaaggcattaccctgctgggcagacagctcccctacataggaccaaccatgccagcttgagaaagtcattaatgttacctgagcctcgtttttctcatagggaaagtacttacctcaaaatgtgggtgtgagagttaggtatgatccacaaataaaacactcagcccagtgtccagcacatggtaggaaattaaggatggttgactctccatgattttagcatacacttttgagacacactaggagcctgatactattttaaatgcaggggattcagtcatgagcaggacagtgaaggctcattccctaatgaagtttgcactccagggaaggagatgatgaatgaacacacacaaaaataagtatgtattataatgtcagatcatagtaaatgctatcttgaaaaataattcatggtaagggactggagagtgactacagtattatttttaattggtggtcagagcttctgacaggagatggcctttgagcatggacctgatgaaaagtgaagccatgcagatatcttagaggaaaagcatcatggacagagggaagagcaaatgcagagaccctgtattagtccgttttcatactactataaagatactacccgagactgggtaatttgtagacaaaggaggtttaattgactcacagtttcacatggctggggaggcctcaggaaacttacaatcatggcagaaggtgaaagggaagaaagaaccttcttcaagtggtagcaggagagagaagagcaagccaaagaagagctgcccaacacttatcaaaccatcagatctcgtgagaactcactcgctatcacgagtacagcatggggggatctgcccccatgatctgattacctcccaccaggtctctccctcaacatctggggattacaactcgagagatttgggtggggacataaagcttaaccatatcagaccctaagccaggaccaagtttgtcttactctagaaccaatgagaagaccagtgaggctggagcctcctgaatgaggctgagagagagggctagagaggtaggcagggtccagatcatatgggaccctgaaggacacagatgaagtttagtttggattccaagtgcgataggagagccagggaggcagtttaattagggtggtgaccgattcagtttatatggtaaaacatctcactctctctctctctctctgagcatggattaggggtgggtgtgtaaacttagaagttgggagcagttgagaagctaatggtcctggtgacagataatggcagtttaaggttgggtaccagaatggatatgggagggaagtggatggactctggaaacctggagatggatgaagaagaattacacctggattggatgtggagagtaaggagaatcagagatgacatcaaaggttccagcttctgcaacctggtagatggaggggtgttctcaggggaggagaacaaggtaggatgaaggggatcttccccttttctctggtctggacagacggggtccttcacattgccaagcctggctcctgtctcctatccccaccatctctttgctaaatctggtcttgggcatcagagattttgaaattgtcactcccaggtactccctataacattattatttccttagatgtatgtatcacctactgaagggattctgtacgtgtattttatccctcccctcacacaccagggtgctttttatttattattataaaataaacataacataaaatttgccattttaaccattttaaagtgtcaagtacagtggtataaatacaatacattcataatgttgtgcaaccatcactgccatccatctccataacacttttcatcttgtaaaactggaactctacgcccattgaatactaagtccctgtcaccccctcccttagcccctgacaaccacaatgctaccttctgcctctacgattttgactactctgagtatgacatgtaaatggaatcatgcagtgcttgtctttttgtgtctgtctgatttcactgaggaaaatgacttcgaagttcatccatgttgtaccatgtgtctgaatttcctttctttttatggctgaatcatattccattgtacgaatataccacattttgcttatcaattcatccatcgatggacacatggattgctttcaccttttggctgttgtgaaggaacctgccatgcacatgggtctatgaatatctctttgagaccctgctttcaattcttttgggtatatactcagaggtagaattgctggatcatgtatgtggtaattctacttttaaaattttgaggccaggtgtggtggctaatgcctgtaatcccagcactttgggaggccgaggcgggtggatcacctgaggttgggagttggagaccagcctgaccaacatggtgaaaccccatctctacaaaaaatacaaaattagccgggcatggtggtgcatgcctgtaattccagttactcaggaggctgaggcaggagaatctcttgatctcgagaggcggaagctgcagtgagcggagatcgcgccattgcgctccagcctgggctatctcaaaaaaaaaaaaaattttttttttgaggaacgaccataccattttccacagtggctgtaccattttatattctgcccaatggtgtcccaggtttccaatttctccacgtcctcatcaacacttattgttttctggggttttttggataccagccatcctaatgggtgtgtctattttttttttttttttttttttttttgagatggagtctcactctgtctcccaggctggagtgcagttgtgtgatctctgctcactgcaacctcccaggttcaagttattcccctgcctcagcctcccaagtagctgggactataggtgcataccaccaggcctggctaatttttgtattttttagtagagatagggtttcaccatgttagccaggctgactttaaactcctgacttcaattgatccgcccacctcagtctcccaaagtgttagcattacaggcgtgagccaccgtgcctggctgattattcattttttatgtctccctgtatcatatacaaatgtgtttggctaaaagtcactaaccaaccacagtgccccgaggacatgtgggattaattttcttacaaaagaaaaagacagactgagcaccgtgactcacagctgaaatcccagcactgtgggaggccgaggcgggcagatcacttgaggtcaagagttcaagaccagacgggccaacatggtgaaaccccgtctctacttaaaaaatacaaaaattagcagggcgtggtggtgcatgcctgtaatcccagctagtcgggaggctgaagcaggagaatcacttgaatctgggaggcagaggttgcagtgagccgagatcacaccactgcactccagcctgggcaacagagcgagatcccatctcaaaataaataaataatacaaagttaggtggctggtgacattggtttagctgtgcaacattaagcagaaggacccaggtttattctagattttctgctcctccatccttagcatattaagtcaccctcatgctgaactcctccacaccacgggatggcggctgcatccaatgaagctgcaacttttttttttttttttgaagtcagggtctctctctgtcactcaagctgccgtgcaaaagcacagtcatagcccaatacaggtcttgaactcctggcctcaagtgatcttcctgcctcagcctcccaagtagctgagactagagttgcatgccaccatacctggcctgctccttctgagaaggagaacaagcactttgcagaagtccccccagcagtgtgcatggaccagagcttgaccgtcccctagctgcaagggaggctgggaaatatttgcccttcctgcctgtgtgctgagaagggttggcatggacaggagcttgaaatggccttggggtagccagtctacagtgcccggctggctccacccatagaaggttcgtgaggacaaggactttatctgtcttgtttactgctctattccaacagccagaagagtgccgggtgcccactaattgcttcataaatatttatggaatggaagaaagatctttcttcctgctgcagatccctgcagtgctttatgccagtctgctggtgctttgaatatcaaacatgacagtcacgtgatggagaatgtttgaattttattgctcttttcttggcaggtttatggggaagtgctcttggtaacactgaagtcattagggaatacatttttggtgagtatttggggaacagaaaggtcaaaccctagagatattttatgcaaggagattcacagtacttttcctactcatggcagaagagagacctgtgtgtaattgttctagcaactgcttttcctgacatttattctcatataattgggcagccaggatgaccacagagtggatgagagtacagactcccttggaaggaatgttgctctggtacatgtaagctttgtgacctccgaaaagttacttaacctctctgtgcctcggtttctgcctctgtgccatgcgggtgataataacagtagttatgaatatttgatgagttaattcattgaaagcttgtaggacagtgcctggtagataacggcactcagtaaacattagcaatcattacctggtccctcatttaacatttaacccctttaataccctaagaggcagacgcttttgtcccttccattttgctgagatccaccaagtcgtgggaaggatgcgtgactcacccacactgctggtcagtgagtgcagacgcggggatctataggagaactgggtggtggatctctaggggaatagtgtggtggttctgatccaaagcctgtctgcctggatccacatcccggctctgcttctcctgcactgctcactctggaaagctgcttaaattctctgtgacccaatttccccttcctaaaatggagacaatagtacgtagtcgcagtctcgtatatttgatgtggggtttaaatgacctcatgtatgtaaaatgcttagagccaagcctgacacatgggagtgtttcattacatgttaatcttatttttaggatcattactgagttcacaccctaaaccactcgtcattcatttaatgtatattcatgggacctcctgtgtgccaggcactgtcctagttcttacactttgactttttttgttgtttgtttttttgagacagagttttgctctgttgcccaggctggagtgcagtggtatgatctcagttcactgcaacctccacctcccaggcttaagcaactctcctcccgagtaactgggactacaggcgcgcaccaccgtgcctggctaatttttgtatttttggtagagacaggatttcaccatgttggccaggctggtcttgaactcctgacctcaagtgattcactgcctcagcctcccagtgtgctaggattacaggcataaaccaccacgcccgggctgatgttgttctttgacattggtgttcaccatagcttggttaaaaacaaaactaaaaagggaatctatctatatccaacctccaaatggctaactaaaggtgtgagatgggtctgagtgttacttctccagtgggtctgctaagctttctctctaaaaaacaaaaacaaaattcctgatatgtagtgtttgccaattcctgtggtgtaaatgttcccaccgtggccaacttcaggctaccaacatgaggtcactgagcacagagttggaagagaggtgcaaaattggctctcgagagccattggctgccattggagcccatggctgccatttctattaatgaaatatccctgcaggtcatctgtattttttatattataactagggactttgttgtacagataaacattcctcctgcttctactcttttgcagaccagttaaggaatctgaccctgaaaggtaagcatcctacttcatcatgaatccctgatgataatggggaccgcacacttgcttgaggccagccattgtcctaggaacattacatgtatgattcatttggtgcccatttgaattctttatctggtatttcaaagatttcatcttgatttggatctgttgctggagaggtagtgtgatcttttgggggtgctgtagaaccatgttttgtcatattaccaaagttacttttctgattccttctcatttgagtagactatttcttttaattattcttgaatttatgttggatttgactgtgttttttttttcttttttccgcttaaggatgtgactttaatgtccctagctaattatagcctaatttggtccttggtgctttcaggggtgaagattgtaagagttccttggatatagggagtcttcgtgtgatggctttctcatatgctggttgtagaagcgatgtgctcactgtgtgagcaagttcactgttgcctacagggctggaatggtagaagactcttgaagcttaactcattccccacaaggcatgcaattttttccccagtattttattgactggtttgatggttcaggcttcaggtctgtaggggagtgcataggaagtgattgtggccaaaacatgtgagtaaatgcaacacccaatggtgagcaaaggtcccagccttgacagaggtggctggaggagctctcagtgagttgcatcgagattttttttttttttttttgagacagagtttggctcttgttgcccaggctggaatacaatggcatgatctcagctcaccccacaacctccgcctcccaggttcaaggaattctcctgccgcagcctcctgagtagctgggattgcaggcacttgccaccatgcccagctaattttgtatttttagtagagatggggtttctccgtgttggtcaggctggtctcgatctcccaacctcaggtgatccgcccacctcggcctcccaaagtgctgggattacagccgtgagccaccatgcctggctgtgcaccgtggtcttatcaggcagaagggttggagccacctcagctcccctgccaggtcagccagaaagccatccatctctcagacacactcgtgatccagtgctccagctattcagatcagacgggcacctcttttcatctgtaggaatgttggtgttctgagtagagaggaactgtgaatctgtctcttatgcaagcctaaacctagaggggctcctcctgtggggatgcagtcgccctgatatgttccagaaaggctgtctatagttgtacccatgctgagctcccatgggagaaaccccaactgtgcctgtggcagtggaagagaggggaaagacatccccttatccaagacccttcatgcacaccagggctgtctgatggttgggttagagctgtgggctttccgtgctgagcccagcactgaaactgtgtccctgctgaaagaaacttcccaccagcagaaagatctgattttcaagtcctgctgtccagattcttttgtcccatggggtgttcccttgatgtggtgcactccccattcccctaggataggagtcactgagcaccagactacagtgagtgttattgttcctctgggtctagccacccagtgaagctgccacacttcaggctggttcttgggaatgtctccaaggaatccggtaatgtcccctgtcctcgagactcccagcaatgggaagcagcaccagctctaatgggggtggcaggagagagacacaggctctgtgagattccttgctgatggacagccttagtaggttggcttccttgaatgctagttatagtagtaatgaactgatcatgtggacagactcaggacctcctggttagccagagtggtgcatgcagtggtgatagctgaggacatagagccattttctccttcctgggcccagtgttatcctaccaggagatgctgtcatggactgtgttggttggcctccacccagcaggtggagcaccagctgcagtagtagcagtgggatattcacttgccctatgttgcccagggtggctactcttgtttctcaggcaatgggcagagccacagagttcccaaaagtttccgtcctttgtattaaagccaccagggcgggtggcagggcaaagccaggtgtgggctgggtcaggcagttttgtgctctaactctccctgtgcagggcaagcagcagctcctgtgggtatcagggggtgggggtggttttcagacccatgtgctgataatccagagaggaatgtttctgcctctgctgcacagaagagtttgtgtagggagtggggagtggcaggtggcagtaagccccacgcggatcccacacacttggcgaggcagatcccctcccaccctgttccactggcagtggtgagctaagttccaggcagcctgtgctcagaacttgcaaatgcccccaagtcataagctttccctgcagagatagcaaccactgctctcaggccatgcccctccccatctatcccacctagccatgtgccagggtcctgcacacgtgtctgcagcttgcttttcattcaccccatgtgggtggagaagttcacctccacccacagttatctcatgaaacccagctgggggcttctttcaacctgcgaccacccacctgaactttttggctgaccactgcagggtgccctgtgaggaacaataaggaatggcttccctgggtccatactgggatctgggagtgcatgcagggttcttcccacagctcctacttatattccacgaacctccccaagtcatatcctgcactgaatagggttaaggccttaccccagagactggactttcaggctccctggtgtggtgggggcgtgtgtcctgcaaacagtctttccccatctcacaccctggggactcgcagcccttcacttgagtcacagtataggctgcagcccgtcacttccttcaaagggactgtggattccttcagatttcctgtctaattcctgaatcacttcttgaaaaaaaagttcacagtgtgaatctctacacagtgttttgtccttccaagtgggaggggtatgccagcaatgcctctaatccaacatgtttgctgtcctgctctttcatagtaggacagctaggactttccagaagtgcccccataaatctgcatgggccagagcttgacctccctctagctgcaagggaggctgggaaatatttgcccttcctgcctgtgggctgagaaacgttggcatggaagggagcttgaaatggccttggggtagccagtctacagtgcccggctggctccacccatagaaggttcctgaggacaaatctgtcttgtttactgctctattccaacagtcagaagagtgccgggtgcccactgattgcttcataaatatttatggaatggaagaatgatctttcttcctgctgcagatccctgcagtgctttatgccagtctgctggtgctttgaatatcaaacatgacagtcatgtgatggagaatgtttgaattttattgctattttcttggcaggtttatggagaagggctgttgctaatgctaaaagcattggacaccttatttttggtgagtatttggggaacagaaaggtcaaagcctagagatattttatgcaaggagattcacagtacttttcctgcatgtggcagaaaagaggcctgtgtataatggttctaacaaccacatttcctgacatttattctcatacactgaacattgattatgggcagccaggaagaccacagagtggatgagagtacagacacccttggaaggaatgttgctgtggtacatgtgagctttgtgacctctgaaaagttacctaacctctctgtgcctcagtttctgcctctgtgccatgtgggtgataataatagtagttatgaggattaaatgagttaattcatcaaaagcacataggacagtgtctggtagataaaggcactcagtaaacattagcaatctggctggatgcagtggctgacacccgtaatcgcaacacttgggaggctaaggcgggcggatcatttgaggccaggagttcaggtttctgatcctggccaacaggtgtgtggagctggtgcctgctacttccaggcctggctacaaaaggccttctgtggctctccagctctctcctctcatggaacagacaaggagaccttgtgccaagaggagaagctcttaaacccaggaggcggaggttgcagtgagctgagatcacaccattgcactccagcctgggcaacaagatgcaagcagcctggcccggcgcagtggctcatgcctgtaatcccagcactttgggaggcccaggcggacagatcacttgaggtcaggggttcgagtgcaagctgggtaacatggtgaaaatgcgtctctactaaaaatacaaaaattagccaagtatggtggtgcacgcctgtgatcccagctactcaggaggttgaggcacaagaatcgcttgaaaccaggaggcaaaggctgcagtgagctaagatcacaccactacagtccagtctgggcaacagagcaagactccatcacacacacacacacacacacacacacacacacacacacaaaattggcattcgttacctgttcatcatttaaccctttgaatgacctgaagaagtggatgctgttgtcccctccattttgctgagagccaccgggtcatggaaaggatgcgtgactcacctatgtaactggttggtgagtgcagacacagggatctataggggaatcgtatggtggttctgatccaaagcctgtctgcctgaatccacatcccagctccacctctcatgcgttagtgaccctagaaagctgcttaaattctctgtgaaaaaaattaaaaaataaagaaatgaggggccgggcgcagtggctcacacctgtaatctcagcactttgggaggctgaggtgggcagatcacctgaggtcaggagtttgagaccagcctgaccaacgtggagaaaccccatctctactaaaaatacaaaattagccgggcgtggtggtacatgcctgtaatcccagctacacgggaagctgaggcaggagaatcgcttgaacccaggaggtggaggttgcagtgagctgagatcacaccattgcactccagcctgggcaacaagagtgaaacacagtctcaaaaaaaaaaaaagaaaaaagaaaaagaaaaagaaaaaaaagaaatgaaacaaacaaaaaaaaaaaaaaaaagaaaagaaaatcaacaacaacaacaaaattctctgtgacccaatttctcctttgtaaaatggatacaatagtgcatagccccaatcttgtatatttatatcaaataaatgtaaatatacatcaaatatacaagattgggactatgtactatttgatgtggggtttaaatgacctcatgtatgtaaagtacttagagcaaagcttgacacatgggagtgtcctcttaaatgtcaatattatttttattatgtcttgtattgttagaaaaagcaagccagggccaggcgcggtggctcacgcctgtaatcccagcactttgtgggggccgaggcgggtggatcaccaggtcaggagatcgagaccatcctggctaacatggtgaaactccgtctctactaaaaaatacaaaaaattagccgggcgtagtggcgggcgcctgtagtcccagctactcgggaggctgaggcaggagaatggcgtgaacctgggaggcagagtttgcggtgagccaagatcgagccactgcactccagcctgggcgacagagcgagactccgtctcaaaaaaaaaaaaaaaagaaagaaagaaaaagcaagccgggcacagtggctcacgcctgtaatcccagcactttgggaggttgaggtgggtggatcacttgaggtcaggagtccgagaccagcccagccaacatggtgaaacctcgtttctactaaaaatataaaaattaactgggcatggtggcgggcgcctgtaaccccagctactcgggaggctgaagcaggggaattgctcgaacccgggaggcaggggttgcagtgagccgagatcgcaccactatactccaggctgggcaacagatcgagactgtgtctcaaaaaaaaaaaaaaaaaaaagaaagaaagaaagaaaaagaaaaaaaagcagacaaaatttatttattgacaattcaaaaatttgaaaaagatgaagcagaagcttgacctaaccgacgtgtatcaggacttagctttctatcgcattttcagcacatgtggaaaaattgaattttgatttggtctcaagtaaaaagttataacatgtacaatattttaattataaggatcaacactgctactattaggtaataatatttttaaatattaagatttttttgtttttttttgaatttttacttcaatagcttttggggtacaagtggtttctgttacacgatgaattatgtagtagtaaattctgagactgtagtccacccatcagtgtatgttttagagtatgttgcattcaatatgtagttttttggttttgttttttgtgacagtctcactctgttgcccaggctggagtgcagtagcaagatctcgtctcactgcaacctctgtatcctgggttcaagtgcttctcctgcctcagcctccctagtaggtggaattacaggcacgtaccaccatgcccggctaatttttatatttttagtagagatgaggttttgccatgttggtcaggctggtctcgaacttctgagctcaagcaatctgcccgcctcagcctcccaaagtgctgggattacaggcatgagccaccacacctggccccaatgtgtagtgtttttttgtttttgttcttgttttttgagacggaatttcactcttgttgcccaggctggagtgcaatggagcgatctctgctcaccgcaacctccacctcctgggttcaagccattctcctgcctcaacctcccgagtagctgggattacaggcatgcaccaccatgcctggctaattttgtatttttttagtacagacagggtttctccatgttgctcagactggtctcgaactcctgacctcaggtgatccacctgcctcggcctcccaaagtgccgggattacaggcatgacccaccactcctggccccaatgtgtagttttttatccccacctccctaccctcctctttctgaatctctgaagtccgttatgccactctgtatgcctttgcgtacccatagcttagctcccacttataagtgagaacatatggtttttggttttacattcctgagttactttacttagaatgatggcctccatccaagtttctgcaaaagacattattttattcttttttatggctgagtcatattccatggtgtttatataccacatattctgtatccactcatttgtcaatgggcacttaggtgggttcatatctttttttttttttgagacagtctcactctgtcacccaagctggagtgcagtggcgcgatctcggctcaccgcaagctccgcctcccaggttcacgccattctcctggcccagcctcctgagtagctgggactacaggcacccaccactgcgcccagctaattttttttttttttttttttttgtatttttagtagagaccggtgttagccaggatagtctcgatctcctgacctcatgatccacccgcctcagcctcccaaagtgctgggattacaggcatgagccaccatgctcggctggttccatatctttcaattgtgaattgtgctgctataaacatacatgtgcatgtgtcttttttttttttttttgaggcagagtctcgctctgttgcccaggctggaatgcagtggtgcaatctcactgcaacctccaactcgtgggttcaagtgattctcctgcctcagcctcccaagtagctgggactacagatgtgcaccaccgcatccagctaatttttgtatttttagtagagatggggtttcaccatgttggccaggctggtcttgaacgcctgacctcgagtgatctcccctcctcagcctcccaaagtgttgggattacaggcgtgagccactgcacccagcccacaagtgtctttttcatataatggctgcctttcctttgggtagatacccagtagtgggattgctggatcgaacggtagatctacttttagttctctgaggactctccatactgttttccatagaggttgtactaatttacattcccaccagcagtgtgtgagtgttccatttgcaccgcatccacaccaacgtctatggttttttttgaatttttatcaatggccattcttgtgggagtaagatggtatctcattgtggctttcatttgcgtttctttaatgattagtgatgctgaccatttttttcatatgtttcttggccactggaatatcttcttttgagaaatgtctattcatatcattgggatgcttttcggtgggattattcgttttcttgctgatttctttgagttccttataggttctgtataatcgtcttttgtggatgcctagtttgcaaatatttgctcgcattcagtgggttgtgtgtttactctgataattacttcctttgctgtacagaagctttttaatttactcaggtcccatatatttgtttatttttgagacggagtctcactccatcacccaggcttcagtgcagcagcacgatctcggctcactgcaatctccgcctcccagactcaagcaattctcctgcctcagcctcctgagtagctgggattacaggcatccaacaccatacctggccaatttttgtatttttaatagagatggggtttcgtcatgttggtctggaactcctgacctgaagatccgcccagctgggcctcccagagtgccaggattacaggcgtgagccatcgttcccatatatccatatgtttatttttgtttttgttgcatttgcttttgggctcttggtcatgaactcgttgcctaagccaacatctagaagagtttttttgatgttatcttctagaatttttatggtttctggtcttatatttaagtctttgatgcaaattcacattgaatttgtgagttgatttttgtataaggtgagaaataaggatcgagtttcattctcctacatgtggcttgccagttatcccagcaccatttgttgaataaggtgtcctttcccccactttatgtttttgtttgctttgtcgaagatcacttggctataagtatttggctttatttctgggctctctattctgttccattgttctacatgcctaattttataccagtaccgtgctgttttggtaactataggcttgtagtataatttgattgggtaatgtgatgcctccagatttgttctttttgcttagtctttgctttggctatgagggctcttttttggttcatatggattttgggattgtggctgggcatggtagctcacgtctgtaatcccagcactttgggaggccaaggcgggtggatcacctgaggtcaggagtttgagaccagcctggccaacatggcgaaaccccatctctactacaaatacaaaaattagccaggcatggtgcatgcgcctgtaatcccagctacttgggaggctgagacaggagaatcgcttgaacttgggaagcagaggttgcagtgagccaaaattggccattgcactccagcctgggcaacagagcgagactaagtctcaaaaaaaaaaaaaaaaggattttaggattttttgttctgtgaaaaatgatagtattttgatgggaattacactggacttgtagattgcttttggcagtatggtcattttcacaatattgattctacccatccatgagcatgggatgtgtttccatttgtttgtgtcatctatgatttctttcagcagtgttttgtagttttccttgtagcagtctttcacctccttggttaggtatattcctgagtattttattttatttttttgcagctgttgtaaaaggggttgagttcttgatttgaatctcagcttggtcattgttggtgtatagcagtgctactgtttgtgtacattgattttgtatcctgaaactctactgaattcattcatcagacctaggagctttttggatgagtctttagggttttctaggtgtacaatcatatcatcagtgaacactaacagtttgacttcctctttactggtttggatacccttcatttctttctcttgtctgatggctgtggctaggacttccagtactatgttgaatacaagtgataagagtgggcattcttgtcttattgcagttctcagggggaatgctttaaacttttccctgttcagtgtaatgttggctgtgggtttgtcatagatggcttttattacattgaagtatgtctcttgtataccgattttgttgagggctttaatcataaagggatgtgggattttgtgaaatgcttctgcatctcctatgatttttgtttttaattctgtttctgtgatatatcacatttgttgacttgcatatgttaagccatccctgcattcctagtatgaaacccacttgatcacatcatggcaaatttcaagctaccaacatgaggtcagcgagcacagagttggaagacgggtacaaaattagctctccagaacccgtatcaacagactccaacccatggctgccatttctattaaagagacgtcgctgcaggtaatctgtattttctataactagtgactttacagttaaacattccccctgcctctgctcttttgcagcccgattactgaggctgcaagaaagttcacaaggggaacatcctcccccagaaggtaagcatcctactttgccatgaatccctaatgatagtgtggactgcacactggcttgaagccagccattgtcctaaaaactttacgtgtctgattcatgtggtgctcctttgggaatggagaggagcatggactctcccaggtgcctgaggccacgcagccaggaggggcaggatcggagttcaaactgacactctgtgaaaaatgatagtattttgataggaattacactggacttgtagattgcttttggcagtatggtcattttcacaatattgattctacccatccatgagcatgggatgtgtttccatttgtttgtgtcatctatgatttctttcagcagtgttttgtagttttccttgtagcagtctttcacctccttggttaggtatattcctgagtactttattttatttttttgcagctgttgtaaaaggggttgagttcttgatttgaatctcagcttggtcattgttggtgtatagcagtgctactgatttgtgtacattgattttgtatcctgaaactctactgaattcattcattagacctaggagctttttggatgagtctaaccataggatccatgtacatagtcgtcagatataccctaggtatgcctaggatccaagtgtcagaggcagaaaatgggaacagcctgaggcaattagcaaattgagaggaaaaatacttcccaaaactacataggttgggagtcatgaaggaatcagacttgacccatggtgggagtacggagaacaagaacaaagtatcagatgaattctgtatggagaagttagattatattatggaggagactatatttgttcaggagaggctatgctgcgcaaagaaaccacaaattgctatagcttaagacacaaagggtttatattttgcttacccaaaaagcgatatgggttgagtgttcctccagggcaacttggctccatgtggggacttaggcatccaagctgtttgcgtcttttttttcctttccttttcttttttcttttttttttttggagacagagtctagccgtgtcacccaggctagagtgcagtggcataatctcagctcactgcaacctctgccttccaggttcaagctattctcctgccccagactcctgaatagctgggattacaggcaactgccaccacacctggctaatttttgtatttttagtagagacgagttttcactacattacccaggctactctcgaactcctgacctcaagtgatctgcctgcctgggcctcccaaagtgctgggattacaggtgtgagccaccgcgctgggccaagctgcttgcatctcgttgcttctcctcttggcacaaggtctccttgtctgttccatgagaggagagagctggagtgccacagaaggccttttgtagccaggcctggaagtattgggcaccagctccacacacctcctgttggccaggatcagtcacatggccccaacctaactacagcagaggctgacaaagatggtcttccttccagttgtggaagatgcaagtgtggctttttcacaggtcaacagtcaggtacagagtgaaggtaggtcctgagcacagcccttcatccacttcatgcctccctccctgttttagttgtgaaggctgccagaacaaagtgccatacataggctggctggcttagcaacaacagagattaatttctcagttctggaggctggaagcccaagatcagagtaccagtagggttggattctggggaaccctcttctgggttgcagagagccaacttcttgccacatggcgggctttaatgttgttttttgacatcagcattcaccatatgctggttatagacaagtctggaaggagaatctatctccaacctgcaaatggctaactaatgttgtgggatggtaggctggtgattgtaccactgcactccagcctggtgacagagcgacaacctgtctcaacaacaacaacaacaaaaaagaaatggcaaccccaaggtgatggtattaagagatggggcctttgggaggtgttgagaccatgagggtggagccctcttgatttggattaatcccttataaaagaagcctcagagagctcactccaaggaatgcggtgaaggttgaagtgtagaatttatgcaaaatgccaagatgagcctggcaggtgacgttctcagcaaacgtgagcagagctattatcagtgtgtgtgtgtgagagagagagagttgaacatcatctaattcatgagtgtggataaaaataagaggggatgccaggcatgatagctcaatgcctgtaatcccagcactttgggaggctgaggggggtggatcacttgaggtcaggagttcgagaccagcctggccaacatggtaaaaccccatcagtactaaaaatacaaaaattagccgggcctggtggtggtgcgtgcctgtagtcccagatactccagaggctgagccaggggaatttcttgaaactgggaggcagaggttgcagtgagctgagattgccccattgcactccagcctgggcaacagagcaatactctgtctcaaataaataaataaataaataaataaataaataaataaataaataaatgggagactttgcctccaaccctgaagaaaataagcgtgcaaaagatgagtagaggtggaggcagagatgaaggagctagaaaaaagaggccagaaagtcagagagagtgaggtaacatgggggtcagcagaaggcaaggggagagagggtcacctggagaaggaggtcacctcaggaggaaccgcagggcattgcagaagatgaggcagagcagggtctgtgatgttcttggtagggtacttggacagtgtctgagaccacctggatttcttgacgtagatgaaggcggtgagcctgaacacacctggctgactgagatgctcgagaattggaccaggacctccctggaaaagcaggagcagccccatgaggaccccgaaaggaaaggtaccatgtgtagtgtgataagtgtcatcaacagtaagtgccaccaaccttctcccccctcttgctcttccccacccctgtgggccagtcctgcaggggacatgaccagatgtcccactggtacagtttggatatttgttcccttccacatctcatgttggaatgtaatcccccaatgtaaattagttcaaccattgtaggagacagtgtggaattcctcaaggatctagatccagaaatactatttggcccagcaatcccattactgggtatatgcccaaaggaatgtaaatcattctgttagaaagatacaggcacatgtatgttcactgcagcactattcacaatatcaaagacatggaatcaacccaaatgcccatcagtgatagactggataaagaaaatgtggtacatatacaccatggaatactatgcagccagaaaaaggaacaagatcatgtcctctgcagggatatgggtggagctggaagtcattatcctcagcaaactattgcaggaacagaaaaccaaacaccacatgttctcacttataagtgggagctgaatgatgagaacacatggacgcagggaggggaacaacacacactggggcctgttgggggcgggtggggagaagaagagcaccaggaaaattagctaatgcatgtggggcttaatacctatgtgatgggttgataggtgcagcaaaccgccatggcacatgtttacctgtgtaacaaatctacacgtcctgcacatgtgtcccggaacttaaaattaaattaaattaaattaaattaaaagaaaaagaaatgtaatccccagtgttggaggtggggcctggtgggaggtgattggatcatgggggcggatccctcatgaatggcttagcgtcatcctcttggtgattagtaagtgcttgctctgagttcatgtgagatacggttgtttagaagtgtgtggcaccttccccctcgctctcttgctcctgctctcggcaagtgatgtgcctgctccccattcactttccatcatgattggaagcttcctgaggccccaccagaagcagatgccagcaccacgcttcctgtacagcatccagaactgtgagacaattaaacctcttttctttataaattatccaacctcaggtacttctttatagtaatgcaagaatggactgatacgcccaccctctatccacccaaccggccatccatccatctaggatgtcttgagtcattagcatgaaataataactctcctactagcaggctgggggtaggggtgacaaaggggaaatgtcagaccaagtgcctgcctggaggactcatggtctagaggacgagatggagaatagacaggtaagccaaccacaggcaagtccatccccgactgggctaatttctatggagagggctgggtgcagtggctcacacctgtaatcccagcactttgggaggctgaggcaggaagatcacttgagcccaggagttcaaaaccagcttgggcaacatagcaagaccccatctctacaaaattttttgtaaaaaattagctggacatggtagtgcgttcccatggtcccagctactcaggaggctgaggcaggaggatcacttgagcccaagaggtcgaggctgtagtgaactatgattgtgccactgcattccagcctgggtgacagagcaagaccctgtctcgaaaaaataataaataagtaaattatatggagagacaaggagaggcgagagcaggtatccggtgaaaaattctgagagtgaagtagcgtggatgagggacaatgaagacagttggtcgctgaagccactgccttcctgagatgacccaggtacagccagtctcacccccagacatccaacctctcacctctgtgatgacccggtgtccaggcacagacacacccagagtcctcctgaccagctcatcagcagctcaccaaggaaaggaaatcaaggtgtactctcttcagactctagatttcccttcctcctccttttattcatgttacataaattcctgtttttatctctgttggatgaaatcagtctattctctggtttcctttgtctacaatttaaagagggagccgactattaacttgatgtctctgagctattgttggccaagctccccttagatgggattaatgaagaagcctccttttccaaggtgatagctcagaagcaacttgaagaatgagtgacaatgagcctaccaagtggaaatgtggggaaagtcagccagagttcatctactgacttcagtctggcagatgagaggcttgggtttacccctccggtgggtaatggagagagatggaatgtgccacacgaagcctcactatgactttctataatgcctggctcctgtgctgaaatgagaacatgcatcctagccggccatggtggtgcgtgcacctgtagtcccagctattcggggaggctgaggtgggaggattccttaagcccaggagttggaggctgcagtgagctatgaatgcaccactgcactcagagtgagacccccatcccttaaaaagttttcttttaaaaaacgtacttttttttgttttgttttttgtttttgtttgtttgtttgagatggagtctcgctctgtcacccaagctggagtgcggtggtgcaatcttggctcactgcaacctctgcctcccgggttcaagcgattctcctgcctcagcctcccgagtagctgggaccacaggcatgcaccaccacacccggctaatttttgtaattttagtagagacagggtttcatcatattggccaggctggtcttgaactcctgaccttgtgatccgcccacctcaggctcccaaagtgctgggattacagatgtgagccactgtgcccggccaattcttaacttactataagatatacttgagcccaggtattcaagactagcctggaaaacactgtgagacctcatcttttttaaacaaaattaataaatagataaaacatttaaaaaagccaggtgtgatggctcacgcctgtagtcccagctactcaggaggctgaggcgggagggtcgcttgaggccaggagttcaagaccagcaagcctgggcaacgtagtgagacctcctctctaaaataaataaataaaaatataagatagaatggccgggtgtggtggctcatggctttaatcccagcactttgagaggccaaggtgggcggatcgcttgaggtcaggagcttgagaccagcctggccaacatggcaaactctgtctctactaaaaatgcaaaaatacaaaattcgccgggcgtggtggcacatgcctgtaatcctagctacttgggaggctgaggcaggagaatcgcttgaacccgggaggcggaggttgcagtgagctgagatcacgccattgcactccagcctgggcaacaagagtgaaactctgtctcaaaaaaaaagaagaagtatggagtcctcaggccacatttagttttctttaacatgttaaatattaaagggctatcaaagcaatgtaggtgtgatttgcttttctgctgctaaactcttgtagaagttaatatttattaagtgcctactatttgctggatgtgttaggtttcttcagagaaacagagccaataagatatctatctatctatatctacctatctatgtctctgtctgcccaaatctatgcatctatatctatgtatttatagctatctatctctatctatctaactagagatatttattttaacaaattggctcatgggattgtgaagatgacaagtccaaaatccatggggcaggccaacaggcggaaaccgagacaggattttttaaaatttaatttaatttaaagtttgaggatacatgtgcaggacatgcaggtttgttacccaggtaaacgtatgccatggtggtttgctgcacttatcaacccatcacctagatattaagccccacatgcattagctgtttaccctgatgttttccctcccaccgccccctcaacaggccccagtgtgtgttgttcccctccctgtgtccatatattctcatcattcagctgccacttataagtgagaacatgtggtgtttggttttctgttcctgcattagtttgctgaggataatggcttccagctccatccctgtccctgcaaaggacatgatcttgttcctttttctggctgcatagtattccatggtgtatatgtgccacattttccttatccagtctaccattgatgggtatatttggttgattccatgtctttgctattgtgaatagtgctgcaatgagcatacgcatgcatgaggcagaatttgacgctccagtctggaggtagaatttcttcttctctagaaactgttttgccctcaaagccttcaactgagtagatgagacccacccacattactgagaataatcttcttgaagtcaactgattttagctgtcaaccacatctacaaaataccttcacagccacatctaggctagtgtttgattaaataactggttactgtggcccagcctagttgacatgttaaaccatcctcccaacatcctaagtgctataggcaggctcttacttattcctcataaatctataagggataggtgttactctcttcctggttttacagatgagaacagagatgttaagtaacttgctcaggggcccggtgcagtggctcatgtttgtaatcctagcactttgggaggccgaagtgggtgaatcacctgaggtcaggagttcgagaccagcctgaccaacatagcgaaaccccgtctctactacaaatacaaaaaaatatttagccgggcgtagtggtgggtgcctgtggtcctagctatttgggaggctgaggcaggagaatcacttgagcgcaggaggcggaggttgcagtgagccgagattgcaccactgcactacagcctgggtgacagagcaagactgtctcaagaaaaaataaataaataaaagtaacttgctcagggtcacacagctaatgagtgatgaagtcaaattcaaatcagcatctagctcaagcacccacctccctactagctttgctctcttgccactctgcccctgctgttcagagaaaggattggagctgaaaaaccaggaagagggaaatcagagggggaggcagtgttgcatcctggatggaaaagatgctgcataaggtactggcagatgagattgggaggagcagagacactgaagaggaggtggaattggcaggtcttggtgatagtccagggtgagggtgaggaagaggcaggcgtctgggataatgacctggtttatccctgactgacttggcagcctcttgggctggggaagggagcacgggaaagtgtgctgggcattttggaacagctcctggaacattctgcgtcgttctcccccatgaacctaaagagaacaagctcatttccccagatacacaggtgatcatacagtcattaaatcgccatcttttccttgccaactcccccaaccccaatggctcaaagtcatctcacctgtggctcaatgatagatgctggatctgacggccaggacccccaggcccctgtatgccaacctttcccagctcaccagatttgtcagctctgctgccctaacaaaagttgaagtggggtggcttcaactataggcttttatttcctcaccgtttttttttttttttttgagatggggtttcaccatgttgcccaggctggtctcgaacccctgacctcaagtgacccacccacctgggcctcccagagtgctggaattacagatgtgagtcactgtgcccagccttattttcttacaattctgcaggcaggaagtccaagatcaaggtgccagtggggtcagtttctcctgaggcctctctccatggcttgcagagggatggccgccttctcaccgcatcctctcagcccagcctttcctcagtgcacacgcattcttggtattcttggtgtcttcctttttttcttttttttttttttttagatacaaggtctcccttgtatctaaatgatctgagtgatacaagtgaggctggaatgcccaggctggagtgcagtggcacaatcatacatagttcacttcagccttgaactactgggttcaagtgatcctcctgcctcagccttctgaatagctgggaccacaggcatgcattaatatgcccagctaatttgtttattttattttatttttgtaaagatgtggtctcgctctcttgcccaagctggtctcaaacttctgggctcaagcaatcctcccacctcggcttccctaagtcctgggattactctggtgcctggcactctttctcttctcataaagaccccagtcctattgaattaggatcccactctcatgacctcagttatcctgaatgacccccccacttttttttttttttttttttttgagatggagtctcgctccgtcatcaggctggagttcagtggcacgatctcggctcacttcagcctctgcctcccaggttcaagcgattctcctgcctcagcctccccagtagctgggactacaggcatgcgccaccaccacgcccagctaatttttgtatttttagtagagacagggtttcaccatgttggccaggatggtctcgatctcttgatatggtgatccttctgcctcggcctcccaaagtgctgggatgactggcgtgagccaacgcgccggccctgaatgacctctttaaaagtcctgtctccagatacaaccccatgggggatgagggcttccacatatgactttggtgggggcagaaaccactcagtctcctgaactcaccttggctgtctcggcttctttccctaggctcactcagtaacttgatggattttgtgaagaaaacaggcatttgcgcttcaaagtgggaatgggggaccactcacaacttcctgtacaaacacggtgagaagaccctcttcccaccgccctggtctgtccttgcgtgtgaatgggctggagtaggggaagggggtgggcctgaaacaatcccaggctggtccttccccagagctttggaggggggtggtgtcaaagggcccagggatctgattaggggaactttcgctcagtggtgtggtccatactgaaaaatgtgtggcctcgctgcgagtcccagtcatcgtgaaaagcctcactgatggctttctctggttttgcaaaaatgcaaaaaaccctaatttcttgtcagctagtcctaggacctggtcttcaaaaacacttgtatgggctgggcgcagtggctcatgcctgtaatcccagcactttgggaggctgaggcgggcggatcacttgaggtcaggagttcaagactagcttggccaacatggtaaaaccctgtccctactaaaaatacaaaaattagccggacagggtggcgggtgcctgtagtcccagctactcaggaggctgaggcaggagaatcgtttgaacccaggaggcagaggttgcagtgagccgcgatcatcccactgcactccagcctggcaacagagcgagacaccatctaaaaaaaaaaaaaacaacacacatttgtatgggttttcccttcaggggactgaccctctcattcaggtggaattgatgtcagactcctgggaactcacactgaggccatttaatagtctccataagctccaatgttcatagctggtggagatcctctcctatgaccatgccaatccctgcaccactcatgtatgtgtatgtgtgtgtgtgtgtgtgtgtgtgtgtgtgtcttgctctgttgcccaggtgggaatgcagtggtgcaatcatggctcactgcagcctcagcctccccagctcaagcaatcctcccatttcagcctcccgaatagctgggaacacaggcacacagcaccatgcctggctaatttttctttttctttttcatagagatggggtctcactatgttgcccagactgatcttgaacccctgggctcaagcgatcctcccacctcagcctcccaaagtgctgggattacaggtgtgagccaccccacacctggccttccccactcttttgttacaagactatcgtgaacatctttatgtttgtggtcctgttgcccttgtgcaaatcgagaaaaggtgcatcttccaggggggtgaattccaaaatgtgcccccctggccagggctgtgtgtggcctgggaagggaaccctggctggatgtcagtcctgctcacctctcctggggtgcttcctacaaggcacacaggacttcagctgtgtctgcgcaccatgccatgcagctgccgggtcttatggcctcggaatacaccatcaagcatcaagtcactggatcatggcgatgagtgttttagcatcaaatttctccctgaaggggttggatgaagtcgctttctcagtagcaatatatgagagtgtaaaccaaaaataaaattctaagccccccaccacccaaccatctgaatagacctctcctgtcagccagggcactccaaagttaacctgaaaaatgggttcagtccctgatgggaagtgggggtcggacatgcctccttataccctcctcccttttggaattcaggaaaagctgactagcagtcatgtcaacacaaatttttttttttttttttgagatggagttttgctctttttgcccaggctggagtgcaatggcgcgatctcagctcaccgcaacctccgcctcctgggtttaagcgattctcctgcctcccgagtagctgggattacaggcatgcgccaccacgcctggctaattttgtatttttagtagagacagggtttctccatgttggtcaggctggtctcaaactcctgacctcgtgatctacccaccttggcctcccaaagtgttgggattacaggcgtgagccacctcaacacagattttaagtctgataagaaacatttacattctgttctctctgaagcctgctacctggaggcatcatatacgtgataaaactttggtctccacaaccccttgtcataacccagacattcctttctattgctaataactctttaaaccaatagccaatcagatatttttattttattttccatatatttatttattaattatttttatttatttatttatttattttgcgatggagtctcgctctgtcacccaggctgcagtacagtggtacaatcttggctcactgcaaccaccacctcagcctcctgagtagctgggattacaggcacatgtcaccatgctcaactgatttttgtatttttagtagagacagggtttcaccacattggctaggctggtctcaaactcctaacctcaaatgatctgcccaccttggcctcccaaagtgctgggattataggtgcacaggtgtgagccactgtgcccaaccgtcaatcagaaaactttaaatctacctataacctggaagcccccccccgacccctcctcacccctcacctctacccctccatgacttcaagtcgtctcacctttctggaccgaaccaaggtatatcttagatatatttgattgatgtctcatatctccctaaaatgtataaacctaggctgtgccccaaccacctaggccacatgttctcaggatctcctgaggactgtgtcacgggccattggtcactcacatttggctcagaataaacctcttcaaatattttccagagtttgactcttttcatcagcaagaggaaccattcccagaggtactgtcttagtctgctcaggctgctgtgacaaaatcccacagactgggtgacttaaacgacagacatttattttctcacagttctcaaggctggaagtccaaaatcaagttgtctgtggggtgagttctttctgaggactctctctgtgatttgcagacagccaccttctcatatcctcgtatggtctttgctccatgtgtgtctctgttctaatcccctcttcttagaagagcactagtcattctattggaatgtttcaaagttttatcatgcagatgtgtgagaggcattggaaccagagtgactctatcttgaatgagggctaggaaaaatgaggctcagccttgctgggctgtatccccaggaagttaggcattcctagcctctagatggttatggttaagggaacagattcataatgtttactaaacagactcagacccaggaatgtcctgatatcctgatatcttgagaacagacgcattcctaattttgctttaaaaataataatataagttcttgtaaaatatagtaattatggtttttggttttttttttttttgagacagagttttgctctttgttgcccaggctagagtgcagtggcacaatctcagattactgcaacctccgcctcccgggttcaagcgattctcctgcctcagcctcccgagtagctgagattacaggcaggtgccaccacgcctggctaatttttgtgtttttagtagagacaggatttcaccatgttggtcaggctggtcttgaactcctgacctcaggtgatccacccaccttggcctcccaaagtgctgggattacaggcgtgagccaccgtgcccggccaaaatagagtaattatgaaaattaatcctttatcacaaatacttgtagcagagcacatctccccatgtttttttgttgttgttgttttcctatatataacaaaaggaggaggtggttgcatttctcctcttactttccgtaacaccctactctgtggagtaacgattctttcacccctttgctttcttaacagacttgctttcgctttgcactgtggactcaccctgaattctttcttgtatgagatccaagaaccctttcttggggtctggatcaggacccctttccagtaactgatgaaggctccaggtagcaagcttcagagagaatagattgtaaatgattcttgtcagacttaagctctgggtggatattaaatgctggtcagctttccttaaatccccaaagggaggagggcatcgtgaggcatgtctgaccctcccttcctgtcacggccagaactaggttttcaggttaactctggggtgccctggccaagaggaagggttcattcagatggttggggtggtgttgtgggggggtaggagttggggagggtgttggcggggggacgggagggatgggggtgggggggaggggcttatcattttatttttggtttacgctgtgaaaggaaaataaatctcgggaccccaaaatcaccaagttaaagggaaaagtcaagctgggaactgcccagggcaaacctgcctcccattctattcaaagtcaccctctgctcactgagataaatgcgtatctgattgcctccagttggaaaggctaatggaaactctaaagaatgttggccggcccgtggctcacgcctgtaatgccagcactttgggaggcagaagcgggtagatcacgaggtcaggagttcaagaccagccttgccaagatggggaaaccttgtctctactagaaatacaaaaattagctcagcatggtggcgggtgcctgtaatcccagctacttgggaggctgaggcagagaatcacttgaagccaggaggtggaggttgcagtgagtggagattgcgccactgcactcccgcctgggcaacagaacgagactccttctcaaaaaaaaagaatgcaaccattcacttcttatctacctgtgacctggaagccccctccctgctttgagttgtcccacctttccagaccgaaccagtgttcatcttacatatattgacatctcgggtcttcctaaaatgtctaaaccaagctgtgccccaaccgccttgggcacatgtcatcatgacctcctgaggctgtgtcacggttgtgcatccttaaccttggcaaaataaactttctacactgaccgagacctgtctcagaaacattgggttaacaacactctcacatattgctgctgagaaggcagcttcatttggaacttcacgccaaaaaccccattttaccttaattacctctttaaagaccctgtctccaaatacagtcacattctgaggtactggaggtaagagcttcaacatgtgtttgtctgtttatttgtttatttatttgagatagagtctcgctctgtcacccaggctggagtgcagtggcgcgatctcagctcactgcaacctccggctcatgggttcaagtgatcctcctgcctcagcctcccaagtagctgtgattacaggcacccgccaccacgcctggctaattttgatatttttagtagagacagggtttcactgtgttggccaggctgatcttgaactcctgacctcaagtgatccacctgcctcagcccccaaagtgctgggatttcaggtgtgaggcaccgcacccagccagggcttcaacatatgaatctgggaagagagagaagtcagctcctagttggcaacctcacaactgctgtctacactgacaacgatcattttcccatccccctctctgccttccatttccaagtcttgctttcagtccccagaagcagctgatcctctttcttcctgggcaccacaggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgaggtaatcgagaagggctttggggccggtcctgggtgggaggtgggctgcggcgaagctgactttgcggaggaactgaggacgcgggctgggaagcgggcaatggggaggtgctggctgggaagtccagagagccaaatcaactcacccatcgctcccgaagcacccgcggtcggccacatccaacgaacttctgatccaaagccatcccagaccttcccgggcccctcttcctggcagatgactctccccgcttctgcgtcctgcctgcccattcataccagtttgaactgcaacagcctagctcctcacctgtgcacctccttccccgggtgtgcacgtctccagccccgagcgcgtgtcttcctgctcatctgggtttcctgggcaaatagtggccctcaataaatgtttgctgagtgagaacatatgcaagtatatttgtcttagtacatattgcaccttcccagtggccactaggatccgttctccctgccttcatatcccagctctgccacttaccagctgtgtggcctgatccaatgtgcgtaacttctgtgcatgtcggtttcctcagctgtaaaattgggctaacgatggctccaccaggagttgttctgtggattaaattaatacttgttaatacatgtgaagtgcttagcacagtatctgccacttactgtggggtttataaacattttcctcccctcccttcccctcccctcatggcctcctttcgagactgggtcttatggtgtgatcatagctcactgcagcctcaacctcctgggctcaagcgatcctcccacctcaccctcccaagtagctgggactgcaggcacacaccaccacaccaggctagttttctaaattgttttagagacagggtcttgctatgttgcccaggctggtcttgaactcctggcctcaagcgattctcccaccacccaaggctaggattacaggcacaagccgccctgcccagctattttattaaaaaatatatacacctacataatatataactatatctattacatgatacataccaatacatagtagtatatataaaataatcatggtaaaacatatcatctattatatttatgtgtaatgtaatatatatttatattcacacacttctatcagtttacattctgtaatatgaattaggaacatccatcctcctccccataccatgatccagaaccaacttgtcaccatctttctagacccttggcccaggaatacccaggctttctggtcttaggatttctgctgaaataaatatcccaagacaatatgataaaggtggaatgagatatcaaggtcttgggagtccttttctgccaaatctctgctgcatgaccccgagcgataggcttaacctctgaacctcagttttctcatcctgaaaatgggaatcacatcatctggctcgcaggagatctgcagagtctctgcaccatgcctggtccatagctggtgttctggattaacaacaatgcttatctggtgatgatgagaatagcaagagtaataggaagaaaaccggcagcatttgttaaacttcaatcaaagacgacttcagagacctaagctgtccactacagtggttgccggccacatgtggcacttgaggacttgaaatgtgcctggcccaagttgaagtgtgctatgaagataaaatacacctcggattttaatgaccgagtatggaaaatgcatgtcaaagaccttattcgtaattggtatattgacatactaggcagggctctccagagggacagaaccaataggatctatgtctagatgaaagggagtttcaggatcacaaggtggagtcctacaataggccgtctgcgagctgaggaagaaacaaaccaatagtggctcagtccgagtccgaaagcctcaaaagtagggaagcccagccaggcctggtggctcacgcctgtaatctcagcattttgggaggccgaggcgggtggatcagaagatcaggagttcgagaccagcctggtcaacctggtgaaatcccgtctctactaaaaatacaaaaaaattagctgggcgtggtggcaggtgcctgtaatcccagctactcgggaggctgaggcaggagaatcacttgaacccaggaggcggaggttgcagtgaaccaagattgtgccattgcactccagcctggtgaacaagagcaaaattccatctcaaaaaaaaaaaaaaaaaaaaagtagggaagcccacagtgcagccttcagtctgtagccaaaggccgtagagcccctggcgagccactggtgtaagtctaagggtccaaaggccaaaaaacctggagtgtgatgttcaagggcaggaagtatccagcacaggagaaagatgaaagccagaggacccagcaagccagcttctcccaccttcttctgtctgctttgttctagtcacactggcagccaattggagggtgtccgcccacactgtgggtgagtcttcctctcctagtccactgactcaaatgttcatctcctctgacagcaccctcagagacacatccggaaacaataccagctttccaggcacccttcaatcaagtcgacacctaatattcaccatcacaattgattacacatcgaggcaatcacacttttgacatattgcatgagatgaaactttttcctacaaattgggtggttacaaagtaataaacagaattttttttttttttttgagacagagtctcgctctatcacataggctggagtgcagtggcacaatctcggctcactgcaacctccacctcctgggttcaagcaattctcctgcctcagcctcccgagtagctgagattacaggcatgcgccaccacacccagctaatttttgtatttttagtagagacggggtttcaccatgttggccaggctggtcttgaactcctgaccttgtgatctgcccgcctcggcctcccaaagtgcagggattacaggcgtgagccaccacgcccggccaataaacagaaatttaagcaagacatatctgtaacaatttaacagaacctgattgtctaagttttttttcatttttctcaaattcatctttaattctttccatgatggggcttataaggaaactaaccaacatgtagctactatagttgaatgtcaaatcttttttttttttttgagatggagtcttctgtgtcgcccaggctggtgtgctgtggtgcgatcttggctcactgcaaccttcgcctcccgggttcaagtgattctcttgcctcagcctcctgagtagctgggattacaggcgcccgccaccatgcccggctaatttctgtatttttagtagagacggggttttgccattttggccaggctggtcttgaactcctgacctcaggtgatccgcccacctcagccttccaaagtgctgggattataggcatgagccactgtgcccagctgaatgtcaaatctttagaaggtacttatgacagtaaattcctctgtaatacaggtatgaagcaccttcatgatatttctgttttatgtgtagaaaagtggctgggtacggtggctcactcctgtaatctcagtgctttgggaggccaaggtgggaggatcacttgagatcagcaatttgagaccagcctgggcaacatagcaagaccccatctccacacaaattttttttttttttgagacggagtttcgctcttgttgcccgggctggagtgcaatggcacgatatcggcttgccacaacctccaccttccaggttcaagcgattctcctgcctcagcctcacaagtagctaggattacaggcatgcgccaccacacccagctaatttttgtatttttagtagagatgggattgctccatgttggtcaggctggtcttgaactcccgacctcaggtgatctgcccacctcagcctcccaaagtgctgggattacaggcgtgagccaccacacccggccaaaaaaattttttttgattagctgggcatggtggctcacgcctgtagtcccagctacttaggaggttgagatgggataacctgagtctaggagcttgaggctgcagtgagccatgattgcaccactgcactccagcctgggcgacacagcaagatcctgtctctaaagataagtatatgtagaaaactgttagactcaaatattcaactcaatataaaataagaagaagccgggtgcggtggctcacacctgtaatcccagcactttgggaggtagaggcaggtggatcacctgaggtcaggtgtttgagaccagcctggccaacatggcgaaaccctgtctctactaaaaatacaaaaattagccaggcatggtggcacgtgcctgtaatcccagctgctagtggggctgaggcaggagaatcgcttgaatctgggaggcggaggttgcaatgagccaagatcccgccactgcactccagcctgggcaacagagcgagactctgtcaaaaaaaaaaaaaaaaaaaaaaaaaagaagaagaagaagaagaagaagaagaaacacttgttgagactgcatctccttttgctaatgagtggtttctagttgtaatatcactcctctgaataaagaagccacctttgagtacataaggaaaaataaccacatgttaaaaggataagacattactccgacatctctactgggccatctcttcctctaacacttcagaaacttagaaatttaaaatattcttacgttaactgcaagaacaagataaaggagaaatgccctttttcttgagatcacaactatgaagtcatatgcttatgcaacttctgcatttgtgtgcaaaacacaaacacactgatctttttttaacttttaagttcaggggttcaagtacaggtttgttccataggtaaacttgtgtcctggggatttgttgtaccgattatttcatcgccccagtattaagcctagtacccattagttatttctgctgaccctctccttcctcccgctctccacccaacactaggccccagtgtgtgttgttctcctctgtgtgtccatgtgttctcatcattcagctcccacttagaagtgagaacatgcagtatttggttttctgttcctggaaacacatttatacatttatctttttttttttttttttttttgagacagagtctcgttcttgttgcccaggctggagtgcagtggtgctatctgggctcactgcaatctctgcctcccatgttcaagcgattctcctgtctcagcctcccaagtagctaggactacaggcatgtgccaccatgcccggctaattttttgtaattttagtagagatggggtttcactgtgttagccaggatggtctcgatctcctgacctcgtgatccacccacctcagcctcccaaagtgctgggattataggcatgagccatgagccaccatgcccagcctctttcttgctcttgtcacccaggttggagtgcaatggcgctatctgggctcactgcaacctctgcctcccgggttcaagcgattctcctgtctcagcctcccaagtagctgggattacaggcacctgctaacatgcctggctaatttttgtatttttagtagagacggggtttcaccatgttggccaggttggtctcaaactcctgacctcaggtgatctgcccgccttggcctcccaaagtgctgggattacagacatgagccaccacgcctggcccgcattgatcttaattctccttgcttagttttgtcagtcagcttgcaggacttaacagatgcctttctaagacacagagactgagatgtgttttatgtaagtttagtaacctcagtgctacagtaatgagacatgcagtgtccttttgctctggttcaggacagcacggaaggaggccacaggaaagagaataaatgaaacttgttacaactgagaaactacttctcattaagtttccccatggtgtcacctttatttaatatttatttttaaaattaatttctcctacttctttttactttcttcaagtgcagcaagtagacaattgaaaagtacctttacggccgggcgcggtggctcatgcctgtaatcccagcactttgggagactgagacgagcggatcacctgaggatcaccaacctgaccaacatggagaaaccctgtctctactaaatatatgaaattagccgggcgtggtggagcatgtctgtaatcccagctactcgggaggcaggagaatcgcttggaccagggaggcggaggttgcagtgagctgagatcatgccattgcactccagcctgggcaacaagagtgaaactctgcctcaaaaataagaaaagaaaagtaccttcacggtgacattatatttctgttacacagtgatgatggagaatatctcatttatcttccaaatacccctgtgaggtggctattacagagatcctttgcagaggtgatgagatgcacccataccacatatctcgttgggctcctgggctcaaatgatcttcccatctcagcttcctgagtagctagggctacaggtgcacgcccccatgcctggctaattgaaatatatatatatatatatatactgtagagatgaggtctccaacatctttctgtggcagagctgggattcaaagcctcatctaggcaccattttccttgccctctgagtcccgcagcccccagccccaaaggttactctctaacctcgcgaatgttgtctctaggtgggctggggagtgcgggtgatggcagaggcttactctttcccttacagaagatgttgtccctgtccaagctgacccttgctctgttgtgtgtctgggctgttagctgaggtcccattgggtctccaggccccaggggtcttctggaggggtcttctggagaggtcttgcaaccatttcttattgcctccttctcagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtaggtgcaggggaggagcaggtgagaagccacctgtattagtccatgctcacactgctaataaaaacatacctgagactgggtaatttacaaaggaagaaggtttaattgactcacagttcagcatggattgagaggcctcaggaaacttacagtcatggtggaaagcgaaggccaagcaagtcaccttcttcacaaggcggcaggaaggagaagtgagtgccagcagggcaattgccagatgcttataaaatcatcagatcagccgggcgcggtggctcatgcctgtaatcccagcactttgggaggctgaggcgggcggatcacaaggtcaggagattgagaccatcctggctaacacagtgaaaccccatctctactaaaaatacaacaacaaaaaaaaataaattgctgggcttggtggtgcgtgcctgtaatcccagctactcaggaggctgaggcaggagaatcgcttgaacctgggaggcggaggttgcagtgagctgagatcgcgctcctgcactccagcctggggacagagcaagactccttctcaaataaataaataaatacataccatcaggtctcgtgagaactcaactcactgtcacgagaacagcatgagggtaaccacttccatgcttcaattacctcccacgacacttggggattatgggaactacaattcaagatgagatttgggtggggacacagccaaaccatatcaccaccaggccaggccgaatggagctgtgctgtgccctggggacatcttgttacgctccaacatctgatggttgagtgagtcatcctgtccacccttgggcctggaggatgccaggctgcctctctcggtcttgcatgtttatgcatgttgctgcctctctctgcagccttcttgtcctacctgaatatccaaccccttccacctgggcatcccacattcctcatccagtctcaggtgagcagctgcttggaaggcctagcatccaggatgggtggtcctccggggcctgattgtgccacttcccacagtgggctccttttagcttgtcaatcgtgtctcctgcgatgagactcccattagggataaattgtgtctgttttcttccttcatttaacgaacatttattggttacctatgctgcatcagccatggttccaggagaggcaggctagagtagtaaagaagacaggaagcagggggccaggcgcggtggctcacgcctgtaatcccagcactttgggacgccaagccggggcagatcacctgagatcaggagtttaaggccagcttggccaacagggtgaaaccccgtctctattaaaaaatacaaaaaattagccaagcgtggtgatgcacgcctgtaatcctagctacttgggaggctgaggcaggagaatcgcttgaatctaggaggtggaggttacagtcacccaagattgtgccattggactccagcctgggagacaagagcgagcctctgtctcaaaaaaaaaaaaaaaaaaaaaagaaaaaaggaccggaaggggcatggatcataaaaatatagataaatccataacctcatgtgtcaataaaactttatttataaagccaaagtagtgggccgactggatttggtccacaactgtagtttgccaagccctgatgtaaatagacaaaaatctgcagaattaattgtccaaactcatgatgccttttctttgttggtttggttatgcttcaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggtaggtgggagaccatagtcgctctgatgcctatgctcgttcagtaagtatctgttggagaactttctctgcaacaggcaggagggttgcatgggtgaaaaaagataggcagtgtctcccctacttgagcttgcgtctcagcaggggacagaccatgaacagggtcaggagtgaatggttttctgaagagtgaagcaggctgtgttcgtttgctagggctgctgtaacaaaataccactagctgggtggcttcacagaaattgatggtctcatggtgctgggggctggaagtgtgaattcatggtatcagcagcgctggttccttctgggatctgtgagggagaatttgttccacgcttgtctccgtgtatattggtccgttttcacactgctgtaaagaactacctgagactgggtaattgatgaagaaaagaggtttaattgactcacagttccgaaggcttaacaggaagcatgggtgggaggcctcaggaaacttacaatcatggtggaaggtgaagggggagcaagcacatctttaccatggcagagaaggagagagagagagcaaagcgggaagtgctacacactttcaaacaaccggatttcatgagaactccgtcactatcacaagaacagcaagggggaagtacgctcccatcaatcacctctcaccaggcccctaccccaacacatgggaattacaatttgagatgagatttgggtggggacacagagccaaaccatatctctgtgaaaggaaaatgaaatctcaggaccccaattcactatgccaaaaggaaaaacttaagctgtggctgggcactgtggctcatgtctgtaatcccagcactttgggaagccaagacaggaggatcgcttgagcccaggagttcaagatctgcctgggcaacatagtgagaccaagtctctacaaataattttaaaaattagctgggtgtggtagcacaagcctatagtctcagctactcaggaggctgaggtgggaggattgccggagcccaggagtttgaggctgcagtgagctatgatggtaccaccccactccaggctgggcgacagagcaagaccttgcctctaaaaaaaaaaaaaaaaaaaaaaaaattaagctgaaagcttaattaagctgagtcatgcaagaaactgtctttccttttgttcctaagccacagataaaaggccacagatatctccacaggtaacttactctatcgatatggtttggctctgtgtccccacccaaatctcatctcgaattgtaatccccacatgtcaagagagggacctggtgggaggtgattggatcttgggggtggcttcccttatgctgttctcgtgagagtgagggagttctcacgagatctgatggtttttaagtggcagtttcccctgctctctctctctcgatctctctctctcatctctcctgccaccctgtgaagaaggtgccctgcttccaccatgactgtattaggttggtgcaaaagtaattgcggttttgcaactaaaagtaatggcaaaaaccacaactacttttgcgccaacctgataagtttcctgaggcctccccagccacatggaactgtgagtcagttaaacttcttttgtttatacgttacccagtctcaggcagtgtctttatcgcagtgtgagaatggactcatacagttctagaagtcagaaatctgaaacgagtgttatggagcaaaacccaaagcgttagcagggccaactcctgcggaggctccaggggagaagctgttccttgcctttttcagcttctaggggccacccgcattccttggctcatggcccctccttcagcctcttgcttctatcatctcatctcctccttgctctgacctcccgccttgctcttataaggaaagatccatgggattccactgggcccacccagatacccaggatcctctcctcatctcaggatccttagattaatctcatctgcagagtcccttttgccatggaaagtcatgtactggccaggagccgtggctcacacctgtaatcccagcactttgggaggctaaggcaggcagatctcttgagctcaggagttcagaccagcctgggcaacatggcaagacaccatctctactaaaagtacaaaaaaatagcaaggcatggtggtgtatgcctgtggtcccagctccttaggaggctgaggtaggaggattgctgaaccctggggagcagaggttgcagtgagcccagatcacaccactgcactccagcttcgatgacagagcgagaccctgtctcaaaaaaaaaaaaaaaaaaagtcacatactcacaggctctagggattaggatagggacatcattaggagacattattcaacctgccacaaagacacagacacaaccagatgacagaagccaggggaagagttggaatattattctgaatatggtgggaagctgctgttaagttttgagcagggaagtagctttatctgagtcaccttttcaaaggcccaccctagctcctgtgcggttggtccctaggtgagataattagcaccctgaggagcagtttgggtcaatgacctcagggtcgcaaggtagagggaagagaaagccattctgggcctctggaccagtctatgttccccagagagtttccccaaaagccctgcctggcatggggcagggcggttatttgctgctcatctgtcttctaatgaggggttgtatattagtttgctggggctgccattaaaaagtaccacagaggccgggcatggtggttcacacctgtaatcccagcactttgggaggccgaggtgggcagatcatgaggtcaggagttcgagaccaacctggccaacatggtgaagccccatttctactaaaaatacaaaacttagatgggcatggtagtgcacacttgtagtcccagttacttgggaggctgaggcaggagaatcgcttgaacccagaaggtggaggttgcagtgagcccagatcatgccactgcactccagcctgctgacagagggagattccgtctcaaagaaaaaagtaccacagatcaggtggcttaaacaaccgacacttattgtctcacagttctggaggctggaagtccaagatcaaggtgtgaacaggggtggtttctcctgagacctctctccttggcttgcagatggtgcctccctgtgtctacacatgattttcctctgtgcctgtccactccccaccttctcacctgtagaactcagggcttatttatgcttatttgttgactctctctcctcataataaggtgtgcagcagtgtggggtcaggaaccacatcactttgctcaccatggtgttcattctttcattcattgattccacaaacatttcctggatgcctgctagatccagtccgcccaggtcctgcagccgtggctgcatacaggtcagatgaggctcttgctcttgtagaatgtacctcctcccggggggcaacatgacataaacaggtaaacaaagaagtcaacaggatggccatggagagtaagtgccatggagacgaccgaacgtgcggtgtgctgaggagtaaagtgaaagctttttaggaaagggtctgggggtctgggaaggcatcctgagggagagacctttcacctggggctgaatactgagaaggggtggccatgaggaagtcttggggaacagaattctgtgcaaaggaaaagtaaatgcaaagtgtctggagtgggaaagaccttgatctgtgtcttacctatgtctataacattctgtactaatataaaggcatatctgaggctcggtaatttataaaggaaagaggtttatttggctcatggttctgtaggctgtgcaagaagcatggcgcctgtatctacttctggtgaaggcttcagagagcatccaatcctggtggaaggggaaggggggctggcgtgttacatggtgagagagagcaagagagagagaagggaggaaagcaccagtttccttttaacaaccagatctcaagtgaactaatagagcaagaactcactcattaccgcagggaaggcaccaacccattcatgaaggatccactcccatgatccaaacatctccctctgggccccacctccaacactggggatcacatttcaacatgagatttggaggggacgaatttccaaactatatcagtctattcgaggaacagaaggaaagctgttattgctggatcagggtaggggaagcacggaatgaaatgtgattggagagatggacagagatcagatcttgtgaattctggcaggtatcatgacattcgatgtaggccaaagagttacctcctagcccagctcctgatacatgcttaataagcgtagtgttggataaataaacgtttacgtggtaaaagtagatcacaagagctccacaggaggaggtggtggagctccaggtcttctcaatgaatgaaagaatggatgaatgtctttctcctaagtcatgtatgacctgtagaggcttccaggtcttctaatcttatccagtgtgcaacactgcctacaaagcacagtggtaacttctaactttcctttctccccaggctctactacccgaaggatagtgcccgaagttgctgcttggcatagatgagcctcagcttccagggcactgtgggcctgttggtctactagggccctgatgtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatgg

SEQ ID NO: 37320 - DNA, 8591 bp, Homo sapiens; identical to SEQ ID NO: 36202

SEQ ID NO: 37321 - DNA, 5757 bp, Homo sapiens
catcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacggtacaattagacagagggaaagggagggagcccgggggtgggggtaggggagggtggagaagcttccggactccttggggttaaaagggaaggtcccgccaggggtccctgggcagaggataccagcggcagaccacaggcagggcagaggcacgtctgggtcccctccctccttcctatcggcgactcccaggtgaagctacctgcaccccacccgggttggggtggattgcgagaggatgggtggggacccccgggccacaggcaggagccggcttagagcctcggtttctccacctgcgggacgcggaagtccccccgctgtgaggttgagaaagaggctcccactggctccgagcctcggatccccaccccgcgcgtgaaggagggggaaacctcgggcgcggcgtggctgcagccagggtagctggggcgcggagagcgctccactcgggcacagggaggacgggaagatgccgcgaggggcgtcattagggtaattgtgcccattaccgctgttccagcccgaatctcccgtctgccagcccctggggttatcggctgcaggtcaaaagggtgcttgcgggctggggtggcccaggctgggcggatgagcgcggcgaggtgggggtctctaacggagcatctgttttaacccgcccctgcacacaccccagcagatcctggccatgagagctccgcacctccacctctccgccgcctctggcgcccgggctctggcgaagctgctgccgctgctgatggcgcaactctggggtaaggtcgggggcagggggcggggagaggcgccggtgggaggcacgggcgggaggagaatgtgttcccgtcaccaagccccgcgcacctctcctcccccgagaccccagcacccacccagcgctccggagcacggcccgcccccaagtcagctgggcccttcttctggctcggcccctgggtgacccgccccactcaggccctgtccgatttctgccacccggatcctcgctcttccgtggactcttcgccgcgttctttctcctcctcttacgccgccccatcccggccccgctccattttacactaccgtgttttgttttgtttgtttgtttgtttgagacggagtctcgctctgtcgcccaggctggagtgcagtgacgcgatctcggctcactgcaagctccgcctcccgggttcacaccattctcctgcctcagcctcccgagtagctgggactacaggcgcccgccaccaagcccggctagttttttgtatttttagtagagatgggatttcaccgtggtctcgatctcctggcctcgtgatccgcctgcctcggcctcccaaagtgctgggattacaagcgtgagccaccgctcccggccacaccaccgtgttttatcctgagtcttgccttaccgctttttgccctctcccctcactttttttcttcctctttccctttctctctcttttttctttttctttctttcttttctttctttcgttcttcttttccttccttcctttccttccttcctttcgtttgtttcttctttcttgttttactttctctcttattttttcttctttctttcttgtttttttctttctctctctttttctttccttcttttttttttttttttttttttgagacagggcagtgctctgtctccgtggctggagtacagtggcccaatcagagctcactgcagcctcgacctcctgggctcaagcgatactcagcctccagagtagctggtaccacaggcatgcaccaccacatccggctttttttttttttttttttttttttgagacagggtctcactctgtcgcccagactggagtgcagtggcccaatctcggctcattgcaacctccacctcctgggctcaagcgatcctcccacctcagcctcccaggtagctgtgactacaggcgcatgcctccgcgactacttttttgttgttgttgttgttgtttgtttgtttttgtagagactgggtcttgctgtgttgcccgggctggtcttgaattcccgagctcaagcggtccaaccgcctcggcttcccaaagtgctgggattacaggcgtaaaccactgcgccccacccctctcctggttttcaatcccgttttgttattcacaccccttcctctccccgatccccgagttctatccccgcacccttacctccccgccgcgttcaatccccgcccctctatcgaccagcgacgttctagccagctctccaggcgcgctgcgttcagtccctgccctccagacccaccctattctgtctcattactccacgctaccctatcccagcttccttccactttcacgcgcttcttctcctcccattcccttcggtgcacgcgaaacccccaatatttccctaccaccctcgcgttctggctgcgtcccccgtccccgaacgcagtccagtgccacagcccagctccaaccccaaacccagaccctgccctccgtgctttgattccgtcccctttctttctccagccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagtaggaggagatccatccccgaggacgccacggggggctgtggaggcggcctccagggaggagcgggcagggcggggtctctcggaactcccacagctggaggtgcggtccccggtgtccttccagcaggaggagagaccgggcttgcgctgtggccgccagggggcggtgtggtccttttccgcatttctgggcccgtcactcctctcccgctgattctccttgagctctaggaggaggtggttgcctgcaacggatagaagccagggtccggtgtggtcaggaatttagaactaaaggaaaaggttcacttcgtgagtccccgttgaaggaggaagggttgggtattaccacagagaaaatgtggagttgggctgggctcggtggctcacgcctgtaatcccagcactttgggaggccaaggcgggtggatcacctgaggtcaggagttcaagaccagcctggccaacatggtgaaaccacttctcaactaaaaataaaataaaataaaaaataaaaaattttaaaaaaattaaaaaaaaaaaaaggctgggtgtggtggtgggtgcctgtaatcccagctactcaggaaggaggctgaggcaggagaactgcttgaacctgggaggtggaggttgcagtgagccgagattgcgccattgcattctagcctgggtgacaagagcgaaactctgtttcaacaaagaaaagaaaaagagaaaagaaaatgtggaaggcttacctaggtgtccaggcccccagccctcctcaattcctacagatcctcagagctcaaacaactgattcctcctccccatgtccactgaggtccccttctcccacaaggccctcttccctcagactcttcctatctccaggccctgcgtcactgcccacctgctttcccagtccctatgaagggtttgccttcacatgcctcttccttcccccaggccactgtgggctcgagtaggggatgaccacctgctgcttcttcagggagagcagctccgccggaccactcgctctgttgtccatcccaagtaccaccagggctcaggccccatcctgccaaggcgaacggatgagcacgatctcatgttgctgaagctggccaggcccgtagtgctggggccccgcgtccgggccctgcagcttccctaccgctgtgctcagcccggagaccagtgccaggttgctggctggggcaccacggccgcccggagaggcaagagctggggctctgaggccggaacctcaggaggagggggctgagggcctgaacccctgggtctgaggaaggatgggctggggactggattcctggatctgagggaggacgggctggggtcctagatgcctgggtctgtgagtctgaggggaggaggggctgggggcctggactcctgggtctaagtggggaggggctggggccaggattcttgagtctgaaggaggaggggctggggcttaggatagaaacggtcttgtatctggactcctggctccccaaggattgggggctggacccagggattactggcatattctcccttcagtgaagtacaacaagggcctgacctgctccagcatcactatcctgagccctaaagagtgtgaggtcttctaccctggcgtggtcaccaacaacatgatatgtgctggactggaccggggccaggacccttgccaggtagggtctgaacagggagagtctctgactcctgggagggaggacagggaggttatgggaaaagagcagaccctgtgcccgatccccaactccattcccaaacccatccttgaccccaactcttacccagacctaaccccctcctcatccctatcctcaatcccatttccatcccaaccccaccccattcccatctccaagcccattttcatcccctcaccttccatgaactacaatcccaaccccagtctcactgtgccttcattctcatcccccagcccaacctcccataacctgaagtccacctccattcctaccttccagctcatacctaattccaaccccatcccatcctcgtctttatcccaacccaactccttccttccccaccactgccccagatcccaaagtgacagctctcacgttggcacatttatttgatctctccttcctgccacccccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccctgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtga

SEQ ID NO: 37322 - DNA, 5904 bp, Homo sapiens; identical to SEQ ID NO: 36271

SEQ ID NO: 37323 - DNA, 5904 bp, Homo sapiens; identical to SEQ ID NO: 36271

SEQ ID NO: 37324 - DNA, 8547 bp, Homo sapiens
ctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaagtaaacttgccaagtaagcgtcttaaagcccaaccccaaaggctcttttaagagccacttaaattatcgatattagagctgtaaacacgtgttcctaatccaggcttaaattcgggcgatctttttaaagggattatcatgatcttatcacactgagtaatgcatgcagtgcttgtaatcgagtctggctaaggagaagccacatacactttgttagtactgagtgaggaatatggcgcctaaaaaattagggatgtgcaggaaacttgtgttaacagaaagtgcttcctggctcttggcgcgaaaatggatacttccgttgtgtcgagtgctgtgacttcctgttagaacttgttgaaagcctattgtgtcacgtgtactttccaccatgtaatggcgttctaacgtgagtttatatattagtaaatttggttcccgatggcgttccagtacgtatggctttcgctcgagcagttaccttatttaacctcttctaggctgtacccagctctgccttgctttgcttccccctcaccccctgattccatctctgcagcccacgggacatcgggaagatgccagaccaccaggcaggatagtctgcaagggtaaggggaggagcacagcttttctcaggagtgaagaaacggaacatgaaatcatcacggagatttttggaatagtttactagtttttaaggcatgttcagcgtcaattggtccaatcagtaatttttccttttgacaagaaagcttatagaaaaggaaaatgaaaagcaagtagattcagaggggagacaacagacagactagagacagtccgccccgaagcaagaagttggagtagaggagaagggaacttccccagcagcacagggtttgagctaagtgttaggtggtgggttagaattaggtggtgggttttattgtgtgattagaggctagaatgactatgccggtgatgagcagtgtgaaacttttttggaagaaccaagtgaaagaaagagtccacgaattttaagctaggttgttacctggctaaatttgtgatttagaaatgtaggccagtttcacaggggaattttgtgtgtgtgtgtgtgtgtgtgtgtgtgtgtgtgtgtgtgtgtatttaacatatttggccacgcattgttctagtctttggggatattgcccgcccttaggcatttggagattagcagggtcatattgaaaaacttcatacatgcaaagcatatgttcactgttgatccaagtcttatttatcctaccagtaattttggggttacattaatattctaagaaatgtatcaacaaataattatatttattgtttacctatataggaggcactgatctatatctatacctatataggagggcagatcacttgaagtcaggaattcaaaaccagcatggctaacatagtgtgaaaccccgtctctactaacagtacaaaaattagggggggcgtggtagcatgtgcccgtagtcccagctactcgggaggctgaggcagaattgctggaagccaggaggcaaaggttgcagtgagcctagatcacctcactgcactccagcctgggcaacagagcaaaactccgtcgcaaataaaattaaaaaataaactaaaatacactatgccaatgaattctaccttcaggtatacctgactactttttatagactaaaatttttactctggagctatctgctgttattacctttagacttacaaactatttttgcaaatggacatatcatcttgattttatacaatttactttcagtcctttttgctctttttacaaaattctggaagtgcatttgtgttttaatagaaatactgggtggaagtggccataactttctcctgctttcaccctcaccccttttctcccttcaaaatgatctcattttatttctcttgatagcacagattccgcccccccccccccccccagacagagtctcactctgttgcccaggctggagtgcaacggcgagatcttggctcactgcaacctccgcctcccaggttcaagcgattatcttgcctcagtttcccgaatgactggtattacaagtgcctgccaccatgcccagctaatttttgtatttttagtagagatggggtttcaacatgttggccaggctggtctggaactcccgaccttgggcgatccacctgcctcggcctcctaaagtgctaggattacaggtgtgagccaccacgcccggctgatagcacagaatttaacagcttgaaggaatcaaaaagttcagatcactgttattttacaaatagctaaatggatgcaaagcttactttgctcaaatcattagactcagaacaagattccattatgctcttgtttgtttccattataccatatatctctttgtcatctattttctcattagccacgtgtattaatttgacttaatttggagcaaaaatagggctcttttaacttatttatttgtatatttcataatctcttttaaattgttaaaaagttgaatgtgctaaattgtctcctgtctcataaatttttttttttttttttttttttaaagagtagttcagtgctttgcaataattgctgtgtgattctggaccacagcaattcaatctagcaattgttacagcctgctgaagaacgcttgcacagaataattgcctgcttcagattctcccatcctttgggaaactgagagtagctctgggattgaaaagtggaggtttatttaactgtggttagggacttggcaatcatatgtttggtctctgctgttatctagtatctttaagtctagaagttggaagtaaagaggtcagtggacctaagaaaatggcatggctttctaccctagatgagctggaaaaacttagtaattcttcaagtgcttaatacaaaggagcaaatctcacaactcaatgcctatgaattgtaatatatcatgtcactactttcttgatattacctgaggtataagtacagttgggagaagaccttatctctatcttcaggaatataagtgaaggaaaggaaatttttttcttttttttgagacagtcttactctgtcgccaaggctggagtgcagtggcactgtgtcagctcactgcaacctctgtctcctttgttcaagcaattatcctgcctcagcctcctgagtagctgggattacaggtgcccaccaccatgcctggctagtttttatatttttagtagagatgggatttcaccatgttggccaggctggtcctgaactcctgacttaaggtgatccacctgccttggcctcccaaagtgctggcgtgaaccgggccagtgagccaccgcactgggcctgggaaatttgttcatttgctttatcctactttctcattctttattgaactaggatttttttgtctttattgtatgtgtctgaaagccagtttgttactcttaagacactactcaaatagaaatataatgtggccacgtgcgatggctcatgcctgtaatcccagcactttgggaggccgaggtgggtggatcacaagatcaggagtttgagacctgcctggccagtatggtgaaaccccgtctctgctaaaaatacaaaaattagttgggcatggtttcacatgagtgtagtcccagctgcttgggaggctgaggcaggagaatggcttgaacccgggaggctgaggttgcagtgagccaaaattgtgccactgcactcgaacctgggcgacagagcgagactgtctcaaaaaaaaaaaaaaaaaaaaggagggggggaatgtaatacgtcatacatgtacttatctttccagtaaccatttttaaaagttaaaaaaaattgtctgggcacagtggctcaagcctgtaatcccggcactttgggaggccgaggcaggcggatgacctgaggtcaggagttcaagaccagcctggccaacatgtctctacttaaaatacaaaaaaattagcctggcgtggtagtacgcacctgtaatcccagctacttgggaggcggaggcaggagaattgcttgaacccgggaggcggaggttgcagtgagccgagatcacaccattgtactccagcctgggggacgaaagcgagagttcgtctccaaaaaaaaagttaaaaaagttaattttaatagtgtatcctatttgacagaatatatcaaaaatatagtttcagcatatagtcaatacagaatgtattaaatatcttgtattcttttttcatttcaaatcttcaaaatctggtgtgtattttacacttttatggtatatcaaaataaattttcgtggggaattcttgatctgtaattagaataagatgattctgattcatgtccctaaggtgttccaagtatacttgaatgctatctaattgaatccagcaccagtttttaaaagtaaactaattaagatataattaaacacttactccctcagtcacatgccacattgtaagtgctcaaactccatgcatggctagtgctataccataagacactcaatgagcagaacttgacctaaaacccactagggcactatgcaaaggattacaattccttctggcatcaccacctactacggtttttcctaagggagtgtttaatccattgggcttggaacatgaaaaatgacagggaaggacgtgttacattgctgcagatttaacaataacataactatatagacacaaaataaaaacgactttctcaggcccacaaactgacacatgaaaataattcattccaattgggattaagtgacaagcaggttttgcatctgtcctgacacatttccccaaattcttcattataggactagcaccactactactctctgtgatggcttatctatctactaagagagtgtgattaagaatattacaggtttgagtgagtgtatgttcggggcaatttgaatctatgctcctggaataataaaaattaaagaaagacaagtttgggtcataaaatctaacatttgtgaattggttatttgatttggcctcttttgccattttaaaataagagtaataaaatctatctcacaagaatatgagatacgagataatccatgtaaagcacttaacaattttcaacaaactttcagtgtatcttaggcattactttcctctttcaccctttcttttgtcccttttgtaatactttgaaaattttaggtattgttaatcattgcttatttagaaagtaagatcaatcttttatcaggtcttcccttagctcgctcttgatgctactcttacagcgatttcagaaaagccttactatccaattcaagccaaatcaggacataagccgcctaaatgttttttgttttttttttttcccccagattgatgcctgtagctcctggggaaagtggaagtcagataactcctttatgaaaaggcagcattcaaaaactataaaaaatataaatccaacattattaaaattttgcacatccaaagatatcacgaacagttaaaaacaaacccacaaggtgacagaatatatttgtcacatactgacaaaaagttaaaactcaaatatataaagaatatttacaaatcaaatctcataaaataaaaactgtagagaatctgaatagaccattccgaggaaagcgggaaaatctccaaatagccaaaaatctcatttagaaaaactccgatttcacattaggaaatgctgataaacaataactctcaagcactgctggtggaatatgggagtataaatttaaaatactaccctggaaagcaaattgttcatttttattcatgttgaatatgcacatttaccaaataattccacttccatgtaaccagaaaatgcacagctgtatacagtgctgttttgtaatgaggaaaaaaaatcaacagagaaatgaataaagtatttactgacacattagaaaactagattaatggtaaaaataacctagaactgcacatttcaacacggatatatttcaagagcaaatgtaaaaattcatgacgattaaaatagattaggggtatgtgcatctaaagttaaaacgcgtgggaacagtaaacaaatttagaatatcagtttatcctagaatattagttaattctagataggaaaaagggagggctgtgctactgagaaagggacataaggattttagatgcacttgaataagtggtgtggtcaccagcgcattttgtatacttgatatattccagtatttaaaaggcaaacatataaaggaatattattactaagactcttaagactgccctactgttctacagtagtaaaagcatggtctgtccccctcccccccatgcagagctctgtgcccgccaagtcctcttaaaccagccaccacgaagttttcctggaggttctagcatttagtggagcccatcaaactcattatctcctgagacgtatttgaaggtccagagggaagttaattatctagcccgcccctatttggaccgcagaccccttggctttctaaactaatccgagcggtaaaccggctgcaggcaatttccaggcagccgccagaagttactggccagcagaggctcttctggccttggaaaaatctcggcccaaggtcacctgtagtcatcagcccattttcggcgtcgagttaatcttgtaaaataggatgacagaactcactgacaatggccctattaagagactcagtttgcagtcatttcaactcttttgttgaaagcttaggggccctaaaaagggcctttttagagaatgactgggcttcaaaatgccatttagccgccgaagccatagagggtgcggccctggcgcttgagcgcgtagaccacgtccatggcggtgaccgtcttgcgcttggcgtgctccgtgtaggtcacggcgtcccggatcacgttctccaggaacaccttcaacactccgcgggtctcctcatagatgaggccagaaatgcgcttcacgccgccgcggcgagcaaggcgccgaatggctggcttggtgataccctggatgttgtcgcgcagcaccttgcggtggcgcttggcaccccctttccccaggcccttacctcctttgccgcgtcctgacattatcaagtggtcagagaacaaaggtctgctgcctgtgatggcagctttcttttatgggtaacctctgcggaccagactgaaaaccggaagagctttggcgggaagtccctctgcattgggggaggggacctaaaagggaaacaggcctgctgtgctctactccctcttgttctccttcagtcctttttaatcctcaagacctaggctgtttttccttttttcatttaacatgattcctgcctcataacaaaaatgttaacattatagaagatacataaagcaaaaagaatgttatctctgcatatatgcatgttttcctttaacattatttgtatggaactatgctattttgtggcatttttctccttaatatacaatggaaatatactccatatgctaaattcctagcaatagaacaagatagactcatagaatttaaagatcgttcaggtatattgctaagttcttttctacttattttcatttctagtgtttggggtggagaattatccccccaaatatcgagcttggtaatggtgggtgtttttgaaaattgagggttctcagaaacaagtctaagaatcaaggtccctctaactttgtcctgtttctcttccccaaatacagggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctctt

SEQ ID NO: 37325 - DNA, 8338 bp, Homo sapiens; identical to SEQ ID NO: 36983

SEQ ID NO: 37326 - DNA, 114923 bp, Homo sapiens
ggcctgagctctcctggcccctggctctcttctgcagagggcctgctctcagctgccacaagagggcgccggagaacggacctgagcaagagaggcaggagctcctctgcaggtcctcccaggcaccaatccttctgggagggaggaaggcttgggagtcctcttagacagatcctcagtcacttctctctgcttgtgtctcaggaagaccagctcctcctactgtcttctgtgctagggatcacttccttgttgagtggggcctgagttttaagaggatcttctgctcctcttcatctggtccctttccttccaaggcctcagagaggaaggcatgcagtgggccctagcggtgcttctagctttcctgtctcctggtgagtgcgctgcctacagagaggatcatgggttttgttttctttattttcttcttttgcaaggattgccatactaaggaattcctcattatattttgtgttgttcccattgcagccagtcagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctgggatgggcacagtgattcagatccgccctacaccacactgaaaacctgccttgtggctgcttctggtacacaagatagagccgccccctctcatttcctgccaccaaatttaccgtgtgctgaacaagagaaacattgcttaactcctgatctcccctgcaatatcacactcccctggcagcagctgcaccctgttccccaccctcccccaggacttccctgaagaccaagccaccatctcagctaaacctcagagaagcagcctggctgagagcaaggttctcttagctctcctaggacatggcggaagcccactcactctgcttcctaggacaaatgggtacctctagggtccagctgtgaagcaagatattttggacaacaaatgagaagggtatttatactaaattgtgtatcccatcatgatccagaaatcgcagctgagactggtgcttattccttatatctataacaatgtaagcaatactataatgaccactgaaacaccaggcctaggtatgcagttgaacattctctccctctgccctcccttttattctctctctctttttttaattctttgcttgcttttattatttttctctctctcccttcctccttccctccgtccttccctccctccttccctccctctctccctccctccttccctcccttcctctcttctttccttccatccattctccttcgttttccttccttccttctttgcttttctcttgctttcctttttgggtacataatcagaatactttttccacaaaatcatttgaaataatttttctctatgtgttcatgtcaacattgatatagctactttaattgttcagttttcttttttacattttggaaatttgttgtattactttgttttgtttcatatctgttttgcatatataaaacatttacatggaagtgaagtcaaaatcataaaagatgatgcatttgaagattttagcttccattgtagacttctcattcttcttttctccctgacactataggtaacaatatttttggcagttcacttgagctgtttcactctgtttttcatagcggagtatgtattctttctatttgaatgccatatttatattttctttctgatattcagtttctatatattttaatcaatcttatattttcctgtgtctggactgtgtgtcttacttctaaaggtgcacatacttcataagcatgcataaagatgtccatatcatttatttgaatgtttttatgcattgattatttaatgatggcatcactgatctatcaggaatttttatacaataattactgtattagtaataataatactggccaggcccggtggctcatgcctgtaatcccagcatttgggcagtccagtcgttaggatcacttaggccgggagattgtgaccagctcagccaacgtggtgaaaccctgtctctagtaaaaatacaaaaaattagctggctgtagtggcacacacatgtaatcccagctacttggatgctgaagcaggagaatctgtagagcctggtaggtggagttttcagtgagctaatatcacactactgcagtccagtttgggcaacagagtgagactctgtctcaaaaaaatgaataacgataataataatattgatggtacatatgggtactgacattctggtagttaatgtactaagcacattacatgcatattttatttaatctacacagaaacttcattaaggtttaaagtactgttgaatgtaacattagaaattgggcggttaattaacattccctaagtcatatgctttaatttgataatgattgcaatccaagctctgtggttccgaaaatgagatttgtaaattcagtttgcattcccccatctttgggagtactagtattatttcacaactttataggttatttatagttcttcttttgtgaattgccatgtcatactctttgcctattcctctcttggaggattaattttttcttattatttcgtaagagttaagatacactattttaaagatactgaccctttatcgaatgtgttgaagatatttcccctcatttgttattatttacatttggcaccttttggtgaattgaactttgaaaaaaaaagcattaaaatctatcaatttttctagggtgtctagtttgatgtcaagcttagaaaggccaatctcacctagaatttctatgcaattcatcattgtttaagtgtaatgattttgtttttattacaactaaatcactatctatatctggtaagaacgaaatgcaataatatttgtttccatatggtaagtcaatacccaaaagagaacttataaaataattgactatttccttgtggatattaacatatcactttatcacatgataaaatattacatgcatgcggctttctttctggattttctactgtgttccatgaatcttctcattctagtgccagtattgccctctcttcagcactgtagctttatagttcttttcacattctgatgaaatttctctcattatttttttgttttaagaattttctgtgcattctagtgtgatctcaatcctctcccttcccatttttaaaccatgagacttctgtccagcaagactttttcatgctccaaggcatggaagctttcctccttcacaaggaccccgagaactcagctttcagagctgctcctacagcagcctcatgtcctgcacgtgtgctccagaggcagagggagaccaaccggagccccctccctttctcattcccagctgtgatgacagcagaaactgaattctctgagctaggacaacacaacaactgagagagacactgttctacatctcattatgcatctttcaaacatgtgtctctatatattcttacagaggtggtgataatctgcctatgccttactgaattttcacaataatattactatactttttttgtcccctatatttccaactgtgaatccaggtgcactgcagatattagtctgctttctgagggtagggatgacaaataaaatatacaataccgggggaattggaagtacagaaaaataacaagtttttagtttaagtatgttccaaatattgcatgacatggcacccagtactactttaaaaacaaacaagcaaacaaacaaattcacactcctactttaatgaacaaaaatcctctaataaggaggtcacacacacaggattacaggcacaacccctgcccccccaacacacacacacacatatttaccttagagcagactccgggacacaccaacacacatgatcctcagtccttttaataaagcacgttcaacccttctcagagtgaccttgagtggttgcctccatgagtctgcagatgcgaaaaggaacttggttcagggccctaatcagaggcttcctgtcaggacaaggttctggcatcagcattacctgctgcaactctgaagggcagggtgggagcctgctatgggactgccccctccaaggtgtgagcctgttaattccagggtcagcttacccaacatctgcagtccctcagctggaggcctgagctcttaatgcccctgcctcccttctgccctgggcctgctctcaactgccacaagatggcgcagaagaaagggcctgaggagatgcgggagctcctctgcaggtcctcccaggcaccaccccttctgggaggaaggcttgggagtcccctaagacacatcttcagtcacttctctctgcctgtgactcaggaagaccagctcctcctactgtcttctgtgctagggatcacttccttgttgagtggggccggagttttaagaggatcttctgctcctcctcatctggtccctttccttccaaggcccccgagaggaaggcatgcggtgggccctactggtgcttctagctttcctgtctcctggtgagtacgctgcctacagagaggctcacaggttgggttttgttttgtttacttcttttgaaaggggtgccatacaaaggaatacctcattaaattttgtgttgttcccattgcagccagtcagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctgggacaggcacagtgattcagacctgtcctacaccacactgaaaatctgccttgtggctgcctctggttcacaggatagagccgccccctctcatttcctgtcaccaaatttactgtattctgaacaagagaaagacagcttaactcctgatctccctcctaatatcacactgtcctggcagcagccgcaccctgttccccacccctcccccacaactttcctgaagatcaagctgccatctccaggcctcagctaagcagcctggctgagagcaaggttctctcagctctcctaggacatgggggaggcccactcactctgcttcctatgacacacaggtacaactagggtccagctgtgaagcgagatattttggacagcaaatgggaagggtatttatactgaatcatgtatccagtcatggtccagagatcacagctgagagtggtgcttattccttatgtctataacaacataagcaatactataatgaccactaaaacactaggcccaggtatgcagttgaacatggtctccctctgccctcccttttattctctctctcttttttcttacttctttgcttgtttttatttttctctccctccctaactccctccctccatccatcctttcctcccttcctcccttgtttccttccatccattctccttccttgttttccttccttccttccttgcttttctctctctttctttcctttttgggtacataatcagaatactttttccacaaaatcatttgatataatttttctctatttgttcatgccaacatttatacagctagtttaattgttcagttttcatttttacattttggaaatgtgttgtattactttgttttgcttcatatctgttttgtatatataaaacgtttacatgaaactgaagccaaaattataaaagatgatgcatttgaagattttagcttccattgtagatttttcgttcctcttttctccctgacactataggtaacaatatttttggcagttcacatgagctttttcactgtttgtcatagtgccgtatgtattgtttctatttcaatgccatatttatattttcattctgatattcggtttttatacattttaatcaatcttatattttcccgtgtctggattgtgtgtcttacttctaaaggtgcacatacttcataagtatgcataaagacgtccatatcatttatttgaatgtctttatgcattgattatttaatgatggcatcattgatctatcaggaatttttatacaataattactgtattagtaataataatactggccaggcccggtggctcatgcctgtaatcccagcatttgggtggtccagtcattacgatcacttaggccaggagattgcgaccagcttagccaacatggtgaaaccctgtctctactaaaaatacaaaaaattagccggctgtagtggcgcacacatgtaatcccagctactttggatgctgaggcaggagaatctctagagcctggaaggtgaaggtttcagtgagctaagatcacactactacagtccagtttgggcaatagagtgagactctctctcaaaaaaatgaataatgataataataatattgatggtacatatgggtgctgacattctggtagttaatgtactaagcacattacatgcatattttatttaatctacacagaaacttcattaagggtttaaagtactgttgaatgaaacataagaaaatggggggttaattaacattccctaagccatatattttaatttgattatgatagcaatccaagctctgtggttccaaaaatgagatttgttaattcgatttgcattcccccatctttaggagtactagcaatatttgacaacgttataggtcatttataattcttcttttgagaattgccttgtcgtactctttgcctattctccctttggaggattaattttttcttattggttcgtaagaattaatatgtactattttagagatgatgaccctttatccaatgtgttgaagatattactcctcatttgttattatttacatttggcaccttttagtgaattcaactttgaaaaaaaaacaataaaacccatcaatttttctagggagtctagtttgatgtcagcttagaaaggccaatctcacccagaatctgtatgcaattcatcatcgtttaagtctattgattttcattttattacaactaaatcactatttgtaactggtaaggtagaaatgcgacaatatttgtttccatatggtaagtcaatacctaaaagagaacttattaaataattgactatttccttgtgaatattaatatatcactttatcacatgataaaatattacatacatgcagctctcttactgcattttccactgtgttccatgaatcttctcattctagtgccagtattgccctctcttcagcactgtagctttatagttcttttcacattctgatgaaatttctctcattatttttttgttttaagaattttctgtgcattctagtgtgatctcaatcctctcccttcccatttttaaaccatgagacttctgtccagcaagactttttcacgctccaaggcaggcaagcttccctccttcacaaggacccgagaactcagctttcagagctgctcctacagcagcctcttgtcctgcatgtgtgctccagaggcagagggagaccaaccagagccccctccctttctcattcccagctgtgatgacagcagaaactgaattctctgagctagcccaacacaacaactgagagggacactgttctccatctcattatgcatatttcaaacatgtgtctctatatacttcttacagaggtggtgataatctgtgaatgccttactgaattttcacaataatattactgtacttgatttgtccccttattttcatctgtgaatccaggtgcactgcagatattagtctgctttctgagggtagggatgacaaataaaatatacaatacgcagagaattggaagttcagataaataacaagtttttagtttaagtatgttccaaatgttgcatgacatggcacccagtactactttaaaaacaaacaagcaaacaaacaaactcacattcctacttaatgaacaaaaatcctctaataaggaggtcacacacacaggattacaggcacaactcaccccccccaacacacacacacatttaccttagagcagagtccaagacacaccaacacacatgatcctcagtccttttaatttaaagcacgttcaacccttctcagagtggccttgagtggttgcctccatgtgtctgcagatgcgaaaaggaacttggttcagggccctaatcagaggcttcctgtcaggacaaggtcctggcatcagcattagctgctgcaactctgaagggcagggtaggagcctgttgtgggactgccccctccaaggtctgagcctgttaattccagggtcagcttcccctaaatctgcagtccctctgctggaggcctgaactctcaatgcccctgcctcccttctgccctgggcctgctctcagctgccacaagagggcgccgaagaaagggcctgaggagacacaggagctcctctgcaggtcctcccaggaaccaccccttctgggaggaaggcttgggagtcccctaagacacatcctcagtcacttctctctgcctgtgtctcaggaataccagctcctcctactgtcttctgtgctagggatcacttccttgttgagtgggacctgagttttgagaggatcttctactccttttcatctggtccctttccttccaaggccccagaaaggaaggcatgcggtgagccctagcggtgcttctagctttcctgtatcctggtgagtgtgctgcctacagagaggctcacaggttgggttttgttttgttttcttcttttgaaaggggtgccatacaaaggaatacctcattatattttatgtttttcccattgcagccagtcagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggggcaggcacagtgattcagatctgccctacaccacactgaacatctgccttgtggctgcctctggtacacaagatagagccgccccctctcatttcctgccaccaaatttactgtattctgaacaagagaaagacagcttaactcctgatctccctcctaatatcacactgtcctggcagcagctgcaccctgttccctacccctcccccacaactttcctgaagatcaagctgccatctccgggcctcagttaagcagcctggctgagagtaaggttctctcagctctcctaggacatgggggaggcccactcactctgcttcctatgacagacaggtacaactagggtccagctgcgaatctagatattttggacagcaaataggaaggttatttatactgaatcatttatccagtcatggtccagagatcacagctgagagtggtgcttattccttatgtctataacaatataagcaatagtataatgaccactaaaacactaggcctaggtatgcagttgaacattctctccctctgccctcccttttattctctctctcttttttcttacttctttgcttgtttttatttttctctccctccctaactccctccctccatccatcctttcctcccttcctcccttgtttccttccatccattctccttccttgttttcctccttccttccttgtttttctctctctttctttcctttttgggtacataatgagaatactttttccacaaaatcatttgaaataatttttctctatttgttcatgccaacatttatacagctagtttaactgttcagttttcatttttacattttggaaatttgttgtattactttgttttgtttcaaatctgttttgtatatataaaatatttacatggaactgaagtcaaaatcataaaaggtgatgcatttgaagattttagcttccattgtagatttcttgttcctcttttctccctgacactacaggtaacaatatttttgtcagttcacttgagctgtttcactctgtttgtcatagcagagtatgtattgtttctatttcaatgccatatttatattttcattctgatatttggtttttatacattttaataaatcttatattttcctgtgtctggattgtgtgtcttacttctaaaggtgcacatacttcataagtatgcataaagacgtccatatcatttatttgaatgtttttatgtgttgattatttaatgatggcatcattgatccatcaggaatttttatacaataattactgtattaataacaataatactggccacgcccggtggctcatgcatgtaatcccagcatttggccagtccagtcattaggatcacttaggccgggagatttggacccgctcagccaacatggtgaaaccctgtctctactaaatatacaaaaaattagccggctgttgtggcgcacacatgtaatcccagctactttggatgctgaggcaggagaatttctagagccaggaaggtgaaggtttcagtgagctaatatcacactactacagtccagtttgggcaatagagtgagactctgtctcaaaaaaatgaataatgataataataatattgatggtacatatgggtgctgacattctggtagttaatgtactaagcacattgcatgcacattttatttaatctacacagaaacttcattaagggtttaaagtaccgttgaatgtaacataagaaattggggggttaattaacattccctaagtcatatactttaatttaataatgatggcaatccaagctctgtggttctgaaaatgagatttgttaatttgatttgcattcccccatctttaggagtactagcaatatttgacaacgttataggtcatttatagttcttcttttgagaatcgccttgtgatactctttgcctattctccttttggaggattaattttttcttattggttcgtaagaattaatatatactattttagagatactgaccctttatccaatgtgttgaagatattactcctcatgtgttattatttacatttggcacctatggtgaattgaactttgaaaaataaaataatatctgtccatttttctagggtgtctagtttgatgccaggcttagaaaggccaatctcacctagaacttctatgcaattcatcatcgtttaagtctaatgattttcattttattacaactaaatcactatttgtaactagtaaggtagaaatgcaacaatatttgtttccatacagtaagtcaataccaaaaagagaacttattaaataattgactatttccttgtgaatattaatatatcactttatcacatgataaaatattacatacatgcagctctcttactgcattttccactgtgttccatgaatcttctcattctagtgccagtattgccctctcttcagcactgtagctttatagttcttttcacattctgatgaagtttctctcatttttttgttttaagaattttctgtgcattctagtgtgatctcaatcctctcccttcccagttttaaaccgtgagacttctgtccagcaagactttttcacgctccaaggcaggcaagcttccctccttcacagggacccgagaactcagctttcagagctgttcctgcggaagcctcatgtcctccacgtgtgctccagaggcagagggagaccaactggagccccttccctttctcattcccagctgtgatgacagcagaaactgcaaaatttgagctaggacaacacaacaaccaagagagacattgttctacatctcattatgcatatttcaaacatgtgtctctatatacttcttacagaggtggtggtaatctgtgcatgccctactgaattttcacaattatattactgtacttgttttgtccccttatttccatctgtgaatccaggtgcactgcagatattagtctgctttctgagggtagggatgacaaataaaatatacaatacccagggaatttggaagttcagatatataacaagtttttagttcaagtatgttccaaatatttcatgacatggcacccagtactactttaaaaacaaacaagcaaacaaacaaacttacactcctactttaatgaacaaaaattgtctaataaagagatcacacccacaggattacaggcacccccccccccgccccccgccacacacacacacatttaccttagagcagagtccaaggcccaccaacacacatgatcctcagtccttttaataaagaacattcaaccctcctcagagtggccttgggcagttgcctccaagtgtccttgcagatgtgaaaaggaagttggttcacagccctaatcagaggcttcctggcaggacaaggtcctggcatcagcattagctgctgcaactctgaagggcagggtgtgagcctgctgtgggactgccccctcctagggctgggcctgctgactccaggggtcagctttccccatatctgcactccctctgctggaggcctgaactctccatgcccctggctctcttctgcagagggcctgctctcagctgccacagagggtgctgcagaactggcctgagcagagaggcaggagctcctctgcaggtcctcccaggcaccacccttctggaaggaaggcgtgggagtcccctaagacacatcctcagtcacttctccctgcttgtgactcaggaagaccagccttccccactgccttctgtgctagggatcacttccttgttgagtgggacctgagttttgagaggatcttctgctcctgttcatctgggccctttctttcaagaccccagagacgaaggcatgtggtgggccctagccctgcttctagctttcctgtctcttggtaagtgtgctgcctacagagaggctcacaggttgggttttgttttggatttttcttctttagcaagggacgccatactaaggaatacctcattatattttatgttgttcccattgcagccagtcagatatctactaacttggaagcgaaaataaagtcaggcaccaggcagatggggtcatctgctgtaatcacctgtgatcttcctgtagaaaatgccttctacatccactggtacctacgccaggaggggaaggccccacagcatcttctgtactatgacatctgcaactccagggatatgttggaatcaggagtcagtcaggaaagcatgatacttatggaagtagaaggataagctggaaatttatacctccaaaactaaatgaaaatgcctctggggtctattactgtgccacctaggacaggcagagtgattcagacctgctctacaccacactgaatatctgtcttgtggctgcttctggtacacaagagagagccgtcccctctcatttcctgccctgaatttactgtattctgtacaaagagaaacagcttaactcctgatctcccccctaatattacactctcctgtcagcagctgtaccctgttccccaccctcccccaggactttcctgaagactaagctgccatctcagctaagcctcagctaagcagcctggctgagagcaaggttttctcagctctcctaggacatgggggaggcccactcactctgtttcttagggtccagctgtgaagcgagatattttggacagcaaatgggaagggtatttatactgaatcatgtatccaatcatggtccagagatcgcagctgagagtgctgcttactccttatgtctataacaatataggcaatattataaataccactaaaacactaggcctagatatgcagttaaacactctctccctctgccctcccttttattctctctcctttcttacttccttgcttgcttttattattttttcttccctccctccctccctccctctctccctcccttccttccttccttttttcatttcttccttccttgcttttctctctctttctttcctttttgggtacataatccgaatattttttcaacaaaatcatttgaaataatttttctttacatgttcatgccaacattgatatagctagtttatttgttcagttttcattttaaaattttagacatttgttgtattattttgttttgtttcatatttgttttgcatatgtaaactatttacatggaactaaagtcataattttaacgaagatgcatttggagattttaacttacattctagatttctttttctctctcttttttttttttttttttttttgagacggattctcagtctgtcactcaggctggagtgcagtggagcaatctcggctcactgcaacctccgcctcctgggttcaagagattctcctacctcagcctcccaagtagctgggatttcaggtgcccgccagcacatccagctaatttttgtatttttggtagagacagggtttcctcatgttggcctggctggtctcgaactcctgacctcagatgatccccctgcctcggcctccctaagtgctgggattacaggcatgagcaacctcaccaggccccattctggatttctctttcctcttctctccctgaccctataggtaacaatatttttatcagttcagttgaactttttcactttttcttattcagaacaagtctttcagtattacagaaaagtcttttgtttgtcatagtgcagtatatattgtttctatttgaccgtcatatttatattttcattctgataaggttttatacattttaatcaatcttttatcttccagtgtctagattttgtgtcttgcctctaaaagtgcatacacttcataagtatgaataaagaagtccatatcatttatttgaatgcttttattcatagactatttaatgatggcatctctgatctattgggaattttaatacaataattaccgtagtaataataatatgctaatgataaacacgggtactgacattctggtagttactgtactaatcacattgcatgtaagttttatttaatcttcacagaaaccccattgaggggttaaagtaccattgaatacaccagatgagaaataaagggcttaactaacattccctaagtcatatactttattcgatagcaatttcaatccaagcgctggggttcagaaaatgagatttgttaattcaatttgcattttcttacctgtgtgaatgctagcattacttaacaactttgtaggccatttatacttcttcttttgtcaactgccatttcatactcttcgcctattcttctgttggttatcatttttttcttattggtttgtaagaattaatacacctcattttagagatattgatcctttatcaaatgtattgaaaatatttctcgtggtttgctattattttcagcaccttttggtgaactgaactttgtgtactacttttaataaaacctatcaatttttctaaggggtctattttgatgttaggatcagagaggcaaatctcacttacaatatgtgtgcaattcatcatggttaaagtctaatgattttctgttttcagttttattacaagaaaatctccatttgtagctggcaacatagtaacttaagaagatttgtttctggccgggtgcagtggctcacgcctgtaatcccagcactttgggaggctgaggtgggtgaatcacgagatcaggagatccagactatccggggtaacacggtgaaaccccatctctactaaaaatataaaaaattagctgggcatgttggcaggtgcctgtagtcccagctactgagaaggctgaggcaggagaatggcgtgaacccaggaggcggagcttgcagtgagccgagattgtgccaccgcactccagcctgggggacagagagagactctgtctcaaaaaaaaaaaaaaaaaaaaattgtttccatatggtaagtcaattcccaaaagagaacttattacataatccagtagtttctcaaggatattaacgtacaactttatcatgtgataaaatattacatacacatggctctctttctggactttccagtgtgttccatgaatcttttcattctagtgccagtattgccgtctcttcagcactgtagctgtatagttcttttgacattacagtggagttactttcctttattgcttttttgttttaagggtgttctatgcattgcaatgtaatggcaaatctctcccttctaatttttaaaccgtgagacatcggtcccagcaaggattttccaggcttcaaggcacctgagcttccctccttcacagtgaccccaagaactcagctttcagagctgctcctgcggcagcctcatgtcctccacgtgtgctccagaggcagagggagaccaaccagagcccctccctttctcattcccagctgtgatgacagcagaaactgaattctctgagctaagccaataccacaaccaagagggatgttgttctacatcttattaggaatattttaaacatgaatctaaacatatttgttatagaggaggtgaatatctgtgtatacactactgaatgttcccaattattttattctacttgttttatcacccatatcttcatctatgaatccaggtgcactgcacatattagcctgctttccaaggatagagttgccaaataaaatatgcaatacccaggtaaattggaagttcagataaataacaaataagttttgagttcaagtatgtaccacatattgcatatggcactgcaccctgtacttttttttttctttttttgagacggagtctcactctgttgtccaggctggagtgcaatggcacaatctccgctcactgcaagctccacctcccgggttcacaacattctcctgcctcagcctcctgagtagctgggactacaggtgcccacccccacaaccggctaatttttttgtatttttagtagagacagggtttcatcgtgttagccaggatggtctcaatctcctgacctcgtgatctgcccacctcggcctcccaaagtgctgggaatacaggcgtgagccaatctcacactcctacttgatgtggcctttttacttgagaatgaacagaaatcctctaacaaagaggttacaaacacaaggtcacacacaccccctcctgacccccacacacccatttaccattgaggagagtccatggccgaccaacatacctgattctcactcctgttgagaggaggggccagctgggcttcctgggtcgagtaggggctcagcaagctgtgaaacgcactcatttcctgcatcacgacttacttcggtcctggatgaataatattgaagatatatgcttaaaatattccgaacaccaggatttgtgcatgtgttttcttccccatgaaagctatgaacagcgaaaattttcctgtaagtttccctgtgttctctctccctctcttccttccccctgccccaaaactaaagtaaaataacgttaactgcccgtttttctgtaaccagcagaccttatctatactcccaattccaattccttgtaaacatactttgtaaagtcctgtaagatcctgtctcctttgccatgacgctgcaaggtcataaagtagataaaacctaagttgcaattccggttttcctcaagatctaagacatgttacaaatggttaattgcctttgtttctcgctttggtaacatcttcccgcctcaggtatttcccgccttgaagagtttaaaaggcaatcctataatctaactctggctacccattctggaccccctccatgctttggaagctttgtactttcactctgctcaataaagcctacagctttttctctctctcggtccgtgtttctatcactcgctgcggtcagccgccacaccaattctatggcgtggctaggcaagaaccttaggtgttacactgttaataaagcaggttcaggccttctcagagtggccctgggtattttgcctccaagtgtccttgcgaatgtgaaaaggaaagcagttgaaagaccaaatcaagcttcctgacaggacaaggccctggaagcagcatcaactgctgaaactctgaagggcagggtgtgagcctgctgtggactgccccgtcctatggccctggccagctggcgccagggtcagctttccccacatctgcactccctctgctggaggcctgagctctccatgcccctggctctcttctgcagagggcctgctctctgctgccacaagatggcgctggagaaggggcctgagcagagaggcaggagctcctctgcaggtcctcccagacaccacccctctgggaggaaggctggggagtcccctaagacagatcctccatcacttctccctgcctgtgactcaggaagaccagctcctcctactgccttctgtgctagggaacacttcctgtttgagtgggacctgagttttgaaagcgtcttctgctcctcttcatctggtccctttccttccaagaccccagagaggaaggcatgcggtgggccccagccctgcttctagctttcctgcctcttggtaagtgtgctgcctacagagaggctgatgggttttattttgttctgttttgttttctcattttgcaaggggtgccgttctaaggagttcctcattatattttgtgctgttcccattgcagccagtcagaaatcttccaacttgcaagggagaaggaagtcagtcaccaggccagctgggtcatctgctgtaatcacttgtgatcttactgtaataaataccttctacatccactggtacctgcaccaggcggggaaggccccacagcatcttccatactatgacccctactactccagggttgtgttggaatcaagaatcagtagaggaaagtattttacttatgcaagcatgaggaggagctggaaattgatactgcaaaatctaattgaaaatgattctggatctattactgtgccacctgggacaggcacagtgattcacacctgccctacaccacactgaaaatctgccttgtgactgcttctggtacacaagatagaccagccccctctcatttgttgccaccgaatttactgtattctgtacaaagagaaacacagcataattcctgatctctcccctaatatcacactctcctggcagcagctgcaccttgttccccaccctcccccaggactttcctgaagacaagctgtcatcttcaggcctcagccaagcagcctggctgagagcaagactctctcagctctccgaggacatgggggaggcccactcactctgcttcctcggaccaacaggtacacctagggtccaactgcgaagcgagatattttggacagcaaatgggaaggatatttatactgaatcatatatctagagatcacagctgagagtgttgcttattctttatgtctataacaatataagcaatagtataattaccactataacactaagcctaggtatgcagttgaacattgtctccctctgctttcctttttgtctctctctctactttcttggttacttgctatttttctacacatccctttttctggcctcccctccctccctccctagctccctccctagcttgccttccttccttccttccttccttcctttcttcctccctctctccttcccttccttacttccttcctttctttcttcctccctctctccttcccttccttacttccttcctttcttcctccctccttctcttacttccttctttttttcctttcttccttttctctctctttctttcttttttgggcacacaatcagaatacagaatcattctctatatgttcatgccaactttgatacagctagtttattcgttcagttttcatttttatattttggaaatctgttgtattattttgatttgtatatgtaaaacctttacatggaactgaagtcaaaattataaaacaagatcaatttagagattttagcttccattctagaattctcttttctcttctgtgtctcaccctataggtaacaatatctttattagttcagttgaactttttcactttttcttatttattcagaagtctatcactattacagaaatacctcttttgcttgtcatatatgtgcagtatgcattatttctatttgaatggcatatttatgtttttgttctgatattctgtttttatacatttcaatcaatcttttagtttctggtgtctggattttgtgtcctacttggaaaggtgaacatacttcagaagtatgcctaaagaaattcatatcatttcattaatattttattcatttattacttgatatgatctatctggaatttttatacaataattactatagcaataataataatactgatgataaatatgggtactgactttccggtagttactgtactaagcacattacatgtatattttatttaatcttcacagaaaccttatcaacgggtttaagtaacattgaatatagcagatgagaaagtgaggggttaactaacattccctaagtcatatagtttaatttgatagcaattgcaatccaagctctggggttcagaaaatgagatttgttcattcaatttgcattttcttatctttatgaatactagcattattttacaattttataggccatttatacttcttcttttgtgaattgccttttcatactgtttgcctatccttctgttggggtattaattttttcttatttgtttgtaagaattaatatacaccattttcgagatattgatcctttatcaaacgtgttgaaaatatttctcatcatttgctattatttattttcagcaccttttggtgaactgaactttgtatattacttttaataaaatctatcaatttttctagggtctgtattatgatgtcaggctcagcgagaccaatgtcacctacaattagtgtgcaattcatcatcgtttaagtctgatttccttttttcagttttattacaactaaatctctatttgtaccttttaagttagcaacccaaggatatttgtttccatatggtaagtcaattcccaaaggagaacatagtaaataatcaagtatttccttgtggatattaacatacaactttatgacatgataaaatattacatacacgtggctctctttctggactttccactgtgttccatgaatcttttcagtctagtgccagtattgtcctctctttgttgtatctgaatgagttagagaaaatgccacactttgagacaaattaagattccgtttatttagccggcggccaagagacggctaatgctcaaaattctctcggccccgaagaaagggctagattttcttttatactttggtttggaaaggggaggggtgtctagttaaaacaattttacagaaataaagtaggcaaaaagttaaaaggataaatggttacaggaaagtaaacagttccaggtgcaggggctttaagactattacaaggtcatagacttggggctttgggcgttatcaatcagatggattcctgggaattgcggatatagcttgccacagtatcttatcagttaattgcattcttggatgtgctgggagtcagcttgcacaagttaagtccttgaggaaggggctgccagtgaaagagccaagatggagtctgtctggctctcttagctaagggagagtcaattcaggtggaaacaaggccaggtgattaaaggaaaagggagagtctaaaaacagggttagtaaaaacacggttgggcattacatcttcagcactgtagttttgtagttcattttatattccagtggagattgtttctctcattacttttttgttttaaggattttctgtgcattctaatgtgatggcagttctctcccttctcatttttaaaccatgagagttctgtcccaggcaggattttcctggctccaaggcaggtgagcttccctccttcacaaggaccccaatgactcagctttcagagctcctcccctggcagcctcaagtcctgtacgtgtggtggagaggcagagggagaccaactggagccccctgcctttctcattcccagctgtgatgtcagcaaaaactgaactctctgagctaggccaaaacaacaaccaagagggacattgttctacgttttatgaatatcttaaacatgtgtccaaacttttttttttttttaccgaagtgaaaatctgtgtatgcactactgaattttcacaattattttactatacttgttttatcacctgtatctccatctatgagtccaggtccactgcagacatcagtcagctttctgaggatacggttgctaagtaaaatatgcaatactcaggaaatttggacgttcagataaataacaagtttttagctgaagtatgtcccaaatattgcatgacatggcaccctgtattactttaaaaaaaaaactcacacttctacttgaatgaacggaaatcctctaataaagagatcacacacacaggcatacactcccaacacacacacacacacaaactcacagaggatcacacaaacacccgccccacccccacacacccatttaccttagaggagagtccaagacccaccaacatacctgaccctcgatcctgttaataaagcaggttcaggccctctcagagtgaccctgggtgttgcctctagtgtccttgcagatgtgaaaaggatggtggtttagggccctaatcagaagcttcccggcagaatgagggtcttgcagttgccttacttgctgaaactctgaagtgctgggtgtgaacctgctgtgagactaccccctttaaggtctgagcctgttaactccagggtcagcttcccccacatctgcactccctctgctgcaggcctgagctctctatgcccggagctctcttccttagagggcctgctctcagccgccacagagggcgctggagaactggcctgagcagagaggcagaaactcctctgcaggtcctcctaggcaccacccagagtcccctaagacagatcctcaatcacttatctctgcctgtgaatcaggaagaccagctcctcctactgtcttctgtgttagggatcacttccttgttgagtgggacctgagttttgagagggtcttctgctcctcttcgtctggtcccttacttccaagaccccagagaggaaggcatgctgttggctctagctctgcttctagctttcctgcctcctggtaagagtgctgcctacagagaggctcacaggttttattttgtttcgttttgtttattttcttcttttgcaagggataccatactaagaaatgcctcattacattttgtgttgttcccattgcagccagtcagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctgggataggcacagtgattcagacctgtgctacaccacactgaaaatctgccttgtgactactcctggtacacaagatagaccagcctcatctcatttcctgcccatgaattcactgtattctgtacaaagagaaacacagcttaactcctcatctctcccctaatatcacactcccctggcggcagctgcaccctgttctccaccccaccctcatgagttacctaaagaccaaactacaatctcccagctgtgtcagccaagcagccttgctgacagcaaagttctttcagctcttctatgggctggtggagacccattccacctgcttcctaagacagacaaattcctcaaggactggtctgtaaagggattcatttaggagactatatgggaagactagcttcactcaagcatttatccaattattgtctataggctaaaatagtgcttattcattgctcaggataaatgttggaataacaactttgcacttcagtaagacatctaacgtgtatcagatctgctatcttttggacacactgacatttttttctacataacaaatcatggtactattggtctgcaggagaatgggtaaaaaagtgatagtcataggtacgccaacttgtgggtcatatcataggttttcaaccatttcaagcatccctgccctaatgcaagtatctgaaggatctgacccttgccctgcagcagaattcattccatgtcccctctggatattagactgataatttggatcaggtctcagcatgggccattgaggaacactacagccctgctgagagataaaaaggattatccactcaaggagttcacacctccgggccgacatggagaacgtgcctagaagcagacttggagggtgctcagtggtgggttgtggaatgtaagcctgaagaagcagagtttaattctacgggggtgctttcataatttagtaccctgacagggctcctggtgttggtccttagacactcctgggatggctccctggaaacatggaggaaaccttggtcgcatgacatgatacggagatgttggagctgcctggacacagttacagagggaggcattaaaaggcttcgagaggtaggcatgctagagtggactttcccactaaacctgagaactcactggataactgtattccctgcgagagcccagagaaccctctgaattaggaaagaagggcatgttctgaaatgggaggaatcagcgttcttgagagtcttggtggaagctgtgccctgtggggcagggttgactataggagacgctgttaaggaattagctcccaagggtcaatggagatgatgtaatttcaaaataagagtccaaatgggcagaattagtgtgagaagacataaagccagaaaagcagccaaggagccctgctctacagaaatctggggtgacagctaataaaccacagtgttcctaggggtaaggaaattgggctaccacagtggtattccacatatgtattccatatatacatatatatctctcccatatatatatatatatatatgagatatatatatgagatatatatgggagagatatatatgatatatatgagatatatatgagatatatatgatatatatatgagatatatatgagatatagatatgtatatctctctcatatatacataatacatatctctctcatatatatatatatatatatatatatatatatatgtaattggaacgtattaagagaagatgaatgaaagaatgatgtcagctcctcctgttctccaactcagagtcctttgaatgaaggggaaggcagattgccttgagggagaaccttgtaatgttctagcaagtatatatggcagtgattctccgagccttttcccccaaaagatcgaagactagttacctgagaaatttgtacacctagggaaggggaataactaggtctttcaaggctgttggagacggcatctgagctaactttgataccaagaaatgcatactgtcaacgtggtcccccattagagtgaggacacatagaagctccccctctaatgctagttttaaaggcccaagtctatctaaaagggcagtcccataggtggatggactgactgtggtctctaccctgtgtctgaggatatcagagtggatatgatgaatggacataaaataaggaggctgcccccctacccccggatagtccaggcagccttcattcctttatttcatttggaacccatatggcttattctctttcactgactggagctcacagtctggctattgtaacctgtcttaaatctttttctctttaaaatatcttgactttgaggcaggtcttagaaaatgactcttcctgtctcaaaatgcagtccttcattctgattgatgaattggaagcacatggctggtgtaaagaataagaaactaattataagccaggaaacagcaggagaagaaagcagagaagcaacgcttaccctgaagaattaatttccgtttagaaaatatcacagctgatgtgtcaaaggccccggtatgcaggaatgagattaaacaaatgtggtcatgaggaagaggtttctgaataatgatagagaagcttgagtctacaagaaatccagagtccagaatactgcaggggagcagtgctgggttcatgtttatctggtctcttgtctattggatcctctttcttccagaaccctaaaccttgaatcagccttatagtcctggctcctagaagagtgtttctcaaagtgtactccacggaccacctggataagaagcacgtgaggcttttaattaaaaaaaaaaaaaaaagtacaggttctgggaagcatccaacacaataagacagaatcttggaatgaagggtgaaaatgtgcattttaaaataacctccagagctgattcttattcaaactgacttttaaaaactgctgcactagtggcaagagatcgaggggctgtcctgagcctgacacagaaaggtgttctagaaagctgctcacaggctccttcgcagcccaccaaatccgcctcactcttatctcccccagcccctcaaagcagctgctttgacagtttctcacatttttgcatgataatcccacaactgcaattccttctggcttcctgtgacctcacgcaagaaaaagttgtgtactaaatgaatctgctttaacttgctctccttcctcggggatcacacctttttaagaaagcctgtcccttaccttgaagcacaaacatattctcatttttattctcccaataccttgaaggttttcttctgcacatgtatttgtttgatctgccttttgtgcgtggggtgggagttaggtaggaatcttaaagtggagagccagtttcttcccaaattactgacctaacccatccttaacccccagttcaaggccacctttgtgatagtgaagcttccacatgctcactcagccccttctgctctctcttcttctctactgtgcatgtcggcttgtacttttgccagtttctctaaagacacaaccagaggtggggtggctgtgtgtgcacaacttcaactttacatgtggggctgagtccctatgttgtatatccttgtgcaaaagcacaatatgttaattgctatagcttttaaaaaaataattaatagtttttcataatcaaattttcttgcttttttgttttttcaaaaaagcatacttttattgaagaataaaccccttatatatgtacacttatttataactatgaaccatgaactaggatagaaatgcattgtgtatattacaaaacataacaaaaataataggggtagggaggtgcagatgttggtcaaaggatataaacctgcagttctatgatgaataagttctggacatctggaatacagcatggtgactatacttagtaatactatattgtacacttgaagcttactgaaagagtaaatctcaagtgttctcaccacacaaacccaaaggtaactatgttctcaccacacaaacccaaagggaactatgtattaattagcttgattgtggtaaccatttcacaatgtatacatttgccaaaacattatgttgtatacctggaatatataattttatttatcaattatacctcaataaagctgaaagaggggattactaattcccacaaaatacagatttaacaaaaacttttattcaacaaacagtgctatgaagttgtaaattggaaacaaaagaaataaaatttcatccacagtcttctcatcaaaacccttcagtggcattcctctttctggtgtcccagtcttgtcaattttgctaataactgtcatcctgggaatacccaatttatcctacatgacaaaatgacaaagtctgattagatgagttctcagattctagcatggccagaagagcactgtcctgggtcggataaatcacgtggaagatgcaggggatgcgtgactttaaaggtccagcccttagtccctggatcttcatgcaggggccgcctcagcctggatctgctcttcctcaccactgcagccctatcccacgctggctgaggtctgcttccacctgggcagtgactggatgacatgggatgagaggacacacctctccctcgcccagcatcgcatttctctttccctggagatctgggatcttggtcagaatccttcaaacgccacccagggcttgagagggcaagccctcctacaccttgactgcgttttgcccaagatttcccccatattattattttaaacgtgtctaatttagacaaatagaacctgtaagtgctacattgagaagagcacagggccaccgaattgggaagacaagtagaggaaaggaaagcaaatgtcaccagacagaatgtatggctgcaggtttacagcagattctattaaaatctatggttgggctgggtgtggtggttcacccctctaatctcagcactttgggaggccaaggcagagagatcacctgaggtcaggagttcaagaccagccaggccaacagagcaaaaccctgtctctaccaaaaatacaaaagttagcaaggcgtggtggcacgcgcctgtaatcccagctactggggaggctgaggcaggagaatctctggaacccaggaggtggaagttgcaatgagcagagatcacaccactgcactccagcctgagctaaagagtgagaccctgtctcaaaaaacaaacaaacaaaaaatctatgattggctgattggctattgctaacaacttttgagtctttaatgatcagtaattgaattaaaacggttaaaacaacaattgagagaaacatagttttgaacactgacaacacaaaataacttatccatgtaaccaaaagctacctattcccccgaaactattgaaataaacaaacaaaaaaattagaaagcggaaactttacaaaaattattctcaccaatgaggttgtccaaatgtcaccaaatttattatagaatagtaataaccaaatttgtgcatgaatcggtgatgacataagtatcttgtaagcattactgaagttttttttttttctattaaatttaccttcaagatatgccttcaggatgaggctttccactgcacttcattatgcaatgccatgttgacttggtatattacctcagatgtgactctaatatggtttgatttgttatgacgagactaaaatgaaacatatcacttttttcatgtgcatattgcaccttataagcacaaggtgcaattaaataaccaatttgaatattgaaaacatatgtagttgttataatttttttctcctctaaaataatattttcttatttctaaaaaaatctagaaaatagagaaagattgaagacaaataatttgcccatttccattgctcactgtctgtattttgcactttctacctgtcatttccctgcgttgaccttttctgaccatagctgtcactttctttcccattaccctagcccacccctgggctaaaggtctatagagtgtataaatgatagccccagaatatccctctgtcaaaacgttctgctagctttgtatttgaccaccttctcaccaactcagcacaaccctaagccctgcatgtgagaatgctgaaaactggaatcatgactttcagtttttgccatcgaagagaagctcaggaactgggtctggtcgtgggagcccagggactcacagcttcccttcccaagccagaccccttttcttgccatgcccacaaccttcccctcatggccatctctttgactactcaggaggtcctgggtgtcattagcaaagctgaaaatgaaccttcatttcagtaggaactcaaggctgggtctatttctccaagcctttggcaggtgtgtccttcgctggcccttcccaatgcacagtcttcaccatttccaaggacgtgccactggcagaggatgagctggtcctgcctccaggccctctctgtctgctggcctgacttagccttcttcctttggagacacacacacactcacacacacgcacgcacacacctggttcttgaaaactgcattagtccctataatttctactttgtgtgaaccccagagatcatttactggaacccatccagtttccaggtgaaacaacaacaccccacatttcttgagcatggtctatgcagctgggattgtgctgcgtgctctgctcacattctcctgtttactgtccatgtggccctatgacacctctctttacagatgaggaaaaagaggtgaaacaacttgcccaagactacacagctatcatgttattttagggcactgaaaatctccttctactaggacctctgggtgacacgctccgatgctggctcagacggttggcatgggtttttttagggattgctgttttgtgtttgtcccttcctctggagcaagcagcacactcattgttctctgagtataagatggttacatgaagcagaaatttgtcaccagcctggcctggcttctctcccaactctgattctctttaggtattacagccttggaaaagctacttaaaataacagccttactccttcatttctaaactgaagataacatttgtcctatagagttattttaggatttaataaagcaatggccctaaaccaattagtgcagtgcaagagttttgctggtgtccaaccaatgattgctattattgctaattataccagcaacactctttaagcctttttcagcactctagccattggtcatccctcccttcaccttgtggtcagatttctgtctctcctctggaacttctttcttcctcccccatttctctcatcagttacctccttgcaccaccagggaaatagcagttcaggccctaagctggtcgctaccataactcaggaaagtgtggctcaggtccatagtttgaaacaggtcactctgggctcctctcccccagtcaggatcagagatatggtgggctgccctgccttcctttgggtcatcctgtttccaggtcagtctcctacctaaggacctgtgtagaggtggcgaggctttgggacatccctacctcactgctctctccctgacagctggctggtggctcatcaggccggagcagctggcccatgtcctggggcactagggaagcttggtcatcctgcagtgcgtggtccgcaccaggatcagctacacccactggtaccagcagaagggccaggtccctgaggcactccaccagctggccatgtccaagttggatgtgcagtgggattccatcctgaaagcagataaaatcatagccaaggatggcagcagctctatcttggcagtactgaagttggagacaggcatcgagggcatgaactactgcacaacctgggccctgcgcagccttgcatgctgccccagccctacacaaaaggactcttcctcccgatccaacaaggccttgggcattttcacttactcttggtcccttgggtttccctgtggcatagaagaaaaaagtcttatcccctgtccctcacctccccatctatcctggaggtcccttccccggtcccactacagatgaggctttcagcttgtgcagactcagtgatctatatctcatcgaaaggggtctgtttaaagatgctccagttcagtgtctctgaagcctttgcaggatgacctgtgctcctgaatgcaggtgccactagccacctgtggctattgagcatgggaaacataccaagtgcaatagtccaagctgagatgggctgtgtgtctaaaatcatattttgaagctttagtgttaaaagtgagataactcttataatgatcaaaagttgaaatgattaggtatcttggactaaagccaatagcattaaaactaattttacctgtttctctttactttttttaatgcagcaactaaaaaaattaaagtgtgtgactcacattggtgactcatttatttctgttggacagtgctgttagagactgatcatttaagaatctgaccatctcccctgaagaatgcacaaataaaatattttggaagagatttcaagggtggaggacttgctgagatttaccacaaaatggttgaaaagctgagactagaagcctactcctgtttccagcttccaagctcttggccctgggactgttatcattttgcaatagagtcagcaattagaagcatgggaaacatgactgcccacttctcagtactttcacccgtgggcgggctgcataggaactgatgtgagtagacagtcgccatggcagggtgatgcagtcctccctggatgagacatttaccttccacttctccttcaacagcaccccagtgtggaacacgtgtgtatcccaagcttctctagacttttgttctcctatctgacaaatgagggggtttagccaaatgtctgctaagttatatgactatgatttttgtattaaagcaaagccatacacataagatcactatgcccactaccttcatataaagcagtcttttttaacatagaataaatgaaagaaaaaaaaagaaagcctgtgttactgatcctccagcaccaaacaggaaacccctctgctgctctatgtgcagaaaaaaaagaaattctttgaagtctaagctgaatttaaatgccttttcaagagaatgcttaatacactgttgatgagaatgtaaattagtacaacttctctagaaaacagtatggaaatttctcaaagaactaaaaatagaactaccattcaatccagcaatcccataactggatatccacccaaagaaaaataaatcattatattagactgcattcatatatttatcacagcactgttcataatagcaaaaatatggaatcaacctaaatgtccattagtggatggctggataaagaaaatgtggtatatatacacagtggagtactattcatccataataaatgtggtatatacacacaatggaatactgcttatccatacaaaagaatgaagtcctgttttttgcagaaacatggaggaagctggaggccattatctaaagtgaaacaactcagaaatagaaagacaaatactggatgttctcacttataagtgggagctaaataatgtgtacaagtggacatagggtgtggaaccagacattggaggcttgtaagggtggtggggggcagaaggaatacagatggaaattaagtaatttcacatcacaatgagtattatccaggtgtggggtatactaaaagccaagactttaccactgtgcattatatgtgtgtaacaaaattgcacttgtactccttaaatttatacaaataaaaaacaaaaggagaatcacttggacccaggaggcaggggttgtggtgagccgagatcgtgccattgcactccagtctgagcaacaagaaataaaaaaaaaaaacgctacgccttgcttctgaaacagcccagcgtctctaacctctactgaaggctcagttcacggctaaggccttccaacttgtgtgagaaggacagaggccatacaggaggaaactttcattctgttttggagttgttccttcatttcatttttctaattgtgctgataaaaccaaatgggcacagagaggagatgcctcctcttctgcctgccccctctctcagtgctttactccaaacaagagtaaatttggtgaaatggtgactatcagggtgtggccaaatggaggcgcaagctccccagtcacctccttatggaacaacatctttcatttcctcaagaggagactctgccactgcagtgaaccttcaccaccacaaacctccaccttcactcctcaccaacacctgctgtactcttcatgaatgctgtgagcttgagcgagttcttaaatttcctagccatcagtttcctcatctccaaaataaagaaaacagcaatgtccaaaatcaatctccctctgaattatactacctggtttcagcctcaacctccagggtgatagaccagcttagagaccaagattttatctttcctaagtgatctcaccttcagaggcatcatcaccagacttttcaagttttgtttcttagaaatggtcccaagttctttccctctcatcgtctcttgctttagggagcctcccagctagtctgtcttagcaagacaagggcatagctggtgcattgctgctggtgagcaggggcaagttcacagaaggcagcatgggagagtataacagaaatcaccatcagtttccaagggcttgctctgtgtcaggcattgccctaaacagtctacctgggcaaacatttattctttgcaacatccagtaaggtaggctgtgattttattctcctttggtagataagaaaacagaggcagagagaactactcaaagagctcaggctttgcagcccgatagaattaatcttaaatctgtcaccaacaagctgttaaaccttgacccattacctgacctgctttgagtagggctttgtgaagattatactaaatttatggtattaaacatcataatggctacaaactgcttgacacattaaggcattcactaagtgtccattgcttggtaactctttaaaaactgtattttaaatggtgatgttttgttaacatcagaacgacaaaaaaatactacaatggccatccattccctcactccaccctttcatctattcaacaaacacctgggaatagagagataaacagcacatgatcttactcccctgggaactcttaactgtcgtttagaatgagagagaaatgggtaaacaggccaagacttgggtaggaggtgctaggagagaggaaggcactaggtggcgtgaagagaaagcaatttgaagcatctccatcctggacttactgggtgaggtaagcttcctggggaagactgcctggggctgagcccagaaggataaacaggaattagccagggaatgtggagtagaatgcagtccaaacacaaaaaaattcaagtcaatccatagaagtgggtcgtggaattccaggcagaaagtgactaaatgaagatggaaggacagggagggggtggccacatcacagagaacctcttatcctaagaactctggacttcatcttcagaggcaaggtagagagagcaaggactttagagcaggaaaaggaccaggtcagtctagtggccatggggaaggtgggtgggaggggccgagatgggatgtatggaggtgcgtgaggtggaggcagtggtgagccaggaaatgtttaggacgtagaatcctcaggaattagagtgcggtgaattagaggggagaattgaggctgatgctcaagctcctggcttgggcaatgtgggtagttatgtcatacagggaactcggaagaagatatggtttgggggaagggaatgagttcactctggctatgagcagactttgtttgagatcccatgtcagacgtacttgaaaatgtccaagagttagctggatatgggtacagacagctttcgatttaactgaggtccgacttaagatttttttttactttatgatggtgcaaaagtgacacgcatttggtagaaaacataatttgacctttgctgtttccccaggacagtgatataaggttatgatactctcttgcgatgctgggcagtggcagtgagctgcagctcccagtgggtaaattaagcatggaaatctggaacacagcagcttttaagggatgcactggggagagcagtttgtaaaaataccttgggacggattaaatgtcttggcttagagaaagaacaacagacaataggaaactgtcattgaggagaagccgggattcaggagatgtacattattcaggtagctgagggaggggacaggaacctgaatcttcaacagaagcaaacaaactgggatggagggcccagcctcatgaaggtgaccagaaggacccggtgctgcaggctgtgtgggtagctgagcagagctaagcggcttgacggaccaacatctctccagctggttgaagacaagctctcagaagacaatgctgcatgtcacagccccagcaaccaacaacaccagcctgacaacttgctggggtggccgccttgtggtctgaggtggccgtctaaactatgtggtctgatctcaggctgcagaccttgcaggactgtcttcacacagactggaagtgctaacaggtggtgaggacaccgctttacaacgatgcagggggccccatgtcaccctcacccatgggaagtttgacttggtggactcagccaagccacagaggtctaacgcttctctgcggtgatttcaggctgccctggcagaaagcacagtgcctgcagacatgctgtcactgctccacacatcaacgctggcagtccttggggctcgtaagtagttttgctcccccaatcactttggactgatattctctattgttatatatttttataaattccaaattcttggtttatttactccctcccatttttttccccagtgtgtgtatatggtgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtgggaggtgcacagcagcagacagtttgagccatcccattcaataaatgtttattgagtctttgtttataattacgaattgggaagccacagttaccaccagtgtgcttgtaaacagtttttaagataaacattcatgtggtgactctacttggagttgccaaattccacatattttctcaaagcagaagctttgcataagtctatacaagtgaccagcctcctctttttcagggttgtactctctcaccaacagcttttctaggtcacccatgcttatttttctggttcaacctctcctactcattatatattttttttctggtataatatatacacatttttagtgtgattcttttgtactagtcaatatgcattacataagttttctctgaccttcctatttctctcgattaaaaaatggatatgacattaaatggtattcatttttctggaggttaacatgtaacaaacgcagcatgatctaaccacgagcagggcagactgcaatgacaaatctatcacatgcatgccttgagtggtgatgtttgattttgtacaaaatccgtaaacacttccactaatcgaatctaagtcaaagtccactttggattggggtttgagaaaaaattcatttgctgcaacctctgcctcccgggttcaagcgattcttctacctcagtttcccaagtagctgagactacaggtgcgtgccaccacgcccatctaatttttttgtatttttaatagagacggggtttcgccatgttggccaggatggtctctatctcctcctgacctcgtgatctgcccacctcagccttccaaagtgctgggattacaggcgtgagccaccgtgcctggtcatccaaccatgagcttttgatagactactctgagccaggcattatgcacagcagaaattacaaggcccatacgctctgcaaaggcccgaggttgcttctgttgaaccacattctgctactgggctgccattcaccactaaaatggcagtcctcaacttgaatataactcatgattgtaagtctcttatgaattttcgttacttctagttcaactcaggctttgcaatttattattgttgatggtgttgttttaatttatgtttttgccatgaaaccctttcttgaaatgtgatcttacaaatataaaatagagaaaagtagatttccactgggaaagagttcagagatgaatgatccttagtctcatcttctcaaatttctctgatactttgatttttcaacagctcaataattatctgagtatacatataatgtacaaagtggtcaagacctgggcctgtcatgtcagaaggacataggtccaaatggggctctacttaccacggataagctgtgtggcaaggccttgagcttctctagccccatttcctcacctgtgaggcaatggtcctgtggttatcatatgggtggctgtgagaactcctgacatgatgcatttcaaggatttggcctagtgcttggcatattgtgacagcccagcgttatctgacaagagacaaaactagatacaacaaaaaaataacagcaagcacacatatatagtcatgtgtcccttaacgacaggaaaacatcctgagaaatgcatcctttggcaatgtccttgttgtgcagatattgtagagtgcccttaacacacacctacatggtacagcctactacatacctaggatatatggtatagcttattgctcctaagctgcaaacctgcatagcatgttgctgtactgaatgctatatgcgattgtaacactgataaatatttgtgtatttaaacatagcatagaaaaggtacagtaaaaatagaatataaaaaaaatgctacacatgtgtagggcagtttcattataatttgtccatctttgactgaaacattattattcagcgtatgactatatatacaagaaaacatacacacacacacacacacacatacacacatctggtttttttttttttgagatggagtttcactcttgttgcccaagctggagtgcaatggcgcgatctcggctcactgcaacctctgcctcccaggttcaagcgattctcttgcctcagcctccaagtagctgggattacaggcacgcactaccatgcccggctaattttttgtatctttagtagagatggggtttcgccatgttggccaggctggtctcgaactcctgagctcgtgatcaccccacctcggcctcccaaagtgctgggattacaggcatgagccaacacgcctggcccatatacacatctttatatatccagggcttagtgctacgtctatcatagtgtggctattacattttatagagagaatagctaagtatgaagaaactcttacaagaggttatcccagattaatttaattctaagcttttggtcatggttccctaagacctttgactcacacacagctggacaggacagtggccttgtgcatagtgcagatgaccattataggggaaaaacaagtcgaaattcatagtcctttactcctcctgcccttctccttttgcttaaggtgagcttcaccaggaacattttcgccacaccaaaggaaaactagccagaggcaaaccagctctaagttaatatttgccaattaaatggtttaagttttggattcacagaaacactgacagcatcttattagaatatactgtactgcatatagtaggggctcaatgaatatctgttgaattgagattgatactttcattattattgatgggttcattttacctaatgggtcaacgcgttgtatggatggatgccctgaatattctgatgatttgggttcgacttcttttcttttctacctgaggtgggtgagctacaatgactctgaataatagaatcaacattatattatctagttaatataaaatctgaataaaatctaaggaaatcttggaaagcaatattttcataaaccatatcatctgttgccgaactccccacacatacaagtactatggaaaaagtaatgtctactgcccaggagtcatcttatagaaaccacaattctagaagttgctgtacccacctggaaatccatgctgactgttttgtctcgggtgctttttgctttcagtcctgtgaaggggttcacaagaggcagactggggtagacaaaaaaagggcacagactttgaaatgcttatctccagacattgcgctcatgagtatttttatctgtgtcatttctgtacttttgaaatggtctaatagaaaacacattactttttaattttattttaaaattgacttaaaaaaagaattcctgttttataatattaaacatatccctgcacattattgagcacctagagacaatatgtaaaatgtgttggttagaaggacctggaaggggctctgcttgactactttttctttcctcttctctaacaacgtttgcttcttgtaaaaagcaaaatcttaccttttctcctgtttcctactgatcactgtgctgagctaaagaaaatgttagtgatttgaatgctcaaggcagcttattgggcttgtatgtcttcctggaacactaggatttttcaagcctgtagatcaaaggtcttgggaaaaaagaaacaacttttttcagtgagctaactgaaatagaagagaatggcgactcctacccacacctcttggatcctggacatcagctctggctgtggggcaaatggcactgcatattggccaatgtggggaggatgcagccaacttaaggccccttttcagggagggaacgctgaccccacgctcctatttcccagctgcctgctgatgtttccattttctacccccaaacaacacctgcaggatagggaagaccatccatgcagcccagggcggtcagacttttaaggcagagttatgtggaaaatggacttggatgagccaaggaggaaatcctgcagatggcccaataagtggattatgtttgacttcagataagtaggacaagctagggagccagaaggttttattagttttgtttcactttccacaaaaccaccaaggtcccatctccaacagaacaggatgtgtgactgttccttgagtaaaaaaacaggaaactggacaaatcttgagagatcatcattaattagtacttctttagttgatttcttaatatggaggagcatgtagattattaataatgcttttgttcttgagttaagtgaaggagtcttaggtatttgttgactcattaaataaatcaccaacatgtagtagactcaaataagaaacataaaagtgatacacatttagataaatgattatagtgctttatgcttgtagtgcttcatgaatcgatagtatgattaatccaattgtgctcgtagtgttctttacaacaactaagtttaaaatagagaaacaatctcaactctcattagatgattgaggatagagaaatgcctgtcacgttcatgtcaagtagaatttatcccctcacccctgttgctataattgatgtgtctcttctgtagatccctaatttaatttcttgtcacttttaagtcaacttttaactagcaaattagcaaagtgctaagggattcagagagattgaatcacgtgctatactttactgtagtcccgttctctttatattttacttataaactaaagttacagagtaattatcaaaactccatatttgtgttctgaaattggcagaatttgaatttgcagtccataggtcagcagatttctctgactttccttattttctttgcttagccacagaaaaacagaaaaatcagtgagtttacatgcacagaattaaatgtacagactattctctgaaagagctcagttctatgtgaaaatgaataatgtaataaatattcttatgagtgtagtaatagtagctattgtttattgagtacttcttatgtgcatggcactttatactgcatgctttatgtcatttgagcctaacaaaatactatcattattattatctcatttttatagatattttctttttttaataaactcttttatttgcacgtttgtgtcttgggttattcgtggggtgagaaacctccacacttccaatcccagccatctggtacaatctggtgttgtggtccagctgtcggcaaagggtagaggtgggtgcagggctggccccccagtctgcaccaacctcttcagagcagggagctcagaccatggttgtacttgcactgcttcagggcctcgctgaagccttcacacagggacaggtcactctgcgtggtcgaacagtccaggaactgccggatctcgtaggcgcaggaccccatctgcaggggctggggggcagcgcgtgtgggggtctgctgggcagcaggctggacgggctccgagctcccccatctgaaggctcaggtcagggcgctgcccatgacgtgtcccacagccgagcccacggctacccctgcggccatggacgccatctaagccatgaggctcggctggccggaaggggcggagatggggcggctgccggaggcggtggctgtgtgggggcaggtgggcagagggcgcggcgggagggggctgggtggtcggaccgccgcgctgcggcttcccagagacatggtggcggcggagggacccgggcgatcttaaatgacagcgatggcggcagcggttctgtcgcggggacaaatgccctttatagatattttctaagtacagatttgagactttgataaattaagatacttgatagtaagcagcgaggctgggatctgaatccaggtctgtctgactacaaaatctattgccttgatctcctacagtgatgagaaaaacaaaaccaaacacgaacttttaaatagagacatttcagggggaaataaaaaaatttataattcgttttatgagttttttttttttcatttgcggccttaagctcctttccccagggtcacatgaagttagttaaattgatgctaacggtgtttacttacagacaatctgcagagaattctctacagagaattttcttatgcaatcaagtttttctgacttctgggttctaagatttttttctttttttaacaagaaaaaaaagcgtaaccaaaactgtgtttattgagcaacagaaaagcagcgagatggaacacagagatattccccctgattatcacctttccgctgcactcccttaccctcagtccgctggggagcacagaaatgttatccaaaggtggatgggaaagggtggaaaggctgagacccaactgcagcctggcctgagatggccacatcatgttctgcttcctgcctggctgcccagggagggcctggatgggcagagggccaagtcagtgtcaggctgggaactttacatgcttttctcacttaaatattgtcatctcctttctcagaggaggaaccagagattcagagagactctgtagcctccaagatcacgcaggcatcactagtagcagagaagggatgtagagcaagtgtgacggtccataagacttactctcttcccaccacaccacactcacccagcaagaactggaataaatgacaagggagggaagaggggctcagacttctctgtatattcacaaggatgtggaatgtgttcctgtaagcgtacccaagttgggaatttggtcctttaaagaaaaaggttgaagcaggaagacttccagtttgctggatgaaacataatgcagcaatcaaacagcccgactcttttgagtgaatatcaataggaataccactataccattcacttgttcttcaaaggaaaaaatgaaactaatgagtccttgattccatgacatagataaatgttctgagaaggaagaagttaatggatcactgggaaggcttcatagagccagaagattcaagtaaaagtcttgccaaacaagaaaaggagaaagttcatttttgtcacagtctggttgcaacagtaaaaactagcttttgtcatcatcacattttctaatatcgaaaggacatattttaggaaaaagcatcccaaatttataggtatgttgttatttatagaacttcatttttttaaatcaaactcttcagtgaattaatttttaccacctcctcaggtacaggataaatgggacatttgcagccagtttcctccttgcccatgtttgctgcgaggtggggcgtggatgtggggaacctctctgggggaagaggatgggtgcagcagcccgacgactggtcgtgaggccccaccacaaaaagcctccacttaaagggcaatgctgagagccccaccacacctcatgatggggaattcctctgtctagagatgttatttattgtcattcaagtcaaggaactaaaatcctaagaaaaagagcataccccaaagccaaactaggcctcctaacagtagctctgtgctcatcctgcttcaacaaggaggcagagtagagaggaaggaggtgaaagatatggaacccactgagctcccactttattccaggcgtattatgcacctatctaagccaatgctggtagatagggatttcaatttcattttcatagttgagggcactgggtgtcagatagcaacaagtcaagctaacagcaggctgaactggaattaaaagcaggactgaatgattgcatgctcgcctgtatagcacactacgtggatttgcttggcattgaagaaataggttttagttccagctctaccatttactagctgagaggccttacattaccccctcttccccatggggaatcccttcctgcctcaaaatattgtttggattaaataagccaatgtttgtaaaagagttttggaaattgtagacaccataacaaagtaaagagttatagttttttttaaacacattttcattcattctaatatgatttctcatatgaattatctcctaaggatagtcaatatttatggagctcccactatagggaaggcatccttcttgatgaaataaggggctttaacaatccctacaacttatgactttgacttaacaaaaacgaaatctagcatgtgttatatgaaagtagcaggtaacaagtggtctagcaaagctgcagtgctatatgctgagtgatagaggtatttgttgtaacatccactccaattcctcaagaaaatagatggtggcaaagaagattaagtgatattgctcattaaatgatgagaatttttacatactggatattcagtgggagtttcattttgtcccaatctccgctgacactctaagctcaggagaatggtagtaatacaaaagaaggggacaaaaccagagattcacagtggagggcaagcccctctccagcagacattggtaatgtctgagacattttttactgtcacaaacagagtgagaatgctactggtatctagtgagtagaggccagaagtgttactaaacatcctacaatgcacaggacagccccacaacaaagaattatccagcccaaaatgtcaataatgcagaggctgagaaaccctggggtagttggccatatttctcaaagacttgctaagaggtagacaaaactgatgactccaacctttggctcatgagctatatccaggctaattacagtaagagctttcctggggactctaattttgcaaagactttctctgaaaagcactgttgggatttccctggaaaccccctcctctcccagtgaggaggtgatgaggtagctcttctacttccacaccaaataggactctcaggtcctacatccaccatgggtccagagcagagccctgtgtgtgggtcatggaagtgttgggtctgtgccgtgagcgtttggtggccagataaaccagtgaggactctcacctggaaaagtggacaggtggcttcaggtcatagcccacgtggtaacttggaccaactctcccctgaaatcagttagataatcatgatgaaataataataatgaaaaagaatctttctaaaagtttctaagagttagcaagataacaaggtgaataacttttaccctggcaaatggactgattatcatggtgtcatacagctatgggtaaagttcccatgtgatcctgaccaatcagcaacctcagaaatgactgatctgggcgcagggcctaaggacacccattttctctgtgaacactctttgaggttccccttcctcatcctggtgcagcttctcctgctccaggttccctatttcctcagccttgtctcaggcactcagcctgagcagacgggacgtcacagctacagatatgcacctgttcttcactctgggaatgtgaacttgttctcctacttctcagattggctgagggatttttttgaaaatgaatgtctcatttcttgataactttggtttcattgaaaatgctattttgtttctaattgaaattgggtaaaaacaattgaagcaagtaaaaatctttatttcattagcagaaatgaagcatatattttcactgtagggtatttagatagaacttttcatacacactcaggtactgaccaacaccaaatcaggcttttgaggatttgatatttacttggaaaaaaaccctgttccaggtcaattacaggcaaagagctgcaaccatatataaaattctgtatataaattctctatataaaattctgtctacttccctttagttcttaatataaaattcctagaaaaatagaaagacatgatgacccaatataatggcccccaggaaactagcatgacattggagctgaggtaatgggcacttgccccattatcatgtctgcgaccacatccttcccaatgtggaagagcctcgtccagccctctgccccagctaggcctcagcctcagcttgcagcacttcctgtgttcctcagatgatgcctctgtgatcacaggaaaccagaaagggagtctgatgactatcaatttcaccccacaaatgccagtacctatacccccaagtgtctgatttgacatcatttcctattgacttaggttcctatttagagactatgtttgttgaaactgcatgattatttcagagagaaagcaaggtccattatatcatttcttagaaacttctagtcatggtgaattgctcagggtgaagatgccagcaaggaacaagatggaattcatatccactcagttcccactggctgccagaaaatgggatagatgttctacatattcagaatttcaggtgattgtcataagaacctggtaaataaacttattcatgaaagaaataactgatgtttagacaggggcagttatctgtccaaacaaatagttcatgctctttcaagtgcactattgggccactttgaataccctttgggtttattaacttaatggaaatagggccaggggcagtggctcaggcttataattccagcgctttcagaggctgaggcaggcagatcatttgtcctcaggaattcaagaccagcctgggcaacatggtgaaactccatctctacaaaaacacaaaaattaaccaggtgtggtggagcttgcctgtagtctcagctattccggaagctgaggtgggaggatcacttgagcccaggaggcagaggttgcagagagacaagattgcagcactgcactccagcctgggatacagagcaagactctgtctcaaaaacaaacaaacaaaactttataggaatgaactgtggcatttgtgggtaattatgcgctggcccggacttactgcctagtcctgcagagctaggtcaagacagaatgggcagtgactcaagacagaatgggcagtgactcaagaagccatggctaaagggtcatgctgaacacacatttggaagagttcccaccccccaccccacccccaccctgctccccaccggcattctgccttaggacccttcttctcactggaggggaaaaggctaagaaaacagaaaaccctctctgttcttgtgaacttgctttagcagataatatcatgggtgggatacctggagagggatcaaaacctcacagcccagacttaagtaaatgatcaaaatgtgtaatgaggatcatgttttggaaatgtggccaacatatttttattctctaaaataaatcatgtcaccttttgtcctttctttattgtagctaatccatgatatttactacccatagaaagagatggtagttgcccagaacaaactcacttttttttttttttttttttttttttgagatgaagtgttactctgtcgcccaggctagagtgcagcgcacaggcgcccgccaccacgcctggctaatttttttttgtttgtttgtttttagcagagacggggtttcaccgtgttagccaggatggtctcaatctcctgacctcgtgatacgcccgcctcagcctcctaaagtgctgggattacaggcgtaagccaccacagcctgccacaaactcactttttgaattaattgtgagatgttgggcttgaaaatcaggttcaatttttttttaaagagttttctatagttgtgattctctcattcataggtcaaaaggccacactggcaaagtaacaacacagaattttattacagctgctagatatgaagactcagcatatgatatcggtgacgttaataccttcccagggagaagcgctgttccttctggctgggaagtgcgagccggtggggggagagagaggagtagagcattatgtggaggtacttcccggttcccttgcgtctgagggtcttatgccagaggggatagaaagcccaacagaaactcaagatagaagaaggagaatctgcgagtgtctgtctcctgtcaagcttccctaatacagccctggtagaacttcatcaacagtggaaggcatttgcaaaggtgagcccaaaccagcacccctttccacacaggctgtccatgtagaaggcccagatgcttctcagggtctctgagaggatacaaagctactgagggggccagagggcacagcacctgggatttggatgagaagctgcaggaagggaactttgcaccccaagggcatggtgtggagtcaatagtggcaagttcagtctggttttttacatcagccggttcagaggaagagtgaaatccccaagatcagcagggcaaaatgctggaagttgtcgaggatgcagagagtagcaggaagacacctctgagaactcactcacacaccctgcccctgtgtagagatgtcatcctggggatgagaaggaggaagacagagaaacgcagaaaagcctaagcaggcaccacaaagagaccgagcccgtctgaaagaggctgctctaacctggtggaaactattttaagttggtaagtttagtgcctccccacaatatcagaacgagcaagagacgacaggtataggttgtgtacatttcccctctgcgttgaatgatagcgtgtgcgtgttccaccactgtgccctgctcaaagttagctgggtggctgtgccctgctcaaagtcacttgggtgaggggcgcccgtgggagccaaaaatcccatcttacacccaccccctgcacactctggagttgggctgtgacatgctggagaaaggtgtctttgtctaattattctgcctaagggcatgccttttgttaattagtaaaaggaagccttatttgtgctctgcagagtgggggtgctgtttaggaggtaattcgtgatagaaccacacagacaagatagattcaatttaaataaattgaatctatgaagcttcctaaccccatggaaacacaaaattagtttacacaaaaataatcattaaagaactaatgaaaataatgtttgaattcagccaccagacattacattccagagccttgagaaaaactgatgaaaaaaaagtcatgaaaaaaagtcattcgcacaagtgacaccatggtgtgaagtcaaggagcacagactctggagtcagagggcttgagtcaacctgagcatcttcagctttgactgtgaagacacagctttgactctctgtgttgcagagatggtagtgcccactccagtgacgcttgtgaggattagttgagataataaatacaaaatgctgagcatcaaacctagagtagagaaaggtctcaagtaagtactcattaccagtatttgttatttaatttcacttttgtctacattcccttgtgtgaaatggtttggataattaattaaggaaaactttccctcagggacattgctgatattgcaatcttcactagatacacttatctctacctccgcctccacctccaccttcacctccatctcttctctgtctctatctctatcttcctgttgtttatctatctaattatttataaatgaactggtgggtttgttgttgttgcagcctggctaatgttatccagacatatctgaaacctcatgagtggcatggaatggcagtccctgcttgaaccatttacctcctttcctaacaccaacaatcacacacacctgacactgacctgaagcctctggcctgtcctcggaggcaaagactgggtagacaagatgcctggttaccagcaatcttctgcaatttcctctgagctattgagattgcttttctctttgctcaaattatgtgagaaacttttaaaaaagaatttaatgtgctcttttgatatttcaggtgttcattcaaaagcctatgttattctctgtctctctgtctcttttcctagttgggtaatcaaaatggcacaatcagaaatatttatatctgcaacagaaaagaagaataaatttattcatgcacaagtacattatgtacatatatatgtttgtgtatacatatatctgtataattgatatatttgggagaaataaaaggtttcattaagcacacaagttctagagttagaccctctgtcgcaaattactgtcctgtcacttaactcctgccagaacaaagtgcatacttgaacaaaatgcctgctctgtaaaaatgccttgatcttgaataaaatgcctgctaggtcaaagcttctattttcccacctagaaaatgggaacaataataagaatcctcacttaatagataatggaaaaagttgcttgcagcacagagcctgctacagacaatgccttcaattaatgcaaactattaatattatgaaaagtgagtatctgttttctgacaatgttttcaataatataaattctgcctttgttcactttatttgtttgaaaaaacaaataaaaaaccaaacaaaaaagtgtcttaaaagtgtccatttgtctttcttcttgactcctagtaacgctttcctgtgtttagggaattttcacctcatgggttttggtgagtgaatgaattcatctccctctacagaaaagaagaatgcctgatgcattttctcagcctttattccaggtagtcaggtagactatggactccagcaattagatacactcctcacaacccctccattacacacacacacacacacacacacacacacacacacacacacacacacggctgctggagttgcagggtctggaaggaactgtctggcagggatggagtgtgcagggtgcctagtgagttccagcgtggccgtggctgccctggctgtggcagcaccagggctctaagccgggccctgcagactggctcaatctgcagcatgggcgctctctcttacttcccattcccaggacacatcctgtgcaggggaagagtgagtccttctagttgtagccacaggcccattggtctgctgacctccacctcctcaatattcgactccccagcattgagtgtctcaaaaacagtatttttcagaaaagagggtgaacagggcaactgctttaggaggagccatccgagccagctgcttcctctcctgtctcctagggaggacccaagctgtcggagttcatacctgtcccacaaaacacgagccagagctggacaaaagtgacagggacaaccactgtccaaggttaagtgagccctgaggcaccagaagatctccaagaaagccacatggaaatcataaaatggagctgaatggaggaaaagagaagttctgtaatgtggaaaaatgaagtactaacaatatttgactgttttcccttgatttagccaggttactacttcaaaacagtcagcaaagcattttaacaatgaaagctgttggggaaattaaatggctggaagtggagggaaactgtgcattgtggtgcatgcctgttgtcctagctactcaagaggctgaggcaggagggtggcttgagcccaggaattcaaggctgcagtgagccatgatcacaccactgcactccagcctggccaacatagcaagaccctatctctacaaaaataaaaataagaagtggaggggagataaaaatgtagtggtaggagtagtagtaataatatctaataattactgaaaatttactatatgtcaggaactatactaggtgtacttagctatttagtctgcataaaattttaataccagtgttattattgtatccattttcagatgagagatttgaggcacaaagagattaagaagtttgcacagggtcagacagcccctatgtgataaagatgaacagttagacattaaaacatgttttggttgggtgcagtggctcacgcctgtaatcccagcactttgggaagctgaggtgggtggactgcttgagctcagaagtcggaggccagcctgggcaacatggtgaaaccccgtctctacaaaaaatacaaaattagccaggcatggtggtgtgcacctgtattcccagttactcaagaggctggggatgaaaggattgcttgagcctcagaggttgaggctgcagtgagccatgagtgtgccactgcactccagggtgggtgacagaacaagatcttgtctcaaaaaatatatgtaaagaaaaaattctccaatgacatgggaagttgctcagaatataagctgaactgaaagaatacagaacactatacatgtaaatatatctatagtccataaaatcatattaatattcatgtatccaaaatgaaaatatctacaagtgagcatatgataatgtgaatagtagtgggcctttgtgatatgaccgtagatgtttttattgttatctttccccattgctctgagtttcttcaatgagcactgttaccagcatgttctacctatcagctgtgtgacttctgtggagttgatgactctgtgcctcattccctcatccaaaaaatgaaaattccaagtacccatattaagtgatcattgtgaagattagaaggtgaaaaacgtttagaaaaaaaaaaggctagcaaatagaaaatgctcaataagtatttgctattataaaagttaatgtttattaaatatgcaacaatttaaaatattatgctgaggaaaagtgttcacgaacaactcctaggcaattagaaatccttctcatttccacagaaattaagcaacccccatggccccctcacattcgtgcagagaacaccatcgagattgctagcctgatttgagataagcagggtgagcaggaggggggctcagtgctgagcctgcaggaggcactgaagggcccaaaaaaccattttctttctctccccagttcaggccacaccctccagaacctgaccagagtcgtctagccaccaggtccgcactttcctgccttctccttgggtacaccgccccgaagacaggatgtcactgctggaagcatttgccttctcctcctgggctcctgagttgctgtccgaacatttcagtctagctgcgtgaccaaaatcattcttcaatgtttccctcttctactgtcagatgttcattggaaattctcctcttttacttacagttggacttggattatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgggattacaccatactagaactgttgaaacaacatgcacaaaatcccctcccagggtctgtgcccaccacatccttcccaacaggggcaaccacagccagtccccagctgggctcccagactcaggctcgccttctctgaggctcttccggggctttccaggaagctgttatgggttataccttcgttcccacctgatcccaggacttgtgctccagaatctttatttgacactgtttcttaatgcattaaagacttgtctggggactgagagaacataggtcgtgccactgtccatcatatcaccacctagagacttccagtaagtagcaaggtgcagttgagacagggatccttattacgtacagtcaagacaacccccctgcaatataactatcactggcccagtttacaatgaaagaaatgaaagcttagagaactgaggttgcatgatctgccagacaagtcatgtctttgagctggtctatgagaccacaccgaacagtttaaggattgcaattctctaagtaaatgctaggatatctgggataaattcgggaaggagtaagtgcccttttttctgggaggggtagggaggagaatttgcctgcatgagatcgtcagaatagagctccaagtcatcccaggggccattggatgagacccttcatgttggaataacctttggtcttacctgtaaaggaagagagaattgtatcgtgtgtgtgtgtgtgtgtgtgtgtgtgtgtgtgtaagttctctacagtgttctcaattctttgcatatattagctcctttaacccacactacctatagtgtctgctctgttgttctcatcaaacatatctaactcctgaaataagtggagtattagttcatgcacttgtccaaatcacagagctgataggtggcaggacagcctagggagggacccaggtaatctggttcctcttgaatatgacactaaactgcttctgaatcacaggagtataaaagaaaagacacattgttcctgtccccatggaggagacagaactgaccatcatggaacagtaactgacacacattactaccgtgtgctgaaacttgtgcccagggttccagtgattaggtgtattcagagaacaagtaaaatgccaataaagtaccaaatgacttttctttctttttttttttttttgagactgagtctcgctctgtcgcccaggctggagtgcagtggcgccatctccactcactgcaagctccgcctcccgggttgaccccattctcctgcctcagcctcccgagtagctgggactactggcgcccgccaccacgcccagctaattttttgtatttttagtagagacggggtttcactgtgttagccaggattgtctcgatctcttgacttcgtgatccgccagccttggcctcccaaagtgctgggattacaggcgtgagccactgcacccggccaccgattgacttttcaatataaaaacataagaaatttgggttttccatatctaggtacgtgacaggtactgttatctatacttcatgttcattatcattattatgtgatcatgtaaatttcttaagtctctggaagccatttaggcacttatagatgtagaactgagacctaaagatttcaaataactcagctgatgttagatagggtaagtagtctagaagggtgcatattgtcataggtcattaatagtaatattcagatgagcttttgaaggacctgatatatttttaaatataaaattaaaagatcagaatataaaactgtaaatgtaaaacccattaaaaaacgtttaatcatggctgggtgcagtggttcacgcctgaaatcccagcactttgggaggccagggtgggcggatcacgaggtaaggagtttgaaaccagcctggccaatatagtaaaacacgtttctactaaaaatacaaaaattagccgggtgtggtggtgcacgcctgtggtcccagctactcaggaggctgaggcaggagaattgcttgaatccgggaagtggaggttgctgtgagccgagatcgtgccactgtactccagtctgggtgacagagcaagactctgtctaaaagaaaaaaaaaatttaatcctgtgatcctgtgtaatgatccaaacaaatatattactatctacaaatgtgtagagaacatgcttaaaagtaaattctgattgctcttattttctttattttaattaactaattaatgttctactagagtcttctcaaaatattttcatcattttgcaacatttggtcaggttttcttcagtgaggattgggtagttatccaagctcccatgtttaccaactttgtgatctgggacgtcatgcgtgccacactgttcttgtctatcagagagagataataataccactgcctctcaacgctggtgagaagtgtgaaggaagtaatggaagaaaacgtttagaacaatgttagcaagtctacaatagatgtttgatataacgttaattttaaaggcttatgattacacataaaaatgaactttatttaaaaacacccctctctgtgacatagtgttcatgagatagttctgaagtccaaggtgagttcccacagactgccctgtcggtccctccagcaatttcaatcaagtttcctcttgaggtgcaccctctttataagtgaaattggatttctctgagttataatctgcattgtgacatcccaattaattataaaccaaatactttactgtatttcaaacagaaatgactatagctttttaaatgaggtatgaataatgctagtgtaaaatttcagtttgccttttttaaaattgtaaaatactgtccatgttttatactcctgagtcctgcatccccaaaacattaacagagggatcaatttttacgtgaggtaaagaaagttatatgcttatatatctggaaaaatattgtacagtctgaaaatcaaggagagaacagctaagtttgaagcagaattagttcaactccagagctgctcccatccctttccacagacacattcttgtcaggtaatgcaccctacaccccgtcagtggtcagtgtaatgctcctgggaactgctcagctcttcagtaggccatgaagtccccagagggcacctgacccaccacatttttctctctcaccaagtcatgccatgctgtctccccactgactggggccagccagcaaccagggtccttctcctggggatatggctcagcagacagcaggatgtccctgctgagaatattcatatttttctccctctgcagcggtgagttgctcctcaattatttcaacatagatgagagatgaaagtgattctttttttcttttattttaagacagtctcgttctttcacccaggctggagtgcagtggtgtgatctcagctcacttcaacctctgcctcctgggttcaagcaattctctcttgtgcttcagcctccaaagtagctaagattacaggcatgcgccactgtgcctagcttatttttttatttttagtagaggcagggttttgccatgttggtcaggctggtctcgatctcctggcctcatgtgatctgccctccttggcctcccaaagtactgtgattacagtcatgagccaccacacctggccagatgaaagtgtttcattatcatttcctctttctatgtcccaggttcatggggatttctcttttttgtttgcagttgaacttggtaagttaaatttaaagcaataaaaaatgtcaactacatttttgtcaacagagcaacagataaaagtgtctaggtatcttgtgtggtgtccactgaagactttgtaaatatagttatacactggtaccagcagaaactgaatctaaattatgagccatctgacaaatatcacttcaataacaagccccagttcgagtttgcttaggtgagaaaaacaagaaacttgaggcaagaacaaattttcaaatgtctacttcagtctttaccataaacttcataggaaaggaagatgaggccatttactactgcactgcttaggacccacagcatcagtgccacactgtcccacacaacaacctctgttgggtctctgcccaaccacatccttcccatgggagcaaactctatggactcctagctgggctcccaccctcagccttgccttctctgcggcacttctggatctttctgggaagccatcttgggttaatgctttaagcaggaagcatgcctgatcatgacgttcccagatattcattgaacactacttcctaatgaattaaggtttggcctgggaatgagtggacacaggctaaggtcccattcctgtcagcatccagataattctattaactgcaaacggcttaggccaagggagagaatcgttgtgtataggaatcccatatataattatttcaacacctctgcaacagaactattatttgcccattttaataaagaaattaaagcttacaagttcaaaatgactggtcgaagttgagaagtgcatgttttttgttttttaaaactggatcatgaggccaccttgaatatctaaaagtcacagttgtacaacagactctttgaggtgactttggggtggagcaagtgtcttttttctgtagagaagaagatggttcctcacttcacactaaggggtgtgacagtgtgatatcatcagaaaagagccccaggcatcggactgttaaatgagccatactttgcatttattaactcctttaacctctggcaacctctgaggtctgttctgttatgaacagaagtgcattttactcaggtaagtgagatctatttgtcctagccactcatccaggtcacacagctggttcatggcagtgtaggattggacccagctagtctggctccagagtctgtactcctcagtcacagaagggtaaagagaagtacattgttcctactcccatggagaagacaatactgacaacttctgtaaaacatttactggcacaattattattttgaactgaatcaggtgaccagaatttgagcaattaggaatccttgttgaataagtgaaataccaataaattatccattttttcaaaatataaagtgatacaaattcgattattttatgatgccatctctaaaataattgagaaagaaatgaagaatacctttaatccatgtacttttcctatagcagtacatactaggcacccccatggaaaaatatagataccaccttgcattcgtgccacgtgttgtcttacttattcgataatttccaaggtcaggacaacatattcatcctcatcatccccttttccaaggagccaggaaggctactgaaggaaataaagggggttccaggaaaggctgacctggggctggaatcagacaatccgtcatcctttatcctcccaccccgatgcactcagccttttgtgatccacatcctgtctgtgtaattcctgaccatcatattccctcagggtgggccacacttggtttcttgaacctatatgggcctttacttgttaactttaatattagctaaagtagacagtaagatctgaggaaaaacacagcgaatctgagaggataagctgttttcagacagggatgcatagacaggcttgcggaaatacttgtgtcaccctcttctcgtggttgtctcatctactactcaaaacagcctcagagagcagcaatgaggtatccactgccagatccctgtgtccagatcatagagcagagctctcctgcagcctttcaggcatcagactaaatggtgagaaacagagaaagagatactagattcatagtgcattcaaatgacagaatactatgcagcctgtgaaaatgatattgtatgcatttattaataaaattcaaacatcttcacaatacaatgtaaagaaaagttcttgaagtgtacaaaacctcttaaaaatataaatgtctgtgttgatagaataattttttaaaaacagaaagaaattatccaaaattttagaataattattcccgagggaataattatttaaattattctatgtacttttactaatttttatatattttcttaagtgagatactaaggctttgttgtaagatatacttaacaaagtaattttctcttgtttggtagtaatactaagacacgataacgtcattaaggactcatgctgtgccaggtactgatatctgagtattttatgcattaccattgtgtaacacgataatataagccccttagtacctctagaagatatatatgtaggcaaggtacacatgtagaaactgaggcccaagagcttaaataactcagcccacattctatagggttaagtggtataggagtgtttaattgtattcggtcactaaaaataatgtgcacatagactcaagacctgcagtattgctcatgataataaagtaaccaaaataagagagtataaagccaaatatgtaaatcccaccgaaatatatacatatatcatatgtataaataataccaagccattctatttcttttttaaaaatttttaacttttaagttctgaggtacatgtgcaggatgtgcatgtttgttacataggtaaacgtgtgctgtgtggtttgttgcacctatcaacccatcacctaggtactgagcccagcatgcattagctatttttcctaatgctatccttccccacaccctgcccgccaataggccccagtgtgtgttgtttctctccctgtgtccatgtgttctcatcattaagctcccacttataaatgcggacatgcagtgtttggctttctgttcctgcattagtttgctgaggataatggctttcagctcatccgttttcctgtgaaggacatgatctccttccattttatggctgcatagtactccatggtatatatgtaccataatttctttatccaatctatcattgatgggcatttgggttaataccatgtctttgctaccgtgaatagtgctgcaatgaacaataccaagctattctatttccaaccataaatatgttgagaaaaattcaaaggaaaagtaaatgatgggtgccttttgttgtcaatttttatatctcattttactcagattttccttaacggatgactgctactcacctgagttcttatgtttaccagctctgtgtttttgaatgagtcactcaaactctgtttgccgttgtcctcatttgacacatggagataatcataaaacttactgcacaggactgttgagaggatcaagtaaaataatataagaaaacatctagacaagtagcaagttgtaaatggatattagatgcttgtcaagtttcttactgcagttctgaattaacagctaattacagaaagatagtcattgggacagaacactgcaggtttatcttcacattttcaaagccatatttctgcaatatggtactgctggggaatgggagagtgggcaagagaacatccctgccccacccctagaggtacacattcatactaggtatttctttccagatagttaacccacttacccgatctgcccagcactcatgggatgcaggaaaccctggaactgctcataactgtagcagctcatgaagaaccctaaggaaccacctcatctagtacttctgagagacctcaacagccccgccttctgccactgacttgagacctccagtgaacagggttaccttctccctggggaaccagactggcagaaagcatgccactggtagtagctgttatcttcttctccctctgggtttgtgagttgccccctaatcatttcagtctacagaagagattgaagtcattctgtattattacctcttcacgtatcgttggcttatgggaatttctcttcacttgcaattgcacttgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggattaggcaccacagtgttagagttgtcaagataacctacacagaaactatctccgagtctgtgcctgtccacatccttctccatgtgggcaaccacagcggtttgctcagctgggtgcccagccggagcctgccctccctgcagctcttctggaatgttgcaggaagacatcttagattctgctcccttggtgtgcagaatcacattggtgattcatggtgtccaaacgggaaaagttttcttgttccctctcagggcgtgcgataaggatgtggctcccttcttggtgcccctctcctcaaacctctagggggagcatgcacacgtgcaggttgtggggctccgaccccacagcagtgtctaggggtgaatgcttataactcctgaggccccagtgggcctgtgttacaaggtgtccttttagtttggctgtccataggtgacttgctttagccagctcaattagaccccctgccttattgcaaggacggagggctttctgtatccctgggtttcttgccttggtgtactgaaagaattggataacatgtgggcttggagaatgagtgcaagttttttatttttgtttttgttttgagacggagtctcgctttgtcgcctgggctggagtgcagtggcgcaatctcggctcacgcaagctccgcctcccgggttcacgccattctcctgggcagtctcccgagtagctgggactacaggcgccccccaccatgcctggctaattttttgtatttttagtagagacggggtttcaccgtgttagccaggattgtctcgaactcctgacctcgtgatctgcccacctcggcctcccaaagtgctgggattacaggtgtgagccaccgcgcctggccgagtgcaaggttttattgagtggaagtagctcttagcagatgggggagccagacgggagatggagtgggaaggtggttttcccctggagttgactgctcagcggccaggctttcctccaaccaccccgccaaactctgctttgttctgccagtcgatggcctgcagcccgccagtctcgccaaactctgctttgttctgccagtcgatggcctgcagcccgccagtctctgtaggtgtgcttttccacattagtgttcctctcgatgtccagccacttgtgtgtgtgcccactagggtctcaggggttttataggcacaagatggaggcgtggcgggccagggtggtcttgggaaatgcaacatttgggcgtggaggcaggagtgcctgtcctcacctaggtccgtgggcacaggcctgggagtggggccctcgacagggaccacgtccttcctttccctgcacttccctcccccaatcccatatcagtgtcagcaattaggatccaaattagggacattttgacactatttcctacaacattaggatatctgggaactctgaaaatacagagtgggtggcttagagcaaaattcatctgtctagtaattcgctacgtagagatttctagtaactggttcagaatgaaagtaggaagcagtatatattttacatagatattccctgctgttatcattattttcccatttggttcatgagcattggaggttttcaaagttagagtgatctgtcaaacatagtaactgtgtgctttttattcgcacctgaggccatcctgaagaaatctagggacaagtaagtagatctgtaagtaaacaatcacctgtttggggtatatgagagatgaaagtataaatcctgtgtcctagaggaagagcatgcagctcacttcacactcagggctcagtgctgggacaaaacaagcactgtgcagtggaacccagctcctaggcacagtgggggatctcaggatgggggctatgctttggagatcttgtctttcagggttctgcaaagaaaactaaaaatcctgagtaaaataggattagatagttaagaagaaagataatacatgcttcctgcatcggtaaaggaaataaccataataatacccctcagaaattaataaataagaaataatgattgacaattattttatgtttattccatgattaatcattgggtggttgggaactttcaaaaaataatgaaacaaaatataaaactgtaaaactgtaaaagtcctctctcacttctttgaaactttcaaacaacaaattaatgatgaaaaatccggagtttcaaagattttctcctatttatacctttagtactatggatatctgacagcatattgccatacatgcagtctacttacagtccttgaagtaattgcaacgtattttttctccattctcccttctgagaatcagcttgtaccatcctgataggataagaggagaaatgctattgaaagcccaatgagggaataccaggagcctccatggcaggtcagcccctttccaggtgcagactcagaatctggagtcccgcatcctgtccgccatgattcctgaccatggtggtccacagggagaatgacctgagcgcctgagtgagtcctcaacagacctcacctctcacctgatgcatacataaaagcaaagggaagaagattgttaaggaaatacagagcctgagaacatgaacttttcaagaaataggtgaatgaaaagatggaattcagcttttcacaatgtcagtgttaagtattttacatggattattttatttaatcctcaaaagagcagtgtagagtgactgtagtggccacacaaggtcaggtcttagaagatgcagtcactttgactttttaagagactcctgggagatttatggggaagaaaacttagagacacactagagtgaggaagaggaaggaaagagacaccgtatctgtgtgaatttaaagtaatgaaatactatgtagcaattaagcagtgtttttgaagaactataagtaaaattgaaaatattcaccatgtatttagcaggaggatattgaacacagaactgatttaaatagtaagctctcatgtacatacatgtatatattgaagaacgagcaaaaggaaaaaaattctccaaagtttaaagagtgggtgtctctgaaaggatgggtgattttaacatcttcttggtacttgcacagattttacacattgtaacaaaaagctgctactacttttaaagatgtatgccataatggcttcaatattttattgattcatgcatttaataatgaaactgtttatataacaacataaaatataactatatatggcacacttaaaattatttttatgtttttccacttaatcatatcactactctatagctctcagaaaaaaaaaaacaaaaataccaaccttcatgttaatactggttactattgagcagaaggtcagcaaactatgtctatgaccagcagtctccagttttgtaaataaagttttattgaaatacaaccatgcctatttatttatatattgtttatggctgcttttgctagctgcttttgcacttgaatggtagagtacattcagtcagtcttcactatctgtgcattaaatacctgcgaattcaaccaacagtggatcaaaaatatttgaaaaaaataaaaaattacaatacagcaataaaaataatacaaataaaaacaatataatatagcaactacatacatagtatttacattgtattaggtattatacataattagagatgatttgaagtgtagaggaggatgtgcatttgttatatgcaggtactatgccattttatatcagggacttgagcatacatggattttggtatctgtcggggatcctggaacaaatcccctgaagattctgagagatgactgtagctataacagagacccacaaagcccaaaatatttattatttgggtctttacagaaaatgattttcagtcactgtcctagagtgatagactcatgagtgacatttattcatatttagtgtttcccaatttctcaatttttctttaatgaccctttgttacacatccaccctccccatattagctgtgtgacttcagataaattagttagcatatatttgattcattttcctaattgtaaaatggagaacataataatgattactcaaataaactgttgagaaaagtaacttaaataatacaaataaagttcttgcaagtgcttggggcatgcctaatgctcaacaaattgaagcactacattaatcatatgagttattattgcatattagaaaataaaattatttagactaatactctaagtccttggtactcaaagtttgatttgtgaaccagcagcattggcttcacttaggagcttcttttaaatccagtcagtcaagcctcagcccaggcctactgcgtcagaagctcttttcagaaggtccctcctacatactatggtgtggggagtgggagtctaagggccaaactgttcaagatataagctccacagtctggtacaagtgcaagccaatcccatttccataggatggttgtgtctagtgtcctctctaatttctggagagcaatattgaactgatatttggcctctctggggctgaaatagatggcatcctcccaattaattaaacaaatatactcaattgtccacgtatatgtacttttattttcatttataaaatttgttataaaatcagcacaaattttcagtattttatatagtgagaaatacaggtgttttataaccttgagttttagatccacattcaacccacaggaagagtaatttttgctttgagtacaaaatacatatcactgtatcctcatatccacatatcacatatcctcatatcactagggctactgaaaaacgaaataggaggcaacagggaaggggagagaaattgaagttaattgccactgtcaccactcacccacacctcacccttcataggaagagttctcctctaaccatcaccatattgccagatctcctgggcactggagtatttagagggccagccatttcagatctgacaacgctgcactctacagaaagggttgtcagggaatcactgtgacccactacttctttccctgacacctgctcagaccaagctacccttgccacacactaaacattctaggcacaggcatcctcactttcctgcttcttcttgggaacacagcctggcagaccagagcatgtcagcaccaggagcatgtagggattcaccttggggtttgctccagtcatttcactttgtatatcaggtgaagaaattctttatcacttcatctttacatatcaggtgttcatgagaattaattttctttgcttacagttattctcagggcgttaaagttggcacaaatttaaaatacccagggcaaaagataaggatgcttttataccttgtaaaatatccagccaagactaaaaatgaagtcaaatactggtgtcagctgaaacctaagtcggcattggatgtgtgttgacaatcgcacctgctcagggtccattaggtgttgtggcttacaatgatgctcatccttccacttcaaccttgaaagtaaatttcacaaacatgaagatgaggtcatttactgctgtgattattgagcccactgggcatcaagcacacacttccctgccttctccttgggacacagcaggatgtcgttgctggaagcatcatcttttcctctctctggactcttacgggttccccatcattttgactcttgaggagagagcaagtaaattatttaatggtgcatctttatacctcaggtcttcatatggatttctcttctttgcttacagcttgttttggatacaagaaattggagcaacctgaaatattaatttccagagaaaaatattaaaagtccaaatactatctggggtggtatctagccgcttatactggctgagacataacttgatgcattttcctcaacaacatgaccctctcaattcacttaggggctgtagctgaaaatgatgttcctagatctgttttgacctacaagataaattctcaggaaaaaggaaatggagatagttatgtgcttgctggaatcacagatgagagatgtcaggacacccgcacagaatccctctttaggtctgtgtgtaccagcccccttccaacaggagcataggcttagcagggttgtcagggttggactgcacctcccaggacttccccttcaacctctggaaacttgattatgttcacacattaggacatacagaaatcagtgtactctgtgctcaaggtccagggattacctgaaagtttatatgatccagactcaaagagggaatcactgagtggcaggaaacgtgctgggtatcttacacatcttatataaccattgcaatactttcgcaatgtcatcttcatttttttccactttaatatgaaataatttgaaagataaaataccttcttaaaccccaaatgcccatgtttcctcagctgtgtcctgtgaccttgaagaagttagcattcatttgctccactcatgttgggggtgagtgtgaaatgaagctcctgccctctcctcaggctcattccactctgagggatcctcctacagtccagccagcacacttcctttgcacaggtctcagatcctcctagggaagggagggggcattagatgatccaccgacaaggtggatccccaccaggatggatcctcttcccggcttctgcctgtgattgcagcagccgtttattcagggtactctgctccctcttgggcactgctctaaatcctttacatgtaactcatctcatccttgggacatcttttcacattggtctgttgtgattctcatcttacgggggaggaaacagaggcagagcgatgtgatttactttgtggtcagagttcttaactggggggggggaggggctggggttctggcttcagcgtctgtcctcgtaaccacgctgtgtcctgactctgagagaggaggtaaaaatagcatctaatatgtggtctctacggctagaaagaaaactgataggaaattaaactagacattttagtgaaattataaaggctgaatgcagactagtgggagagtgtgagccgctgggggccaaaattttagggaatttcccaccatcttttagactttttctccaggaaccctatgcaggctcttgcagggaagagcatggagaatccagagaaagctcccctttttggtactggcttagaaggggaacagtagccactgtctaaattcacccagacctaccccacctcttctccactgtagaaggacttaatctgcaagagaaggtttctatggaatttcattttagttgagggagggaaaaggaagccaccatcaactctgcccaatactttatccctatctccacagagtaatgagttttaatgtgcagaagggtgggtgtcaaaatcatagcccaaggacactggtgggtgcctcctatgactggaaatgtgccacctctggaataagagcagcaacagttgtgaagttacattctcaagtcccggtttgaccctgcctgtttaagacagaagctgaatgaaaatagcagagaatggctcccttcctcacctcaccaccatactaccttgagcaaaagcaacagtagaatgcagtgaagagagcttcaaaagacagactgtctctggggagcagaacaaagggatggctcaaagccaagaacaagggatgattagagaaatctaaagtctctaatgtcctatgaagaacaaactccaatccagacaacttagtagcaacaacaaacttctaacccagtctaactcctaactagattaacacaaactcccacactaaaggtctggcagaaagaaagatgcaggcattttttttttcttttttcttttttctttttttttttttttttgaggcggagtcttgctctgtcacccaggctagagtgcagtggctgatctcagctcactgcaacctctacctcccgggttcgagtgatttacctgcctcagcctcccgagtagctgggactataggcatgcgtcaccatgcctggctaatctttctatttttagtagagacggggtttttaccatattggccaggatggtctcaatctcttgacctcgtgatctgcccaccttggcctcccaaagtgctgggattacaggcatgaaccagcgtgcctggccaatgtaggcatttttaagcatcaaatatagttatctcagtatctactgtgttatacaacatcgtcccctttcaataaaaaaatctaagtaccttaccccaaaacaagaaggaacacagtcttgaagccacaaagcaatcatacgcatcggactctgatatgactcagatgtttgagctgtcaggcagggagtttaaaataactgatgagtatgttaaaggctctaatggaaaaggtagacaacatgcaaggtcagacagagaatttcagcaaagagacagcaattacataaaaaaattcaaatgaaaatgcaagacataaaaaaaaaacacagtaacagaaatcaagaatgcctttgaagggctcaccagtagaccctatggagataaggaaagatttggttaacataaagataggccactagatatgacccaaactgcaatgcaaggagatgagaaagaaagaacaggagagaaagcatatcttcatggaagaacagaactgtggacaatatcatattttcaaacatatttgtaactagaatccctgaaacaaaagagacaaagagcagaacaaatatttgaaaaaataatggctgagagtattccaaatgtagtgatagataccaaaccacagaacaaaaaagctaggaaaacaccaaccaggataaatattaaaaacagaacaaaatacctagacatattagatttaaactgttgaaaaccaaaaataaagagaaactcttgaaggtagctagagggaaaaaagcagattttccatctgaaaccacgcaagcaagaagacattggagtgaaatctacaaagtgttaaatgaaaaaactgtcacttggcataaagacagcttcagacaaaataaaaactgagagaattcattgccagcagttgcacttcacaagaaatgtctgaagttattcaggcaaaaaaaaaaaaaatgatatgggtcaaaaacttgaattcacacaaggaaatgataagaactggaaataaaataaatgaaggtaaaacatagtcctttaaaccttaattgctctaaaacaggagttggcaaactatttttgcaaaggacccaatagtaaatatattctacgttggtggacaacatagtctctgttgtaactacacaaatgggctattgcaacacaaaagtccttgctactcttaagtctggagggacatggaactgttataacaaccgggagggtatctgtattgaaagggacacagccaaccggtcttagtttgagttcccccaggaagtgagcctcaggctttgaggacagctagtttgtttgggagacacaggaagactagtaggagagtgaggagatgatgttaagaaaaggaaggcagataattaaattactttcattaattagatactaaatgagcaacaggaacctcatagaagttcaaaacctaacagatcaattaaatcataatttcttgtttttctgttcctttaattcgtgggactggccatgtaaaataaataaaatctgcagacccctatgtgatctgatggttagtgtggtagtgaaccagggaatcttgctaagtgtcagaacgtgataagaaagtaaccacagagcagaaaaatattcctggtgttaccttaagttataaagacagagcttaaaatcgagcacacatattatatctatgtgaagcaaatgaaaaagatgagcagatattagcctgtaagggaatacaccaaactgttaatagtagttgtctctggttggtggggacaaaaagtgactgttttctctgcatttctttctgacccatctacccatgttgtcttcccatagctatttactgccctttgtttctacagcttcctaactgttctgaaatcccttactaatcagagcagtttccctggtatgcccatcacacatatgggcatgtgggacatagagattagctttttttctgactagattagtaaattcttataatagaaggacctgctgaaccaaggctggaatttcctactcttcactctgaaagctggaaccaatcccaaggggctggccacacacttggttcaaattgggtagtcctggcctgctttctgccttcttagagtgacctaggacttgttcatgtccaaggccttaccagccacacctagaaaatagcaagaacaatagtagcaaccatatctataccattacatttagctcagtacctctctttttggatgtctgacaagtagccaaaaaaattattgattccaattccactcccttcccccaatctccaagcatgtattattttcctccccagactttcctattgcagtaaatggcaacagtatattgtatcatctgatggaatggcaagggtgttttctcaagcagatagtgttttgttgacttctgtgttttttgtttctcctagtaatgagagaagagtgcagagacccaactattactgagtttcctgtgatatgagatctgaagggagtttacaggagctcttgaagctatggtttcacctgcgagaaagacacccacaaaccaggcccaaccctgtgtggtccaatctgagactggagtaggctgtctcaacagagcccctgaccgaaacactacagacccaatgcagggaagacccagtcttctctctaacttactgcaggtttagaaactctttgtgttccccctgacatgtgcagggcaataggccagccatgacggcaatgattgtcattctgaagtgcatggcccaaatggccccatggatgtataatctcctggtgtcactgaaagacaaataaaaagaaagtaaattgtgagatataatttgatattcagattcaactagccccgctcctcacagattattttgctaggtgttgtcactgactactcaatgctttttagaatatgcaaatcaaccatttcatctgctttttatttcgtttaatatgttctgtgattcctagaaagcaatacccagcatcctctatatggccatttgagatacagattctctatattatacagacctagactatacttgggaactgcgttccttccacacatatctctccaactgtgaagtaattgatgaacagggtttgggatctggaaaacttgaactgaaatcctggctcagtttgaactccctaattctgtttcctcacatgacttttaatggtaataaccatttatagggtaaagcagaaagagataaatgcatagttagtgcctgactcatggtagacactatatttatgagttttcttctctttcactatcagaaagcacaggcccatggattgtcatcctgcagcagggggaaggtaagtgaaaaggagatttggggcttagagtagcatatcaatttctcaagacatttttccagacacgagtcttttatgcaaacatttcttgtttgccaaaaagaaacaagtgtttcaccaggcatgtttgcctgtgggagcagtatcagttgaaaagtatctataaatctacaatatgcatagtggcatgttaagtaccccaagtgcaaaagaaaccctaaaagactaaatcttcaggttaagaatgaagacaggtggcacaattgctaaaagggagaatctgattgaaagtgcagtgacccggcctctcccaaacactgccctggtgtttttagaaacaagtgaagatccactggactatattgtaacatatctgatattatctaagtgatgacatatgtgaaatcaaattatgctaatttatgaaagttagtggtccacagattgtcagtatgtgatttttttatctcttgtacatgtcagataatgtgtttttttttgcttcagagggtggtctctctcagaagtgtcttaacttactgctgtacctgatttaattaagatccactacaatttctgaaagataaaccaatgtgaaaaaaatgtgcaaattattattttggttcatgttggcaaccaaaccctgaaatgaaatgtgagatatattttcgtatcttttgatggtctaacaaatttggttgaagctgttctctatgaaaattattatcatcagacttgaaaaagtgatgcaaaacttcaagcaatgcagtatcaacttgtgctttacctcacttgacttacttgttatttatatatttgttcattcataacccatcttcttggaagcaggatttaagttgcctcagtttgttaactcaagacatgacaaatgtggcggggaggatgtatgtgttccaaaacacagggttagaggcgaaactgcttatctttatacacattcatttgggtttcattttacgcctttagtaaaactgaacatcatggtcttcacatagttctttttttttgtaaacttaataaaatatgttataattcattacttactttttacattgtattacttaaatctttcatggctgttgaaatgtagacagcttctaagacttctgatacttccccacatggttctggaataaggaaaagcagaggacaaagagggattgaatgggcatcatcccatctatgacaggtgcaaagggtaattgacagtacgaagtaacaataacttattattttcagataaaaagacacagaaataagatctttccattctaccttatgaagtgaagtctctctgtctgaattattacataaatgataagagaaaattaaacagtttttagcccctactgtgtcccatgctcgattataaatatcgtacaaaagtcctgggaaataggtctaattctctccatttaaaagatgaggaaacccaggctctgagaagtgtgtgtgcccaagggcacatcaccaggagtggaagaactggaatctgaacctgggttttccaattttaaagtgtctttttcttcattcccaacttcctgagataataatttatttcataagaatcctttaaaagctcgagtaaacttgttaatgtttattgctgcagccactctgtccatctccaccatcactgcaacaattcaggtcctggttgcctcttattggattatggcgaccacctataaaaccatctgcttcagccaaattgctgtcctggggagcgccccttcctttctgcttgcacatctatctttctccagtgcaaatgtgatcatgtcactttcctctctaaattttttagcaagtcctcattgtctattctttcaaaaacatttatttgaaaatactataaaaatagaaaattttccacatgcttacttcctaaaaattaatgtgttaagtttctcctaccccatttccatcccatgcccctttactcaatggatacaataaatctccaatatgttccttctggccacgtgttgctttgtaattttaattttaatctatttggaccctgtgttatctgggatgaggtagagtggtatttttattttctaaggtaattattttcctaatgcccgtttccaaacaatccatcatttcctttcaatttaaaaatgctgcagcgtgttttaaatatgcacacatatttgacacattttctggagaatttctgttttatttgtctgtttcattattcttacatcattatcatattatctcagtagctttgtgataaaaattaagatctactatgccaaatgtctattcactgtaccatttttcagaaaatctttttcaatcatctcatatttattcactcctgtagaatttaaaatcaacttatctagcccaacattaaacctcacagcctagaacaacaacaacatgtcgtagtaattctgactggaattgctggaaatttatagatgaatttaggatgtattggcctctttatgataggagctttttattcatcaatgtatgtttctccatttatttaggttttattttatgcccttaggaaaactaaacactgtgttcttcatatcattcttgtatttttttggtaaatttaataaaagattttataattcattacttttccacattttattagttaaatccttcatggctcttgaaatattgacagctgctaagacttctgatgcttcgcctcatggtcctgaaataaggaaggccagaggacaagaagagattgagcgggcgtcattccatctatcacaggtgtaaagggtcattgacagcgccacataataattttgaattttctattaagaagaaaccctttccaaacataattttcacccagccccattgtcctctccattgaattgggggctgtgagctgctgtgtatggacaggtaccctctgtgacctcattcatatcttcctgaatgaggactcaggggacttaggctggagcagggtggatctggagtggacatggaggttgtcaaggcttgtcctcctcagcccttgcaagtgaacacctcatctgtactcaggagatcacacagctgaccccggcttaagatggcagatttttcaacatattagataactggatttgttttttttggtcatgcctcagtataattaaagaatgtattatttcatgggagatagaattctacaaatttcttctattattccaggagaaataataagtcattgcagaacacattttttcatttggcattgccttggtaaagcatcatgttgccaaatgataaaagtggctttttgaaagtggagaccgttgttcaaatttctcaagtatatctgcattgacacatttgcattttcagttactaaagagcttcctcctttcagaagtatcttcccaaattgctagcagagaggctctggtgtttgtgggaacagaagggcttttcctttgatgtaatctcaaagcagtttcaacacaattgaacccctggaaaaaaaaaagacaattctctgaatacttttcctggtaatttagaaaagcagtgggttgacccattaaacctgctgttttctcttcctgcttttttttttccatttcccttttctgttggtgcttttcaagaattactgccttagaagaaaacaggcaatttatgaggaaaaattacaaactatcacatgtcacaaaacctatattcaaggacttccaaaaaagccagaagatgaaattgctagttcaaagttgttggattgctagtcgtgtcccgaggatcagaaggctgagatttttgtagaagcttagaccggtgtgataccactggttggttcaagatatttgctgaagggactaagctcatagtaacttcacctggtaagtaacttttctttctgtttttattccagtaatgaaaaactgatagatgatttttagaaaaaaatgatcaaccttatctgaatatgtcacattcctggcctcagtatacgaacagcaattttgcagattagctgaatatggaaacaaaacgattttgtacatgatatcttcccttccctgtctgtaagcggattaaaattctactttaagaatacacacacacacacacacacacacacacacacaaaagatagactctggcaagaaattaaaatgttttgaggcccatgtctatacaccattagtgtaagtccttggtccaagttacttttttgttggtcttttaagtgagagacataaaaatggagttttattaattacttcttctctgtattttgagatataacatagtgctcccttcttctgctagcctgccaaacccatgttattgattttgatctcatcctgagaaatagtatagaaaaaaattacttcttatagtaaattactatagaaggtcaatacatcccacttattagtgttctagtttctttgagggaggctgaagtcagtcaaaatttatgcaattgggactcttgttatatcacctggaaatggcccggtttaatagaatttgtaagttcaaccagccatgtcagctccaaggtcaatgaaaagagtcttcatcattttacatcttcatttgttcattcatcctctcagcaaatatttatcaaaaacagtttttgttctggatgctagagataaaagggcaaagaagacacagtctcaacactcaaaagctgccagtctggcagataagtattctagattctggcttggttgggccctgtccacgttctttggcctgtggctgccggagaagcagaaggtcttgggttcatgagctcattttctttcttaatttgtgtagcagttattgcttataagatctatgtattgcgtttggtgggaggatttgataaaatgacccaatattgtccttttaaggagaaaattaatattagcaaagtttattgagagccagacaccatgctaaatagtttcaatgctttatctccttcctcatcagacctatgcaggagatcctcttagtcccatttcacagatgaggaaactgaggcctagagaagctcagttactttcttaaagtcacatgactagtcactgtggaaaagtctgggatctatctaagcttgtctactccaaagtgcctggtctggacccttatgtgatatttagaaatattaagtcatatttttatactttgaatatttcttcttctgtagcttgaccctatgaatggactctttagttgactatttttctagtaacaactcccaatttgtattactatttgtgtattaatacaattcttctacttctaattatggcactgaaatgacctctctcctccaaaaagtcatatgggatatacatttattaaatactcaaaatataatttttagggtatttctgtagaatgagtcattttgacgtcattccactcagctgtctttctgtattggcatcaaatttgctagatatgttgaaactgatgtaggagctatcgcagctatgctatattgcagtgctaagtcgcataactcagagctgcctcagattctctgttgagtagcacacgatttaatttgatgaaactgtatagatattttcaagtcaaaagtagcagtctttcagcaatgaatcatcattaagaattcatattttctaacaactcatcagtattctatcagtgagaactggattctaaaaagaacttactttatttttattttttattttttgagatggagtctcactctgtcgcccagctggaatgcagtggcatcatctctgctcactgcaacctccgcttcccagtttcaagagattcttctgcttcggcctcctgagtagctaggattacaggctcctgccactacgcccaactaatgttttgggttttttttgtatttttagtagagatggggtttcaccatgttgaccaggctggttttcaactcctgagctcaagtgatccgcttgcctcagcctcccaaagtgctaggattacagggatgagccactgtgcctggccaaaaagaagttattttagaatcaatctagatacccatccctccatacatatgaatcccaaaatacctataaatcatattgaatatctatttattaaatgtcaaacataggaatcctattattgtctctctttgaaaattaaggaaatattaactctaaattacacttaagacaaagtgtatacaagaaaactttttagggaagatttagaagattcaggcaaaatcatgagaaaaggtaaaatcagactctctaatgtatgggatacaaggagagaatgtacatagcccaaagtgcccagggcaaggtgaggtcagttcttaaattcctgattacattcagatccagtgtgattttgtttgacctttgtcttgacttaacgtcagcagggccaatttttatgtatttatgtaaatattgaaaaaaatgttggcacaattttaagacaaacacaaagggagattcttataaaggcttctcaggtggtgggcaagagttgggcaaaaaaatcaaggtatttggtcccggaacaaagcttatcattacaggtaagttttctttaaattttgcaatgtaaagaagggatgggaggctggcaggcaggagctggctcagaattctaggattccctccttggtcactaatcatggtgaaatctccagagaggtcaggtgacttggttcatgccttaggagtcagaacttttcctgccctagcatgggagacattactaaggagcttagaccaactgcaaatctctaaaggatggaggccttatgttgttccattggtatctctctgttgaaagttttgtgaacaagtttagttttgagattttatttcttcagttctaaaaataaccaatggaaaaaattaaaaaaaaaaaaagtaaaatcagctaccctccttatttggtcaccaaaagatgaaatatttgataatttgaccaaagaatggttaatatcaaatgttaaaatatttctcggtgtgaccatatttagaagtaacataagctgcatttattgttatttaaattggtccaatgagtttgtttattatttgttagcttaagtttaaagatgtaattttgcctggatgagagaaaacatctcataaagatactcttagtctgttagatccactgaaatgaaagttttcagagaattttcacaaagttgataaagcatcggaaaaaatgaaagcagttttacatttttaattccttagtggttgagatcttatgataaaatgaacttataagttaaaaagtgaccttccgattctcttttatccaattgacttaatgagaattgtagcaatcaaattcataatttgtaattttctgagaagtgatttttcaggaaagtgcggtgcaagaaaaggtatggactttgtttctcgactcctggagctagcactttctatgtaactcccttttaggaagtgtattttgatttaccagttgttcaaattataaaaatgctggttcattatagaaaaattggaaaacacaaaaataaacaaaaaattataatttgatattgaccctcatcacattatcattttgttatatttttatttaaacatttttctctgctttttgtttgtttgttttacaaagttggaatcatactagatacacaataatagatctggctttttcacttcacactgcttcataaacattcttttcaaatgtccttaatatttttcaataccagaacaaagttgaaacttctgttttcacgttgatctgtacaaagaagataatggagattatttatctaaagtggatgttataaagattaaatgaaattaaatatggaaattacctaccagaatgcctggcacttggtaggtgatagaaatattatttcctcttctagaattcaagttactacccacgaaaggtctttatacactcaggaatacagataaatgtatcgactcccatctattcagcagctcacttcagaacaaatatcactatttgtaaaatgctttctatgtctaaaagactaattgtacctgcttctaaaagtaattagaatgttttacgtattatctcaaatatgatctacctgaatacaaggtgatttttcattttcaagagaaaatttatgtttaagaaaatatgtattttcccctcccccaactcgaatatgtaaatttatagggctacaggtaaaacagtcaaatgtctacctataacatttaatttcttacctggttcatactttcaaagttaaaaattatatcaatatcaatatcagttgagaaatattgccttttttgcccttatatttcattaaaacttttgttttgatgcttcacatgcatgtaaagcatctatctcagaacagctttctaaggcatctcaggtcaaagcgtccactttggaatcctcttatgatggtgtctctgaatattttattctaagacacaattattcactcacaaaataaaaggatatatttttttccaatttattctgttattctacagttgtatgaagtaaaaactacagagacattaccccaagtaataatgaccaaatccgtgataaatttctttgcctttttttttccttttaccagtgctattccccaaactagcatcattgagttcatttcatgtcgatatctcctccagttagtccttctggatcaaagcagagtattagaagaacattttttaatatgagaagttacacaaagactgtaccatacataaggcacctccccatgttgtgagagaaaattttggggaaaaaaagcttcattttaagttctggcactttctatctaaatttagtatgtaggtgtccctatcacagagctaggatttgcaaacatagtctccattccttgtgtcttatttgagcttgaccttacaaaaccatcaactcctgggggcaaaggagaaacatgctaaatgcacaaactctttgttatttatttaagctatctctttccaaaatctatttgagaagacctaaattaaaatatacaagcacagtcagaccattaaatatatacagatgatctaaagccctaaggaaaggagaaggaaaaaggcctgtgattacctagtgaggagcacagtttaaaattttatgctcaaaagaaggagaaaaaggtaggggaatacatacatcttactaattgataaaaagaagcacaccaaattttcaaatatcatatttttttctattactagattggaaaaagacttcaatgcatgagtcctttagaaggaaatggaagagtgggcagtgccttcaacttccattttggaaaatgaaaggaatggtcatgaaaaacccactgcatattaccactgcatcagtgctatgggcatcctgacatttaatgaaatgcgcagatggtgatgctcagcagacatggtcaggcagataacatgtagtgatctaaagtgacaacagagagatggatttgaggaccaggcctcttgccttttctctacccattctgccttgaagggtaaagccaggtgtttcaagctggactttggcatgaactagacagaagtcagtttcaggctgaagtttctggtgaaacttggaaggcaaataagttgtgctgctgattagaaaaaggctcacttgttttgaaaaacacaagtgaagaattcccatacactgactgcatatattagactttagccaatgttccctttgactttcttaacacggtaggtaaggcaaaggataacctattaaagattgggcgtgtgaaagccatgtttcttgtgatgatggggacgatggctttgagaatcccagagcaaagtggaatgcaaacagaggaactgagaaattattcctcctgcttaattgctatggatttaactgccactccaaaatgctgaattttttttagtaagggcaatgcttggtcctatagggttaaaatgtcatgtcaaggcacacaatcatagcaaacagattgctaatcataacaatgacatcatcatcatcataatctcttatatttccatagcatttatttttgaggcagggtcttcccctgttgcccaggcaggagtgcagtggtgtgatcaattctcactgcagcctcgaactcctaggctcaagtgaccctcctgcctcagcttctcgagtagctgggcctacagtcgtgcacatcatgctcagctaatgctttttgtatttttagtgaatatggggtctcactgtgttgcccaggctggcctcaaaattctgagctcaagcaatcctcccacctcagcctcccaaagtgctggaattataggcacaaaccactgcactgggacctataacattttaatcaaattgcttttttatatcttgtttcattttggtctcacttcagtgctggtagcgatgttgaactgattttgaaacatcactgtttttagacaaataaaacaccaaaagctttaagttatttgatttgtggagcaacagaacttgttatgagcaaaatgaaccaggactggaaccctggtcttttgagaatcccagaccaccagaatttgaagaactcagggaaactgaattagagtttttgatatggactgaatcactgtggaattattataagaaactctttggcagtggaacaacacttgttgtcacaggtaagtatcggaagaatacaacatttccaaggtaatagagggaaagcaggaaattattaaactggaataatgtaataatgtttagaaaaaagaggaattggatggggatttgatgtagaaaacttaggagagactttaaaacaaacgctcatactaaaagagaacatagataacattgcacagatatcataataagatttggctttgtgcatatacggacttccataaagggctcatatgtaatgtatgaaatgatctcattaaaatgtctggccctgagaccaaatgtattatgacaggtaagtttgtgatagactctacagagtggacacatattcatctctgatggtcaaagacatgtttactcttgttgtgaaggagcccgggtgttggagtcaggtccacctggaactctggctccaccactcactgcttagtgaaattgagtgattattctctggcctcagttttctaatccataaaatgggataacagtatgaattcagcagggttgtataagaattgcacaacatagtgtgaattaagtacttggcacattgtccaacccaaaataggtgcccaacaaatgttttctggattcacatgtaaagagacaatgggatctactatggagagttgctctcagtccatctaatttacagagcagcaattctccagaggattcagctgtacttctaactgctcaaatggaaggttatcaacatcagctcacacacgcaaaaattgaacttatggattcgtttcttgttagcaggctttttaatcacgtggcaaaaacattgtattaagatgtctgttttttatttttgttgttctatgtgctttacttaatcctttatcttaattgatatcatttctaacaccaacatattggtcctaagatttatagccaattagtttagggttctgttcatatgtctcaggaaaaaaaggttaaaatcttaccaaaaatggtcaagatatcaaatcaattaaatccagttggaaacatcataaatctgaaatacatatttaaacataaaatggctataactatttagctaatgaaaaaataagaaatagagaacacttaaataaatatccatatgtagatttaatatatcataccgtctctaaaaactgtagttgatatttggtaaatttacaatgctgcattttaataaactacaaacaacttaggcaatttaactcaaatatactatttgattttgcaaataaatgtacataaatgaatccaacaataaaataaattttatttattattttaaataaaatatgtaaattctatttgttattgaagtaagtaaaaatgtaccatacttggccataaaaaactcttaatatgtacattttaaaagtagtattttaaaaatcatgtgagaggatgatccacaatatcggcccttaccatgtgtaatcaagtatgctatttaatgattcgttaactactacgttgagaaagttttggaagttccagattcattttgtcctgaaaagaatgaaacttaaagaatctagctaaagaaaggggacaagaggcaatgaatgctgtggtaccgtacagaaaatgtccaagtttatcatttgatttttaatttctttagtacaatgaattagaagtatttcaatgaagagacactagttcttaggatgaaaattagattggaaaatatattgactagagactacaattatataaatataatgtacaattgaaaaattactcatattttataacatgcttttaaaattagaagcaaactatatggtggagaaatatacactgtctcacaagtataacaagtaaaatactatttgcactaaaagcaaagagtatgaaattaagatgagcacattatgcctaattaaatttatagcatgctcacaaattaatatttctgtatatgtttactaattttgtatgaaaatcagaagctttgctacacagacagaaattatcaagactgttttcttttcttctgaaatgagaaatttaattcttattttcttagaaattgttcaattattaaattcacttcaaaccagccaaagcattggagtttcaattggaaatcaaaatagaaagaattgtaacatttataatttcagttattagattaaaaatacgtgtataacccattaacattccagattcaagtgatatgcctttgtaaacatatgatgctttgttatgtatcttgaccctatccctataagaagctctgaaatcatgacttttaatagagcaattatatgtacattttattcagcaggctaagatgaagagaataatggagctttaaaacagttaagcagcatataggacagatacaaattctgggagagacataaagagtcaaaatatagatacactgatttacacagaccttctcattaatggggtaaatttatataaaacccagtataaaaaatacacccctggtgcattcttagtcattcttaaacttcaaatgaaattccaaaataaaatgtgcttttggtgaatattttctgaagcaaaatgaaattttgataagtgcgttactgcagaagattaacacaagagtatttctgaaaataatcaagaaaaaatttaaataagagttttggaaagttgccattttgtttctaaattcaggagatggtgaataatctggaggtacagctgtaaatactgctgcatcccaaaacttggagggtgcagatgtgaaattgagatgttatataaagttagatattaactagggggactgctcatggtatacacattgaagctacatggtcaacttgatagacagtatgtacatgcggaagtagattctctttaaaacaagtgactgtgtatgttaaaaataaaagtgaacaaaatggctaggcatggtggctcacacctataatcccaggatttgggaggctgaggcaggcagatcacttgagcgcaggagttttaaaccagcctggtcaatatggtgaaacatgttcctagaaaaaaaatattagccaggcatggtgatgcatacctgtagtcccagctacttgggaggctgaggtgggaggatcacttgagcctgggaagtcgagactgcagtgagctatgatcttgccgctgcattccaacctggacgacagagcaagccccagtctcaacaacaacaaaaattttgacattgattcatatgggaaataagataaataataagataaatatggtgcatcgcagaatcagttaaatgaagagtgggagtacacgaaattgcagaacatgagaatgtgtcatatttggccaaagaacataagttacaaaggatggaaaagggaagtgggaaaaggaccaaagagtctcatctgtagagagatcattaaggttttctgaccttccactttcccctgccatccaccttgaaaacctgcttcactatgatgaaacaaaagagattaaaaaataaaataaatatgctcatgaactttggaagccctggtaggaggcagttaaaaatcacactcatcacagcatgtgcagaataaacaaaggccaggttttcgtccagcatctgacatttgagagctgtgacttttggcaagttatttaatgtcttgattctcttttcaacatctgtaaaataagcacaataataagtactgtgcagcctatcctggatgaaaggccgcagtggacaccagctcaatggcatcttctctttttatggttatgtactaggccactccaaactgtgcaatgtgtgtgtttctctaatgattcttttaaactcatatttcatttctccccatagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacaggtatgtgtttacgcatatcatctgtcagaacacttctttgaaagtgaatgctgcattttttcctttcagtattaatgaaaaacaaacataaatctttcttaaatattgttacatttaatggtagcataaatgccctgctacttttctatagaattaaaatggtataggttttggagaaaacaaaattgaaaaagttactgaaggtttgtcagcctcagctccattatccaaaataagaaagtcacgtgctggtttttagggttgttagatggattaaagaaacaacatacacagaagcatctagcaacgtgacacgtggtaaacgctcaaaaagtgttctcccttcttttgatgactttacttgatcaggaaataacatatatatgtctttcaggaatgttctgcccaagcaggagagtcactcacctcaatcttgctacccacaaagtttaacctaaaaacaacgggttcattgttgacaaaatgatgtttatctgttgttgacagaatgatgtttatctaaaaacagttccaattttctatttcctttgctgagacacaaaggggaggcaaatgtgcaaagcttgagggtagtcttaccactgtgcttaagtgttctgatttttctagtgatcagggcaaaataaaaagtatagtaagttccaaggcagtgaatattatacaggagagaagttacagttttataatgtgttttcctttacactaaattctaaaagtaaaaagtctttttttttttttgacagagtttcactcttgttgcccaagcaggtgtgctatggtatgatctcagctcactgcaacctccacctcccgggttcaagtgattctcttacttcagcctcccgacaggctgggattgcaggcgcctgccaccacacctggctaatttttgtgtttttagtagagatggggtttcaccatgttggccaggctggtctcaaattcctgacctcaagtgatccatccacctcggcctccaagtgctgggattatgggcgtcagccactgtgcccagcctaaaagtaaaatgtctttcatgagcttcccaaggcagctacgttaaggaggacacttctcttaatgtcattctacagtagatttctaatgctctttcttggaagtttgtttttctgagaaaagctaaaaatataacatggaagtgatcatattatataatcaatgaagtgcttttcaaggagataaaactaatctggtccacacttgcaaccaaccttgattgagagagagagagaactcaggatacacttgaagattttattatggggaacagttactttattctttttacctcaatcaatgcatggaaataagtgatagtcattttcatttatcttttaataaatgaagtcaccatgaggaaaataaaaagacattgaaaacccattaaagtcagcccttaaagatatttggacatgcagacttgataactaacgtttgcattcttgagacttacccaaaacccatacctcaagtccaagtttttagaattcatgaaataaagatctcagtgagtgcataaaattgcgcaccagaatcatatccgtatagacaagaacacatctactagaaaaataataaaccaacacaccaatgcaactgtgttttcttctgttttaaagtatgttgtctttgtatgcatgtttgcttcttcctttttttttttaacatcacagataaattcaactctcacctcaggttttattgagagaactgtcaatgtgacttggcctctgtctttctagtcccagaaagaattgcactgaaatctgagctcctgtaataaaaacaaccatttgctgagagtaattaacatactgaaagagattttcttagagtacacaatggtgacattatattgcctctttataaataactttctatctatttctgtggattattcctacaaagtacttttcatatgtccaatttcttttcttcccctacaactactgtctgaatactggctctgctatttgctgatatgattctcggcaagttgcctgcactttttaaactttatttcctcattcagaacatggggccatacataatacaactcacttcagtgttattggggaattaaacaaaaaatgcatgggaagcatttaacatagtgcctgacacaataatgagtactcagtagatgttagcttttattaatattgttgttgttatgtccagaaacactatacctccagaaaatcatgggtacttgctggggacattggggatatgcatgatttggaaaagaatgactgctttttttgcttagatgagaaatttttctaagccagactccttcaaatatgtaagattctgttgtggattcaaggactgaaagaattcttggccgagtgtggtggcttatccctgtaatcccagcattttgtgaggacaaggcaggaagattgcttgagtccaggagtttgaaaccagcctgcgcaacatggcgaaaccctgtctctacaaaaaatacaaacattagctcggagtgagtgctgacatgtgcctgtactcccagctactcagaaggctgagatgggaggatctcatgagcctggggagtttgaggcttcagtgagccgtgatgacaccgtactatactccactccagcctgggtgacagtgagaccctgcctcaaaaaacaaacaaacaaacaaacaaaacaaaattaatctttttgctgatgtcatgtcagcagtgtgtgttgaaggctgtaaagcagccatttgttcagtttatttttccattgaacaagtatttatcaaaaacatactttgtggcagtcactatgctaggagctatgaatacagaaggaaaagtaaatgctcttggatactacactccagttgtgataaaaaagaaaaaatgtattcttcaccaacttcaacatcttgatgtgcaaaaacataatacatgaattagatctacctaattacacagaattagaccaattgtttctggaattgtgggctcatatttttaataactgtcctcctgcctctctgtcgacaggttttataaatattcatttaattacacacacacacacgaacaattgactagtacttgctctcattcttctagatgtcatcacaatggatcccaaagacaattgttcaaaagatgcaaatggtaagcttttgtgtttttcccttcctcctgatcattttgttttgaacttctctggcttgaaaaatcagggaatggattttgctaggttggatgctgcagaatggacctagtgatattttaaattagtccctcattttctaggagttgtattaacaaacctaactactgctttggggtatgagatgactgtaaattagagagggtacagtggtatagtgatatgcttttaattatttcaaaaaaaagattttattcattcatgtgtcttttttctttttcttttcttttttttttttttttggacagagtcttgctctgtcacccaggctggagtgcggtggcagtatctcagctcaccacaacctccgcctcccggcttcaagtgattctcctgcctcagcttctcgagtagctgggactacaggcgcgtgccaccatgcccggctaatttttgtatttttagtagagttggggtttcaccatgttggccaggatggcctcgaatttgtgacctcgtgatctgccccctcgccctcccgaactgttgggattacaggcgtgagtcactgtgcccggcctcctgtcctgtcttttgtttaatgactgggaaaaacatgataccatgttgcttctcgagttgttttgttttagtctttggtctttgctagtagctaataacacgaactagtgtttatcaagtgctttttacacagaagggcttgggctgtgttctgcattttcttgtttaaccctcttaaaactcctataaaatggtacatatttttctcccaatttacagtccctttaaagcaaataattataaaaatccctatacatgtcacacagctagatctgggatttcaaatcaggccatcaaacaaagagtttatgtacttagtaagttttctgttctttttctacaatagagtcagatagcaagaaattaccaagccaggaacctgaaacaaaacggacatcatgtggggctgggtgggtgcatgggctttgcagactggactttcactccagctcttttaatgattaggtgtaagtgacctacattttgtgagcaacagttttctcatcagccaacaaagaataattacaccagattcacagttattgaagagataaaggcatgaatgtgagatgtctggcatagggcatctcatttagcagacacagaatgagtacttgtttctggctttttctctctacatatgcacaaagaatgcgactagaagcatgggctctagccctgctcaactttcctctatttccaataccaaggggctctgacttaggctgccacaccaggcaaggagggcagtaccacctcacttgaccaagggcagggagtcacggacacatcacttcttgagatccttttccacaccaaggactgatgtttctggaattctcactttatgaagacaaaacatataaatggaaattttctcaggtagagactcactcttgtagctcattgagtaggcactagtggtccacccccactgtctttacttattccttgacatcacatatctcttgcaaaacctcaaataatattaaatgcaatcacccaataatagcatagccataattagaggcatttaggaaagacaggtgagtgtgccacaactacctaacacatcagcaaatctggattaaccactttctttgattttccacaatgcaaccttactttttaatagttgggaatgttctaagtgaatttagcagaggttgttaatcaacttgaaagctgaattctgacttgtctgactcttggtggtgctggtagcagtagatgtttacttttaggttttggtggtggtggaatatcacttcaacgtaaatcatcagaaataagtatttgtgaacccctctcgcattaatgtatcttattctgtaaaaagaacatgtgcaatttctcttagatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttgacttttgtccatggtattttaattggatgacatcaaattgaacatccaaggtaagaaacagcatggcaattgggctgtggaattctgtattggttgtaagaatggtccaacaccccatttctaattctttccctgagatcgtggttatcacaccttctaagaagaactacaaccaaatgaaggagctcatgtgacttctgtttgaaaggtcaccagagtcagattcattcggtttaggacattccagtggctataggacactatctactgtgacgcgtaccgtgtgagctcagctctagagtgtttcacagacactgtgtttcctgatcctcacgatacccccatgagagctgccctaaaagcagagaggcagcgtgatggagaggttcagcacatgctctctgatcccaggaatcctgggtatggtgtttcgtatctgtgtgacctcaggtgagttccaggaactctatgtgccataatctcctcatgtaaaatgaagttataatgccccgtttcctggagttatgtggattagatgagttaatgacacctggcacatgcaagtcctccacagtgtcggcacgcactgttggtagctctactctagagacagtaataaaccaaaaagtatctgacacaggcctcaatcaacttagaagtttattttgcctatgttaagggcatgcccaacttcctgagataataatttatttcataagaatattttaaaaactcgagtaaacttgttaatgtttattgctgcagccactctgtccatctccaccatcactgcaacaacgcaggtccttgttgcctcttattggcttatggtgaccacctataaaaccatctgcttcacccaaattgctgtcctggggagtgccccttcctttctgcttgcacatttatcttcctcaagtgcaaatgtgatcatgtgactttcctccctaaatcttttagcaagtcctcattgtctattcttctttcaaaaacatttatttgaaaatactattaaaatagaaaattttccacattcttacttcttaaaaattaatgtgttttaagtttctcctactccatttccatcccatgcctctttactcaatggatgcaattattcttctacatgttccttctggccatgtgtagctttgtcattttaattttaatctatttggaccctgtgttatctgggatgaggtagagtgatatttttattttctcaggtaattatttgcctaatgcctgtttccaaataatccaccatttccttacaatttaaaaatgctccagcatgtttttaatagctacacatatttgacacattttctggagaatttctgttttatttgtctatttcattattcttgtatcattatcatattatctcagtagctttgtggcaagtattaagatctactatgccaaatgtctattcactgtaccatttttcagaaaattctttttcaatcatctcatatttattcactcctgtagaatttaaaatcaacttatctagcctaacattaaacctcacaccctagaacaacaacatgtcgtagtaattctgactaaaattgctggaaatttatagatgaatttagggtgtattggcctctttatgatagaagctttttattcatcaatgtatgtttctccatttatttaggttttattttatgcccttaggaaaactaaatactgtgttcttcatatcattcttgtatttttttggtaaatttaataaaagattttataattcattacttcttcacattttattagttaaatccttcatggctcttgaaatattgacagctgctaagacttctgatgcttcccctcatggtcctgaaataaggaaggccagaggacaaaaagagattgagtgggcgtcattccatctatcacaggtgtaaagggtcattgacagcgccacataataattttgaattttctattaagaagaaaccctttccaaacataattttcacccagccccattgtcttctccattgttgtgggggctgtggcctgccgtgtatggataggtgccctctgtgacctcactcataccttcctgaatgaagactcaggagacttaggctggagcagggtggatctggagtggacatggaggttgtcaaggcttgtcctcctcagtccttgcaactgaacacctcatctgtacacaggagatcacacagccgacaccagcttaagatggcagatttttcaacatatcagataactaaatttttttttttggttatgccatagtttaaataaagaatgtattacttcatgggacatagaattctacaaatttcttctgctattccaggaaaaatgataagtcattgtggaaaacatttcctcatttggcattgccttggtaaagcatcgtgttgccaaatgatacaagtggctttttgaaagtggagacctttgttcaaatttctcaagtatatctgtgttgacacatttgcattttcagttactaaagagcttcctcctttcagaagtatcttcccaaattactaacaggccctggtgtttgtgggaacagaagggcttttcctttgatgtaatctcaaagcagtttcaacacaattgaacccctggaaattaaaaaagaaaaaaaacgacaattctctgaatacttttcctggtaatttagaaaagtagtgcattgacccactgagcctgctcttttttctctctatcgcccaggctggagtgcaatggcacgatctcggctcactgcaacctctgcctccctggttcaagcaattctcctgcctcagcctcccgagtagctgtgactacaggcacacgccaccacgcccggataatatttttttgtatgttagtagagacggggtttcactgtgttgccaaagctggtcttgaactcctgagttcaggcaatccacctgactcagcctctgaaagtgctaggattacaggcgtgacccactgcgcccggcctttctttttttgttgttgttggttttttatcttaacatttcttttttctgttgatgcttttcaagaattactgccttagaagaaagcaggcaatttatgaggaaaaattacaaactatcacatgtcacaaaacctatattcaaggacttccaaaaaagccagaagatgaaattgctagttcaaagttgttggattgctagtcatgtcatgaggatcagaaggttgagatttttgtagaagcttagaccagtgtgatagtagtgattggatcaagacgtttgcaaaagggactaggctcatagtaacttcgcctggtaagtaattttttttctgtttttattccagtaatgaaaaactgatagatgttttttagaaaaaaatgatcaaccttacctgaatatgtcacattcctggcctcagtatacgaacagcaatttttcagggtagctgaatgcctggcacttggtaggtgatagaaatattatttcctcttccagaattcaagttactacccaagagaggtctttatacactcaggaatacagataaatgtatcaatccccatctattcaacagctcacttcagaagaaatgtcactattcataaaatgctttttatttctaaaagcctaattgtacctgcttctaaaagcaattagaatgttttacgtattatctcaaatatgatctgcctgaatacaaggtgatttttcattttccagagaaaatttatacaagtttaagaaaatatgtattttcccctcccccaacttgaatatgtaaatttatagggatacaagtaaaaaagtgaaatgtctaattataacattcaatttcttaactggatcatacctcaaagttaaagattatatcaataccaatatcagttgagaaatattgccttttttgcccttatatttcattaaaatttttgttttatgcttcacatgcatgtaaagcatctatctcagagcaactttctaaggcatctcaggtctcagtgtccattttggattcctcaaatgatgatgtccctgaatattttactctaagaaacaatgatccactcacaaaataaaaggaaattattttttccgatttattctgttattctacacttgtatgaagtaagtaagaactacagggactttagctccaagtaataatgaccaaatccatgataaatttctttgctttttttccttttaccagtgctatccccaaaactagcattcattgagttcatttcatgtcggtatctcctccagttagtccttctggatcaaagcagagtattagaagaacattttttaatatgagagtttacacaaagactgtaccatacataaggcacctccccatgttgtgagagaaaaattttggaaaaaaagcctcattttaggttctggcactttctatctaaatttagtatgtaggtgtccctatcacagagctaggatttgcaaacatattctccattccttgtgtcttatttgagcttgaccttacaaaaccatcaactcctggggacaaaagagaaacatgctaaatgcacaaactctttgttatttatttaagctatctgtttctaaaatctatttgagaagacctaaattaaaatacacaagcacagtcagaccattaaatatatacagatgatctaaagccctaaggaaaggagaaggaaaaaggcctgtgattacctagtgaggagcacagtttaaaattttatgctcaaaagaaggagaaaaaggtaggggaatacatacatcttactaattgataaaaagaagcacaccaaattttcaaatatcatattttttctattactaaattggaaaaagacttcaatgcatgagtcctttagaaggaaatggaagagtgggcagtgccttcaacttccattttggaaaatgaaaggaatggtcatgaaaaacccactgcatattaccactgcatcagtgctatgggcatcctgacatttaatgaaatgcgcagatggtgatgctcagcagacatggtcaggcagataacatgtagtgatctaaagtgacaacagagagatggatttgaggaccaggcctcttgccttttctctacccattctcccttgaagggtcaagccaggtgtttcgagcgggactttggcataaactagacagaagtcagtttgaggctgaagtttctggtgaaacttggaaggcaaataagttgtgctgctgattagaaaaaggctcacttgttttgaaaaacacaagtgaagaatttccatacactgacactgactgcatatattagactttagccaatattccctttgattttcttaacacggcaggtaaggcaaaggataacctattaaagattgggtgtgtggaaggcatgtttcttgtgatgatggggacgatggctttgagaatcccagagcaaagtggaatgcaaacagaggaactgagaaattattcttcctgcttaattgctatggatttaactgccactccaaaatgctgaattttttttagtaagggcaatgcttggtcctatagggttaaaatgtcatgtcaaggcacacaatcatagcaaacagattgccaatcataacaatgacaccatattcatcataatctcttatatttccacagcatttttttttgaggcagggtcttcccctgttgcccagtcgggagtgcagtggtgtgatcaaggctcactgcagcctcgaactcctaggctcaagtgaccctcctgcctcagcctctcgagtagctgggcgtacagtcgtgcacatcatgctcagctaatgctttttgtatttttagtaaatatggggtctcactagatactgggttgcccaggctggcttcaaaattctgagctcaagcaatcctcccacctcagcctcccaaagtgctgggattataggcacgagccactgcactgggacctataacattttaatcaaattgcttttttatatcttgtttcattttggtctcacttcagtgttggtagcgatgttgaactgattttgaaacatcactgtttttagacaaataaaacaccaaaagctttaagttatttgatttgtggagcaacagaacttgttatgagcaaaatgaaccaggactggaaccctggtcttttgagaatcccagaccaccagaatttgaagaactcagggaaactgaattagagtttttgatatggactgaatcactgtggaattattataagaaactctttggcagtggaacaacacttgttgtcacaggtaagtatcggaagaatacaacatttccaaggtaatagagggaaggcaggaaatgattaaactggaataatgtaataatgtttagaaaaaagaggaattggatggggatttgatgtagaaatcctaggagagactttaaaacaaatgctcatactaaaagagaacatagataacatggcacagatatcataataggatttggctttgtgcatatacggacttccataaagggctcatatgtaatgtatgaaatgatctcattaaaatgtctggccctgagaccaaatgtattatgacaggttagtttgtgatagactctataaagcggacacatgttcatctctgatggtcaaagagatgttgactcttgttgtgaaggagcccgggtgttggagtcaggtccacctggaactctggctccactactcactgcttagtgaaattgagtgattattctctggcctcagttttctaatccataaaatgggataacagtatgaattcagcagggttgtataagaattgcacaacatagtgtgaattaagtacttggcacattgtccaacccaaaataggtgcccaacaaatgttttctggattcacatgtaaagagacaatgggatctactatggagagttgctctcagtccatctaatttacagagcagcaattctccagaggattcagctgtacttctaactgctcaaatggaaggttatcttaacatcagctcacagacaaaaattgaacttatggattcgtttcttgttagcagactttttaatcacgtggcaaaaacattgtattaagatgtctgttttttatttttgttgttctatgtgctttacttaatcctttatcttaattgatatcatttctaacaccaacatattggtcctaagatttatagccaattagtttagggttctgttcatatgtctcaggaaaaaaaggttaaaatcttaccaaaaatagtcaagatatcaaatcaattaaatccagttggaaacatcataaatctgaaatacatatttaaacataaaatggctataactatttagctagtgaaaaaataagaaatagagaactcttaaataaatatccacatgtagatttaatatatcataccgtctataaaactgtagttgatacttggtaaatttacaacgctgcattttaataaactacaaacaacttaggcaatttaactcaaatatactatttgattatgcaaataaatgtatataaatgaatccaacaggtttatttaaataaataaaatatatatattctatttgttactgaagtaagtaaaaatgtaccatacttgaccataaaaaacactcttaatatgtacattttaaaagtagtattttaaaaatcatgtgagaggatgatccagaatatcggcccttaccatgtataatcgagtatgctatttaatgattcgttaactattaccttgagaaagttatggaagttccagattcattttgtcctgaaaagaatgaaacttaaagaatctagctaaagaaaggggcaagagacaatgaatgctgtggtaccgtacagaaaatgtccaagtttatcatttgatttttaatttctttagtacaatgaattagaagtatttcaatgaagagacactagttcttaggatgaaaattagattggaaaatacattgactagagactaaaattatataaatataatgtacaattgaaaaattactcatattttataacatgcttttaaaattagaagcaaactatatggtggagaaatatacactgtctcacaagtataacaagtaaaatactatttgcactaaaagcaaagagtatgaaattaagatgagcacattatgcctaattaaatttatagcatgctcacaaattaatatttctgtatatgtttactaattttgtatgaaaatcagaagctttgctacacagacagaaattatcaagattgttttcttttcttctgaaatgagaaatttaattcttattttcttaagaaattgttcaattattaaactcacttcaaaccagccaaagcattggagtttcaatgggaaatcaaaatagaaagaattgtaacatttataatttcagttattagattaaaaatacgtgtataacccattaacatcccagattcaagtgatatgcctttgtaaacatatgatgctttgttatgtatcttgaccctatccctataagaagctctgaaatcatgacttttaatagagcaattacatactcattttattcagcaggctaagacaaagagaataatggagatttaaaacagttaaatagcatattaggacagatacaaattctgggagagacataaagagtcaaaatatagatacactgatttacatagaccttctcattaatggggtaaatttatataaaaaccagtataaaaattacacccctggtgcattcttagtcattcttaaacttcaaatgaaattccaaaataaaatgtgcttttggtgaatattttctaaagcaaaatgaaattttgataagtgcattactggagaagattaacacaagagtatttctgaaaataatcaagaaaaaatttaaataagaattttggaaatgttgccattttgtttctaaagtcaagagatggtgaataatctggaggtacagctgtaagtactgctgcatcccaaaacttggagggtgcagatgtgaaattgagatgttatataaagttagatattaactagggggactgctcatggtatacacattgaagctacatggtcaacttgatagacagtatgtacatgcggaagtagattctctttaaaacaagtgactgtgtatgttaaaaataaaagtgaacaaaatggctaggcatggtggctcacacctataatcccaggatttgggaggctgaggcaggcagatcacttgagcgcaggagttttaaaccagcctggtcaatatggtgaaatatgtctctagaaaaaacaaatattagccaggcatggtgatgcatacctgtagtcccagctacttgggaggctgaggtgggaggatcacttgagcctgggaagtcgagactgcagtgagctatgatcttgccgctgcattccaacctggacgacagagcaagccccagtctcaacaacaacaacaaaaattttgacattgattcatatgggaaataagataaataacaagataaatatggtgcatcgcagaatcagttaaatgaagagtggaagtacacgaaattgcagaacatgagaatgtgtcatatttggccaaagaacataagttacaaaggatggaaaagggaagtgagaaaaggaccaaagagtctcatctgtagagagatcattaaggttttctgaccttccactttcccctgccatccaccttgaaaacctgcttcactgtgatgaaacaaaagagatttaaaaataaaataaatatgctcatgaactttggaagccctggtaggaggcagttaaaaatcacactcatcacagcatgtgcagaataaacaaaggccaggttttcgtccagcatctgacacttgagagctgtgacttttggcaagttatttaatgtcttgattctcttttcaacatctgtaaaataagcacaataataagtactgtgcagcctatcctggatgaaaggccgcggtggacaccagctcaatggcatcttctctttttatggttatgtactaggccactccaaaccgtgcaatgtgtgtgtttctctaatgattcttttaaactcatatttcatttctccccatagataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacaggtatgtgtttacacatatcatctgtcagaacacttctttgaaagtgaatgctgcattttttcctttcagtattaatgaaaaacataaatctttcttaaaaattgttacatttaatggtagcgtaaatgccctgctacttttctatagaattaaaatggtataggttttggagaaaacaaaattgaaaaagttgctgaaggtttgtcagcctcagctccattatccaaaataagaaagtcacgtgctggtttttagggttgttagatggattaaagaaacaacatacacagaagcatctagcaacgtgacacgtggtaaacgctcaaaaagtgttctcccttcttttgatgactttacttgatcaggaaataacatatatatgtctttcaggaatgttctgcccaagcaggagagtcactcacctcaatcttgctacccacaaagtttaacctaaaaacaacgggttcattgttgacaaaataatgtttatctgaagataactgtagatcatatttatctgtagataatgtttatctgtggagtgtggctctacaaaacatagaatagtcttggtcactgcagttttatagaggccttgggtttttcagagtttcattttatatatcaccataaagtaacatttcataattacaggttggtaaggcttacatgtacaaacattcttccattttccataataaatgcatttcctgccattggtgaatgcagctcaataaacatttattgtacaattatgacacgccaggcttagtggaaatgtggatgaacagacaaggatgagttactgtcctaaggatgatgcatgacagtgcagagaatatactctcttcctgatcactcagggtcactcatgattcatgcgcgaggtcccaaaacagtgcctttgatgcagattctgtacatctctagacgattggtccaagggctgaatgtgctctggcccagtggtccagtctgtcactatatgtcaacatcctgaatatgaacataacagtccaacatctcaagagtgggcatgaaaaggactcattttgtgctttttcctgtggttaacaagtcctttttagcctgggggaacaagcattaacaaaatgtttgaagatctttgccacgtaccattccaaatttctagggtaagtctttagcttttcagatcctgagtttctgcaatgatcaaatgtgatttggacagttgcgttgactttctcctggggctataatggagtgcaaaggaaacaatggcagggaaaatgcttgctttcaaaatggtagcatggatgtgttcattcgtgtagttactgtattaggtatagcctttcctgaaactaactgaagtggggttataaaaacagtcccaattttctatttcctttgctgagacacaaagaggagacaaaagagcaaagcttgagggtagttttaccactgtgcttaagtgttctgatttttccagtgatcagggtgaaataaaaagcatagtaagttccagggcagtgaataccatacaggagacaagttacagttttataatgtgttttactttacactaaattctaaaagtaaaatgtctttttttttttccgagacagagtttcactcttgtagcccaggcaggagtgctatggtgtgatctcggctcacagcaacctccacctcccagtttcaagcgattcttctgcctcagcctcccgagaagttgaaattacaggtgcctggcaccatatctcgctaattattctatttttagtagagatcgggttttaccatgttggccaggctggtctcgaactcctgacttcaagtgatccacccgcctcagcctcccaaagtgctgggattacaggtgtgagtcactgtgccggacctaacagtaaaatgtctttcatgtgcttctcaaggcaactacattaaggaggacacatctcttaatgtcattctacagtagatttctaatgctctttcttggaagtttgtttttctgagaagagctaaaaatataataacatggaagtgatcatattatataatcaatgaagtgctttcaaaggagataaaactaacctggtctgcatttgcaaccagccttgattgagagagagagaactcaggatacacttagagattttattatggggaatagttactttattcattttacctcaatcaatgcatggaaataagtgacagtcattttcatttatcttttaataaataaagtcaccatgaggaaaatgaaaacccattaaagtcagtccttaaagatatttggacatgcagacatgataactaacatttccattcgtgagacttacccaaaacctatacctcaagtccatttcttagaatacatgaaataaagatctcagtgagtgtataaaactgcacaccagaatcatatccgtatagacaagaatacatctactagaaaaatataaaccaaaacaccaaggtgactctgtttttttctgttttaaaatatgttgtctttgtatgcatgtttgcttcttcctttttttttttaaacatcgcagataaattcaactctcacctcagttgagagagaactgtcaatgtgacttggcctctctctttctagtcccagaaagaattgcactgaaatgctgagctcctgtaataaaaatgaccatttgctgagagtaattaacatactgaaagagattttcttagaatagtgcacaatggcccaatggtgacattatattgtctctttataaattattttctatctatttctgtggattatttctacaaagcacttttcatatgtccaattccttttattcccctacaagtactgactgactactggctctgctgttcactgatatgactttcggcaagttgcctgcactttttaaacgttatttcctcattcagaacatggggccatacaaaatacaactcacttcagtgttattggggaattaaacaaataaatgcatgggaagcatttaacatagtgcctgacacaataatgagcactcagtagatgttagcttttattaatattgttgttgctatgtccagaaacactatacctccagaaaatcatgggtacttgctggggacgttggggatatgcatgattttgaaaggagtgactgctctttactgctcagatgagaaatttttctaagccagactccttcaaacatgtaagattctgttgtggattctaggactgaaagaattcttggccgagtgtggtggcttatcctggtaatctcatcatttgggaggacaaggcaggaagattgcttgagcccaggagttggaaacaagcctggacaacatggcgaaaccctgtctctacaaaaaatacaaacattagctggtcatgggagtgagtgcctgtactcccagctactcaggaggctaagataggaggatcacctgagcctgggcagtttgaggtttcagtgagccgtgatgacaccatactatactccactccagcctgggtgacagtgacatcctgcctcaaaaaaacccccaaaattattctttttgctgatttcatgtcagcagtgtgtgctgaaggctgtaaagtagccacttgttctgtttatttttccattgaacaagtatttatcaaaaacgtactttgtggaaggcactgtgctaggaactatgcatacagaaggaaaaccaaatgttcttggatactacactccagttgtgataaaaaagaaaaaagtattcttcacaaacttcaacattttgatgtgcaaaaacataatatatgaattagatctacctaactacacagaattagaccaattatttctgggattatgggctcatatttttaataactgtcctcctacctctctgttgacaggttttataaatattcatttaattacacacagtcacagacacactcagacacacacacatacacacacacacacaccttgacaaataatgggcatgaacaattgactggtacttgctctcattcttctagatgtcaccacagtggatcccaaatacaattattcaaaggatgcaaatggtaagtttttgtgttttttatttcctcctgatcattttaagttttgaacttctctggcttgaaaaatcagggaatggattttgctaggttggatgctgcagaatggacctaatcatattttaaattagtccctctttttctaggagttgtattaacaaacctaactactgcttcatgtaagagatgactgtaaattgaagggtacagtgatatgctttcagttatttcaaaaaacagactttactcatccatgtgtcttttttcttttcttttttttcttttttgagacggagtctcgctctgttgaacaggctggattgcagtgacgcgatctcacctcactacaacctccgcctctggagttcaagcgattctccagcctcagcttctcaagtagctgggactacaggcacatgccaccatgtccgggtcatctttgtatttttagcagagaccgggtttcactatgttggccaggctggtctagaattcctgacttcgtgatctgccccctcagccctccgaagtgctgggattacagacgtgagtcactgtgcccggcctaacagtaaaatgtctttcatgcgcttctcaaggcaactacgttaaggaggacacttctcttaatgtcattctacagtagatttctaatgctctttcttggaagtttgtttttctgagaaaagctaaaaatataacatggaagtgatcatattgtataatcaatgaagtgcttttcaaggagataaaactaatctggtccacgtttgcaaccaaccttgattgagagagagagagaactcaggatacacttggagattttattatggggaatagttactttattcttttttcctcaatcaattcatggaaataagtgatagtcatattcatttatcttttaataaatgaagtcaccatgaggaaaataaaaagacattgaaaacccattaaagttagcccttaaagatatttggacatgcagacttgataactaacgtttgcattcttgagacttacccaaaacccatacctcaagtccatgtttttagaattcatgaaataaagatctcagtgagtgcataaaattgcgcaccagaatcatatccgtatagacaagaacacatctactagaaaaataataaaccaacacaccaatgcaactgtgttttcttctgttttaaaatatgttgtctttgtatgcatgtttgcttcttccttttttttttttaacatcacagataaattcaactctcacctcaggttttattgagagaactgtcaatgtgacttggcctctgtctttctagtcccagaaagaatcgcactgaaatgctgagctcctgtaataaaaatgaccatttgctgagagtaattaacatactgaaagagattttcttagagtacacaatggtgacattatattgtctctttataaataactttctatctatttctgtggattattcctacaaagtacttttcatatgtccagtttcttttcttcccctacaactaccgtctgaatactggctctgctatttgctgatatgattctcggcaagttgcctgcactttttaaactttatttcctcattcagaacatggggccatgtaatactcatgtacgtgagtattacgtaataatgctcacttaagtgttactggggaattaaacaaaaaaatgcatggcaagcatttaacatagtgcctgacacaataatgagcactcagtagatgttagattttattaatattgttgttgttatgtccggaaacactatacctccagaaaatcatgggtacttgcttgggatgttggggatatgcatgatttggaaaggtatgactgcttttttctgcttagatgagaaatttttctaagccagactccttcaaatatgtaagattctgttgtggattctaggacggaaagaattcttggtcaggtgtggtttcttatccctgtaatcccagaattttgggaggacaaggcaggaagattgcttgagcccaggagtttgaaaccagcctgggcaacaagacgaaaccctgtctctacaaaagtacataaattagcttggcttggtggtgtgtgcctgtattaccagctattcgggagactgagatgggaggatctcctgaacctgtgaagtttgaggcttcagtgagccgtgatgacaccatactatactcgactccagcctgtgcgacagtgagactctgcgtcaaaaaaaaaaccccaaaattattgtttttgctgatttcaggtcagcagtgtgtgctgaagggtgtaaagtagccacttgatcagtttatttttccactgaacaagtatttatcaaaaacatactttgtggtctgtttttgataaataaaaaggcactgtgctaggagccatgaatacagaaggaaaaccaaatgttcttggatactacactccagttgtgataaaaaagaaaaatgtattcttcacgaacttcaacattttgatatgcaaaaacatagtatataaattagatctacctgattacgtagaatcagaccaattatttctggaattgagggctcatatttttaataactgtcctcctgcctctctgttgacaggttttataaatattcatttaattacacacacacacacacacaccttgacaaataatggacatgaacaattgactagtacttgctctcattcttctagatgtcatcacaatggatcccaaagacaattggtcaaaagatgcaaatggtaagcttttgtgtttttcctttcctcctgatcattttaagttttgaacttctctggcttgaaaaatcagggaatgggccgggtgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcttagtggcgggcgcctgtagtcccagctacttgggaggctgaggcaggagaatggcgtgaacccgggaggcggagcttgcagtgagccgagattgcgccactgcactccactccagcctgggcgacagagcgagactccgtctcaaaaaaaaaaaaaaaaaaaaaaaaagaaaaatcagggaatggattttgctaggttggatgctgcagaatggacctagtgatattttaaattagtccctctttttctaggagttgtattaacaaacctaactactgcttcgggtatgagatgactgtaaattagagggtacagtgatatgctttcagttatttcaaaaaacagactttattcatccgtctgtcttttttttttttttttttttttttttttgagacggaggagtctcactctatcacccaggctggagtgcagtggcgcgatctcggctcaccataacctccgccttactggttcaagcgattctccagcctcagcttctcaagtagctgggactacaggtgcacaccaccatacctggctaatttttgtatttttaatagagatggggtttcaccacgctggccaggatggtcttgaattcttgacctcgtgatctgccccctcgggctcccaaacttctgggattataggcgtgagccactgtgcccggccttctgtcttttgttataatgactggggaaaacatgataccatgttgcttcttgagttgttttgttttagtctttggtctttgctagtagctaataacacgaactagtgtttatcaagtgctttttacacagaagggcttgttctgcattttctagtttaatcatcttaatactcctataaagtagtacaatatattttctcccattttacagtccctttaaagtaaataactataaaaatcccttatacatgtcacacagctaggtctggcatttcaaatcaggacatcaaacaaagaattcgtgcagttactaagtcctctattttttctacaatagaaaaaatagcaagaattacagatagcaagacattacaaggcaggaatctgaaacgaaagggacataatgtggggctgggtgggtgcatgagctttgcagactagactttcattccagctcttttaatgattaggtgtaagtgacctacattttgtgagtaacagttttctcatcagccaactaagaataattacaccagattcacagttattgaagagataagggcatgaatgtgagatgtctggcgtagggtatctcatttagcagacacagaatgaatacttgtttctggctttttctctctacatatgcacaaagaatgtgactagaagcattggctctagccctgctcaactttcctctatttccaataccaaggggctctgacttaggctgccacaccaggcaaggaggggcagtaccacctcacttgaccaagggcagggagtcacggacacatcacttcctgagatccttttccacaccaaggactgatgtttctggaattctcactttatgaagacaaaacatataaatggaaatttctgcaggaagagactcactcttgtagctcattgagtaggcactagtggtccacccccactgtctttacttattccttgacatcacatatctcttgtaaaacctcaaataatgttaaatgcaatcacccaataatagcatagccataattagaggcatttaggaaagacaggtgagtgtgccacaactacctaacacatcagcaaatctggattaaccactttctttgattttccacaatgcaaccttactttttaatagttgggaatgttctaagtgaatttagcagaggttgttaatcaacttgaaagctgaattctgacttgtctgactcttggtggtgctggtagcagtagatgtttacttttaggttttggtggtggtggaatatcacttcaacgtaaatcatcagaaataagtatttgtgaacccctctcgcattaatatatcttattctgtaaaaagaacatgtgcaatttctcttagatacactactgctgcagctcacaaacacctctgcatattacacgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataatggttttcaaaccagtgggcacacagagaacctcactctgtaataacaatgaggaatagccatggcgatctccagcaccaatctctccatgttttccacagctcctccagccaacccaaatagcgcctgctatagtgtagacagcctgcggcttctagccttgtccctctcttagtgttctttaatcagataactgcctggaagcctttcattttacacgccctgaagcagtcttctttgctagttgaattatgtggtgtgtttttccgtaataagcaaaataaattt

SEQ ID NO: 37327 - DNA, 40305 bp, Homo sapiens
ggcatgggtcctggccgccggcttcgctgagacgcgctcgcgtgggctgccctcccgggcccgcagtggtcgcggcggcatgaagggcgctctggggagtcccgtggctgccgctggcgccgcgatgcaggagagtttcggctgcgtggtggccaaccgcttccatcagctgctggacgacgagtcggacccgttcgacatcctgcgcgaggccgagcgccggcgccagcagcagctgcagcgcaagaggcgcgacgaggcggcggcggcggccggggccggtccccgcggcggcaggagcccagccggggcctcgggccacagagccggcgcgggcggccggagggagtcgcagaaggagcgcaagagcctcccggcgcccgtcgctcagcggcccgatagccccgggggcggcctgcaggcgccgggtacgcggggacagcggggttagcggaccacggctcggcccgctgtgagactggggtcccgggggccggtttcaggaggaggggcccgggaacagtagggagagttgagggtcctggtggccgccgaaggtaggaggagaggggcaggggtcacaccccttccagctctcgccagcctcgtgcggggctccgggggaaacgctggcttggggtgggatagggccctcgaaccctggcactgaggctctacggcaagttggacgaagttgagggaggttgtctgggtggcgtgtgggggcgaacggctgaggtcgctaccccggggctcccacatccagacctggcggggaccttcatcttccagcccagcctctgcaagattgaggtcggagccacccgagagcgcggtggggaggaggagggcgcctggtcccggggctgggggcctctgtgatgccggaggcctgggcgaccgcggggcggcctgtgacgtcggggcccgggcgggggtccccggcgcggtccggcctggcgccttcgccccttctccgtccggtagcttccaggaggcagccggcatcgtatttcagtacttcgtgtggtgttgatgggatgtgcaacttataaatagctcaaggctgctttaagaaaagcgtttttaacctttccagcaagaatattcggagttccccactccctatttagcaagaaaaaccggtgcgcagcgtggtgtcctgctgcctgtggacggggagggtgcttcagagttcattctctcaccgaactgcgtcagtggcagagccagcaacactccacctgtgtttcctgttttcttgaaatgaggcagcggtcccaaggtttgcagagtgttaggattaagatgtgtaggttgaccattcctgccgacgtttgccagtgtgttcaacttggctttattggtttgttccttgcttgataaaaattgtgcatcgcagccctgaggaaacgtctcaggtttaagtattagggctttgatgtgcagctgggtaatgtttacctttatttgtgaaaagctaaatccagagtcatcacttgagaatcaagtcactacaataaagatgttgaaaatgatttttaaaaaaatgttatttactatctcacgacactttggtaggccagtaaatttctgagcctatctaaacagtgagactggagatacattgtgcattttatatcctgttttttatctttttctcttaaacttatttacatcaatataataaaggaattgaggaaggctaagcttttcttcaccctttattttttaacaaatgaaaatgccgggtgtggtggctcacgcctgtaatcccagcagtttgggagtccgaggcgggcggatcacgaggttaggagatcgagaccatcctggctaacacggtgaaatcccgtctctattacaaatacaaaaaattagtcgggcgtggtggcgggcacctgtaggtccagctactcgggaggctgaggcaggagaatggcgtgaacccaggaggcggagcttgcagtgagccgagatcgagccactgtactccagtctgggagaaagagcgagactccgtcacaaaaaaaaaaaaaaaaaaattctgtgcttcagaaaaacgtgagacgagttagtgctgttaatacattgatttttagcctttttaaaattgtcatgcatttttgtgttaagaattttaagcaattccaaaatgtatgaggttaagtgaaaatcctcttatttttcctactaacactttgcatttatatacataaatgcacagagctatttcttttctttctaaacttaaatgatataaactgggttgcaacctgtttcctgcacttgatgttgtcatgtagtacactcgtaactttttttttctgtcagttgttaggtctaagtgatctggcttttgaaatcaactaaaggtatttagttgattttgtagttagaacggaaattttatcattcaagttctttttcaagtatgtgttatttcaggagcaaacagctcattaatttccatttatgtagttactgtactaaatttatctataatgggtgtcaaggagctattctctcaaggttttgtaaccctagttgataagaagcactgtacttttctaacattcaaaattttttatctagttagaatgttgtaagtgaatgcttagtgtagacaaaaataaaacatgtttgacatatcatagaaatgttaatcctgaaagaatgtggaagtcacaagcttttcctatggaaaagggtttttttttttttttttttttttttttgagacagagtctttttttttgagacaggctggagtgcagtggcatgatctcggttcactgcaacctctacctcctgggttcaagcgattctcctgcctcagcctccttagtagctggcattacaggcatctgccaccatgcccggctaattttttttttttttttttttttgagacagagtgcagtggcgggatcttgactcactgcaacctctgcctccccggttcaagcgattctcctgcctcagcctcctgggtagctgggactacaggcatgcgccaccatgcccagctaatttttgtatattttttagtagaggcatgggttcactatgttcatgttggccaggatggtctcgatctcttgacctcatgatctgcttgccttggcctcccaaagtgctgggattacaggtgtgagctactgtgcctggcctaattttttatatttttaatagagatggggtttcaccatgttgtccaggctggtcttgaactcctgacctcaggtgatccgcccgcctcagcctcccaaagtgctgggattacaggcgtgagccatgatgcctggccaaaaatgtaggtttttaatgtctgactatctgtctagcaatatgtatataaacccttgggtgagccttgctcaataagttcattcttaaagtcatgagaggccgtttcagttttgcttttcctagcctttcagaattatgttctttgaaacaaaggtcaattttattttgtggaaaatcttactgtaaattttattgtattctgtttctttacctgggcttggtttagatgatgatgaatgcatgtgccagccttttcttggcgaggttagtgaaatgcagtgcttgcattctccacttggagctgctgatccagcacagaaaaacaagcccaattcatggcagtgttgatctcttagtactaaattgtggggaaaaaattggatgctgattatctttgttttgggagagttgggaaggagaacgagatgtttgcccaaaactgatcattattctaattatctttgttttggggggtttgggagggaaaatgaaatgtttgcttgatattgataattattctaataagtagccaattgtatttaacagttttcagttttatactgttggaaaaggctttaatatggtgtacagtaaatgtcctattttaagtttgatgaattccaaatttgacgcaattaaaaaataacttggaggaagcagaaaggtgggataagcacctataagtaattctgtagttgagtggagataataaaagatgtttttaaaactatgggttggaaataggaaatctgaaactatgttaaaataactctttttacgctggggtaaaagtatggaaaagtattgttactgttgacaaattttctgatgactgttatgtcatgatctgttataattttcaacttgttaggtaattaactttcttagtggctttttctgccttacattttgaatgccttttccagttctgaactcttttttttttttttttttttgagacggagtctcgctctgttgcccaggctgaagtgcagtggcacgatcttggctcactgcaagctccacctcccgagttcagccattctcctgcctcagcctccccagtagctgggactacagacgcccgccaccacgcctggctaattttttgtatttttagtagagacagggttcaccgcgtcagccaggatggtctcaatctcctgatcttgtgatctgcccgccttggactcccaaagtgctgggattacaggcatgagccaccgcgcctggccccagttctgaactcttaataaagcacgtgcccccagatctgatgttgcacactcctaggcaaccgggcacaagtgtcagtcacagtgggggctgcgtggtggctcacgcctgtgatcccagcactgggaggctaggcgggaggatcactcgagctctggggttcaagaccagcctgggcaacaaaatgagacctgtctctacaaaaaaaaattttttttttaattagctgggtgtgatggtgcagcctgtagtcctggctatttgagaggctgaggtgggaggatcagttgagccccagaagtcaaggctgcagtaaactatgatcacaccactgcagtccagcctgggtgacagagaccctgtcgaaaaaaaagaaaagtgtcattatcttgatatgtctgcaatcaaagcataatactctgctgggtgcagtggcttatgtgtgtaatcccagcactttggcaggtcgaggcaggtgggtcacctgaggtcaggagttcaagaccagcctggccaacatggtgaaaccctgtctgtagtaaaaatacagaaaattacctgagcgtggtggcacaggcctgtaatcccagctacctgggaggctgagacttgagaattgcttgaacctgggtaacagaggttgcagtgagctgagattgtgccactgcactccagcctggcagtctgggtgacggagtgagactgtctcaaaaaaaaaaaaaaaaaaaaaagtggccaggcacagtgactcacacctgtaatcccactactttgggaggctgaggcgggtggatcacctgaggtctggagttcgagaccagcctggccaacatggtgaacccccatctctattaaaactacaaaaaaatgacctgggtgtggtggcaggcacctgtaatcccagctactcaggaggccgaggcagtagaatcacttgaaccagggagttggaggtagcagtgagccgagatggtgccatggcagtccagcctgggtgatagagtgagacttggtctaaaaaaaaaggcaggtgtagtggctcatgcctgtaatcccagcattttgggaggccgagaccggtggatcacttgaggtcaggagttcgagaccagcctggccaacatggtgaaaccccatctctactaaaaatacaaaacttagcccggtatggtggcacatgtctgtaatcccagctacttggaaggccgaggcaggagaaatgctttaacctgggaggcggaggttgcagtgagccaagatcacaccattgtactccagcctgggtgacagagcgagactctgtctcaaaaaataaataaataaataaatgaaacattatgctccacttatgataacatctttcccatatcctaaacatatcacaagcctcagattatgacctcactacaggatatgaattgaatttaaatatttctaggttatgggaaattaaaattatagtaggttgaatttagatctgttgtgcagctttcacacttgaaaaaaatactttaacaaggaataaattatataattttatgttagtgatgtcataaacatcatttttgctttaaaatgagaccggttaagatttacctgtacccagatgataaagttttggtagaaaatattaaatgggaaaatagaaaagtgtgtatctacatatattccttaaggtcttatgtgtatctaagtgggagggaagtctaatagttaaaaaatataactgtggccaagggcagtggctcacgcctgtaatcccagcactttgggaggccgaggtgagcagatcacgaggtcaggagattgagaccatcctgggtaacacggtgaaaccccgtctctactaaaaatacaaaaaattagctgggcgtggtggcgggcgcctatagtcccagctactggggaggctgaggcaggagaatggcgtgaacccgggaggcggtgcttgcagtgagccgagatggcgccgctgtactccagcctgggcaacagagcaagactccatctcaaaaaaaaaaaaaaaaaaaaaatatatatatatatatatatatatatatatatatatatatatccattaacttgaataaatgtcatagctatacaactaatgtggagagtaatttgtaccaagaaaaattgaagccactatagtaaatattgcacatagtgagaggagatcttttaaatgtatataaaaaaagatagactttttttgaagattaaagatgtgacaaagttctccacaatgtatttaccaagtattagatggcttcaaacatagactttgcttaagatgtttaaagcattaaaactaaaggggagtaaagcaaggtgacaggacagaggaaaagaccagagtctcggccgggcacggtggctcacgcctgtaatcctggcactttgggaggctgaggagaccagcctgaccaggttagagaaacgtcgtctctactgaaaatacaacattagccaggcgtggtggcgcaggcctgtgatcccagctaatctctacccgggaggcggaggttgcagtgagccgagatcgggccattgcactccagcctgggcaacaagagtgaaactcagtctcaaaaaaaaaacacaagaacaaaaccagagtctgtggtcccagcacagtgtccaagtgctggactgagtggacaaaaagagatgccctcaagtactggctgactcttgggcaagttgccaaatagcagtgtttggttcatattcaggaagttataactgcaagtctatatatctcatagaatagcaggaaaatctgttttcaaagtaaaaatataagcactacaaactttaaaaacaaaaaccttggccaggcgctgaggctcatgcctgtaatcccagtgcttcaggagggtgaggtgggtgaattgcttgaagctgggagttcgagaccagcctggccaacatggtgaaaccctgtctctattaaaaatacaaaaattagctgggcatggtggcacatgcctgtaattccagcatcttgggaggctgaggcatgagaattgcttgagcctgggaggcggagattgcagtgagccaagattaaacagtgcactgcacttcgggctgggtgacagagcaagactctgtctcaaaataagtaattaagtaaataaattaaaaaaatacaaaataaaaacaaaaaccttagtagccagtgataagccatagttgctatgtaatgtgcagttgggattctaaaagtacagtctgaaatatagggtattctttcattttctaggtacggcttacacactgtgtttttgtaagactgcttttgtgaactgtagcttatttagtaaaatgtacccatggctgtcacagttattgggagatgcctgtaattataggtgagcttagttggtcatatactttctaggatatagggaaagcatgatttaatagtaacatcctattaaaaagtagactgtgggcagttgtagtatcagcaacttttttctttgaagttttctaaacttcctgaattctcctatgacgttgatttctagaaaaatgaaatttacaagtacctgtaaagtttaatagtgtgctgttgcagatgttgtgttccagctctctgctttgattttctgttggtaggccagaagcggactcctagaagaggggagcagcaaggatggaatgacagccgtgggccggaggggatgctcgaaagagctgagcggagatcctacagggaataccgaccctatgagacagagaggcaggcagacttcacagctgagaagtttccagatgaaaagtatgtgctgcagtcctcagcagggcgggtggggaaccagaaaggttttgagaaaatgctactttctttttcttttctttctttcttttttttttttttttgagacagtttcgctcttgtcgcccaggctggagtgcaatggtgcgatctcggctcactgcaacctccgctcccgggttcaagcaattctcctgcctcagcctcccaagtagctgggattacaggcatgtgccaccacgcccggctaattttgtatttttagtagagacggggtttctccatgttggtcaggctagtcttgaactcccaacctcaggtgatccacctgccttggcctgccaaaagtgctgggattacaggagtgagccaccatgcccggcccagaaaatacaactttctactggctactgctttttgtggtaccagtcctaggaatgttttactaatttatgtgcaattcatgttaccttagatgatgggaaggatcttcctttttcctcatagatgcctttacgtcttggttcaggaaatgattgtacaattaaaaatgaattgcttgttggtaactgaagagcactcttaaaaagaaattacacaggagtgtgttgaactggttttcttttgaagttctagattagagatataattttggactagggatataattatggtttttgatttcacattaccaatttagactgctcaatggattgaaataaattcctagctccacggtcaggtcagtaggctgccatgatgaaatttgaagaagagtctgttatgatgtgtaataccaatttctggagggcatggctgctctccgaagtactctaacatggacagaagtcgtgggctggtggagtgttgcgtcgctgcttagtgatgtggcagcatggtggccaccgcactccacctcaacacggggaggggttgtgtcttatgtttggcacttgctgcttaaagtctttgtttaatcattaaacctgtttatgttaaacagaaacaagtagtgaatcacatttcaaggaaaataaagttaaacaagctaaggaagactagaatagtgaacagttatatgtcaagggagccatttttccaaactctttctgcttcttgactgctaattccattccatttaggattctggctacaagttttaaccaaaaaatgtggctttgtaaaactatactatagagcctattaaaaacaaaacaaaacaaaagtccagcagagagtaacttagcctgggtgggctgagcaggtgatgactcatgcagaactgttcacctggaagttacacattcaagacattgagatagtctatctgcaaccatgttggagggagaaacttacagaaagccttaattttgcaccttttttggtgattacttcaaatctgctgtgtagtaagcacagtctccttgtttctgcaaagcttcttgtagcagagctgcttatttttggaagcatttgggtatttattttcccctcactttagggattctgtggaaatgaggaaattatagttcacttgcacaaacccatgtttccccccttttttagtagcaagactgtgtagtctttaaaaaggataaaatagatctttatatgtgacatgaaaaaatagctattaagtgaaataatacatatatggaagagtaaggtgggatatggaattatggaggggttttttaatttaaataaggtcagaattacagaaaagttttaagaattatacgaagaatttccatctgcccttcgagaccccccacatactaactgtttaccacatttgctttatcattcatcccccaccacaccacacagcctttctttgttatttgagaataaggtgtaggaatgtccccttactcctaaatactttaaatgcatttcctaaaaacatgatacaattttcaaagtcattaaaatgaatacaatactgttacctaattctctaaattacggagtctacagactttactcagatttcaccaattgtcccagtgatgtcttttcacaaaagagaaaacatttctgcttcaggatccactccaggcaaatgcattgtatttagtcatctttaattaggaacagctccttagccttcctttgtccttatgaatttgacatgttgtagagtatgagccagttattttataacatgtcccagattttgagtttttctgatgtttcctcgtggaatgaggttacgcacttttggcaggaatgccacagaagtaatgtgttctcagcgcatcgcagtacagatatgtaggggattttcactttcagggaaatctgaatcttgatatcagaaaacattttcttagtttcttaaaaaataccctcaataaataatactcttaactaataataaaaacactcttaataaataaaacatataaagttttatttgtgacaaactcacaagcaaaaggaaggaaaataacatttgagccaagcatcctgctttatagacttgtgattcactgtcttacaacagtcctagcaagtagacatgatgcctgtttcacaagtgggaagcctgaagcccatgaaagtatgaatgaggagttcagtgtggataccaagtttcagtttgaaaacataaaaagttctggagaagaatggtgatgatagttgcacaacagtgtgaatgtacttaatgccacagaactgaacactgaaaaatgattaaaatggtaaatgttatggtatgtatattttaccacaatttgcttaaagcttgttaataatggggggagggtaaacatctgagggattttttttttcagaacaggaattgattttaaatgaccagtaaactacagaaaggaagagccaaaattcatctagacagaggcagactaatctcctaatagtctgttctaagagttcagttaagtttatttggagcctaaggaaaaattcctactgcattaaaaacagtagtttactcccagaatatgtgcaccacatgatatagcagatctcgggggcggagacatgcccgttaatcccagcgccgtttatgacattgcttccgtgggaaaacacgttctctgcctgggtagaatagaaatccatggcagctggctgtgacaagactactacacacattgctgaaactctgggtctgttttctcattgaaaaatggagagggctgaatttagataatctttcgagattataaagattctataattctgtccaataaacatgtataggtattaaagaaactcaaggtgacaccctttttcactatcagatgagcaaagatcaaattttatcatattcaagcttggggaaagtgctataagaaatgctcttggcggcacagtggctcatgcctgtaatcccagcactttggggaggctgaggcaggcagatcacctgaggtcaggagttcaagaccagcctggccaacatagtgaatccccgccttattaaaaattcaaaaattagtggggtgcgcctgtaatcccagctactcgggaggctgaggcaggagaatcgcttgaacccaggaggaagaggttgcagtgagccgagatcatgccactgcaatctatcctgtgtgacatagtgagattctgtctcaaaaaaaaaaaaaaagaatttgtaggttgggcacagtggctctcacctgaaatcccaacactttgggaggcagaggcaggcagatcacctgagctcaggaattcgattccagcctggccaacgtggtgaaaccacatctctactaaaaatacaaaattagccggatgtggtggcacacgcctgtgatcccagctagtctggaggctgaggcaggataatcgcttgaacctgggaagtggaggttgcagtgagccaagattgtgccacgtcactccagcctgtgtgacagatgagactctgtctctaaaaaaaaaaaaaattgccaggcgtggtggtgcacagctgtgatctcaaccactgaggaggctgaggcatgagaatcacttgatctgggagtcagaggctgcagtgagctgagattgcaccacttcactccagcctgggagacagaacgagactctgtctcaaaaaaaaaaaaaagagagagagtttactgttggctgggcacagtggcttatacccgtagtcctagcactttgggaggcctaggtaggcggatctcttgagcccagtaatttgagaccaacctgggcgacatggtgaaacccgcatctctacaaagggtagttagccgagtgtggtggcacatgcctgtagtctcagctgcttgggggactgacatgggaagattgtttgagcctgggagatcaaggctgcagtgagcagtgattgggccattgcactccagcttgggcaacagagtgagatactgtctgaaaaaaaaaattactgttacttttcttttgttttagaactgtactttagatttctttttttgctctgtttcccaggctggagtgcagtggcaggatctcggctcactgcactcctgggctcaagtaatcctcccacttcagcctcctgagtagctgagattaccaggcatgcaccactatgcctggctaatttttatattttttagtagagatggggttttgccatgttgcccaagctagtctcgaactcctgggcccaagcgatccaactgcgttggcctcccaaagttctgggattgcaggagtgagccaccactcctagcctgctttagtttttttatttttatttttaagacaaggtctcgctttgttgcccgggctggagtgcagtggtgccatctcggctcactgcaacctctgcctcctgggttcaagcgattctcctgctgcagtcccccaagtagctgagattacaggcgtccgccacaacggccggctaatttttgtatttttagtagagatggggtctcaccatattggccaggctggtctcaaactcctcacctcaagtgatctgcccgtctcggcttcccaaagtgctgggattacaggcgtgagccaccgagcccagcctgctttagatatttgctatagtttaggatcaggttttgctttagatatttgctatagtttagaatcaggttttggttacaggaggtgggagacagaaaagccaacttggagaatttatttaagttgtgtttcttataagagactggcatgacgttaatgatcagtacttctgtatttctttattttttgagtaaggaagattgcgagttttgtatacttttacccactattgtatagcggtttcttaatgtaacacttttagccataaaagtagattgtaacatacctctactgctggtgtttgagctactaatgccactaggtttcttgatgccaggacctccattaaataagtaatttcttgtgattttaaatgtttttaaaagcctttccaaattagaaaacatttattaaactattgttacaatggtgaaaaagagcttagagcttagtgaaggagagacaagtcctcagaaagagtgctggtgcccagcgacggtgcagggaggagtgggtgggcaatcaggtcctgggtccaggctctgatgtggcagaggaagaagagggaggagtggcttgggctctcgctcgtattgtgagttgggaatcacaggaggaataagggctccgcgttgggcatgtgtgtgcctgacttggggatgtccgggtggagatgtctaggaagtaactggcttcatgtcctgcaatcagatgagagacacagggccagttagcattagcatggggggccaggcggatgtggcatgagccgagatcctgccactgcactccagcctgggcaacagagcaaggctctgcctcaaaaaaagaaatctaaagtaaggttctaataaaagaaaagtgagagtgcccacaaggataaggacagatgggtatccgtatagagcaccaagacaagtggttaggcacgagaggcagacggagaacttttcccttctgtgaatcttgaattggctgcctctgagaagtggaattgcgtggctgaggaacaatgtgagttttgtaccatgtttgggtattatctattccaaaaataattttctaagggcaggcagaaaaagagaagccagaaagtcaggaagattggtggccaggagtgtcatatgacactggggtcaaatgacatgaagacaaaagttgctattgggcttaaagaggtcttcagctgcccttggccgtttatgtggagtaatgaggtggaaggcaggttaaggttttcacagttccaaatgttaccggctggttgtgtgtttaggagggagatttggaaaggggcataatttgaagtttaaccatttttcttacacaaaacattccaaatttaacttaaagatttggtattagaacaggaatgaacgttagaatttatttatcaacattctcattttttgagtaaggaaactagatccagagagagaaaggaatgccccattcagattagtactatgcctgtctagcacctgcttctcctggactggccccaccacttagcctactctctgcttccgtttcctcatctataggcaataattgtatattaaagatttgtttgtgagaatccagttactatatgtaaagtgctcagaacaatgccaggtatatagtctatagtatgcgctcactaaaggttaactattaatttgtgattcaagccaccattctttccagtatactataaccatgattttcttttagaatttttttctggagagaccttagacctttaatttaccagtttttattatatccactccttcctagaccaggtgataggtttgatcgagacagaccgttgagaggacgtggaggcccgagagggggtatgcgcggcagaggcagaggtggccctgggaacagagtttttgacgcttttgaccagagaggaaagcgagaatttgaaagatatggtgggaatgacaaaatgtaagtttctttgtaaatgctattttcactttaagatggtgtcagcacgtggtatgaatctattatgtgttaatatttagttaactttatagtactgtgctgttattcttgtgagaagctgatcctgggacttttatgaaccactctttctgatttggagattgactggagactagcttctggtttaagggactattctttctttccgtagagcagtcagaactgaagacaacatgggtggatgtggagttcgaacctggggatcgggtaaagataccaggtacggtgtaagtgtgtgccctctgagaacctgcaattaagtggaaatctctggatctttgcttttcttgaaaatgatgtcttctgtattgtgctttatacttgtgtgcccctaagtagagattgattttaggcttttgtttcgtgagataagtttttaaaacaggtttgctatgttgcagttagatttaaactgcttttaaaattctattactttagccaaacaaatttgtgacagatgaccatgtatttgctgatgcctcaaacatatggcactgtacatttgcacatgcctcaaaatgctttttgttggctgcacacggtgactcacgcctgtaatcccagtactttggaagccaaggtggacggatcacttgaggtcgggagtttgagaccagcctgtccaacatggtgaaaccccgtttctactaaaaatacaaaacctagcagagcatggtggcaggcacctgtagtcccagctacccaggaggctgaggcagaagaattgcttgaacctgggaggcagaggttgcagtgagccgagatggcaccactgctctccagcccgagtgacagagcgagacacagcatctcaaaaaaacaaaaaaaagctttttgttttgttcattattttttaaaatggtgacaagatctcactatgttgcccacactggtcttgaactcctgggctcaggcagtcctcttgcctcagcctcccaaagtgctaggattacaggcatgagctaccacatctggcctaaaatgctttttaaattcctggatattctatatgtttttacctttcaaagttcatgtggatccttgacacatcttcatttcataaaatcatttgtagattgaagcttagtgacaggtttcacctgaggctcaagttggacatttctctgaggcttcatggtgccttagatctgtgccaattcttctgctagttagagtggatacatggttctgctctgttttatttcacagctggagggatgatgccttcctggtgtctgcagaagaagaggtagggcatgctgcaggcagtgcagtgtgagcagtgctacagggcaggcttcccgctagtgcagaggcttgaggggatccaggcttccacttttcttcttttgaagaatataagcttttttttttttttttttgagacggagtcttgctctgtcacccaggctggagtgcaatggcgcgatctcggctcactgcaacctccgctgcccaggttcaagtgattctcctgcctcagcctcccaggtaggtgggactacaggtgcacgccaccatgcctggctaatttttgtatttttagtaaagacggggtttcaccacattggtcaggctggtctcgaactcctgacctcaggtaatccacctgccttggcctcccaaagtgctgggattacaggcatgagccactgtgcctggccagaatataagctttttacatgaacttatttttcttaaattgttgtccttaaagacaaatgtacaaactaatatcaaatgtaacagcgttagatttactaccattgctcatttgtgttctccttgaaaagaagagaaacttgttgaatgtttctctatctggggttccataggatcttgatgacagatcttttaattttgttttattttactttgataatatattttaaaaagtaatataggcactttctttccttctttctttctttctctttctctttttctttttctttctttctttttttccttttttttttttttttgagacggagtctcactctgtcacccaggctggagtgcagtggtgcgatctcagctcactgcaacttccacctcccaggttcaagcaattctcttgccttagctttccgaatagctgggattacaggtgcccgccaccacgcctggttaatttttgtgtttttagtagagatggtgtttcaccatgttggccaggctggtctcgaactcctgacctcaggtgatccacctgccttggcctcccaaagcgctgggattacaggcgtgagctaccgtgcccagcttgggcaccttctttcttcatcatctgatttaccaccttatctaatactaccacttcatttcagtttgcctttgaacttaaaatcattttggctctaagtggttacttatcctagagggccagccttggccttgtaatgttaagaggtgaccacttgtggccctggcaggctggcatgtctcagtgttaaaatgacgtgtgccccatggcactcattttggattggtttgtgagttataaagtcaaagctcttttttttttcctctctctgtctctaagacagggtctgactctgttgcccatgctggagtatggtggctcaatcttggcttaccataaccttgaaaccccgggctcagttgatccttccacctcagcttcccgagcagctaggactacaggcgcatgccaccacacccactacacccagcatttttttttttttttttctgagacagagtctcactctgttgcccaggctggagtgcagtggcatgatctctgctcactgcaacctctccctcccaggttcaagcgattctcctgcctcagcttcccccgcagctgggactacaggcgcatgcaaccacgcccagctaatgttttttgtatatttagtagagatgggttttcaccctgttagccaggatggtctcaatctcctgacctcatgatccgctcacctcagcctcccaaagtgctgggattatagacgtgagccaccgtgcccggccttttttgtatttttagtagagatgcaggtctgccatgtttcccaggctggtgtcaaacttctgggctcaagcaattcacctgccttggctcccaaagagctaagactgcaggcgtgagccaccacactcagctagtcaaagctcttaggtggttataatttgtaatggaaagcttttcttagaataagactaatttcttaattaataaatagagataaattttatgtatgtatacatatacttcatacatttctttataaagtgagtaagaaatttatttcttagtaaatcggcttgaggtcatgaaaatgatgtatgcgaaggagttatgtgctacttttgattagtgagaagaaagtggaggtgagcctaacacagtaagtaatgtgtttgtggctggcaaagcccaagtgcttcccagtgtattaaaggtgtaagggctttgctgtagtcgagtattcctatttgaagacgctgacagcaataactggatttaaggacaaagtgccttcaaactggtatgactgagccatttcagtaatactgcttttcttcaacagtttgacagcggtaaaatagaattttttctatttatctgtgctgaaatagaatttttccatctgcaataatttaaaaagtgtatcagatattattttcttgttaaaattggagtagacacccatgaacgcagttttcaataatgctgcctttcaacttttattgtgaagagcaagacagttttatttgttctcaaagcaaaatttgatgaaaatctgttgttgtcagagatttgattaagtttgaggtctgattaaatttgaactaggtaacaaagccttgaagtgtgtaacatcattttatggaacatatgtgcacaaataggcattttctgcactagtacaaatgaagtcaaaatatagacatgggccctggggttatatctttcttctgataaatccaacattggtgatttacctttttttctttttttttgagacagagtctccaggctggagtgcagtggcatgatctcggctcactgcaacctccgcctcccgggttcaagtgattctcctgcctcagcctcccaagtagctgggactacaggcacccgccaccacgcccacctaatttttgtatttttggtagagacggtgtttcaccatgttggccagggtggtctcaatctcctgacctcgtgatccttctgcctcggcctcccaaagtgctgagattacaggtgtgagccaccgcgcccggatgatttactttcaacaaaatagcagaacctgccaaattaattgctgctaattttgaaacttaattgtctttcagttttgatcatacagttctatgatagctgtaggcacaatattttatattcatttataaaataggtcaacataggaggacatctatgatttttcttttctgtaaaatcagctaattgctgaagtttaagaaatactcagttttttgtggttcatgcctataatcctagcacttaggaaggctgaggcagatggattatttgagcccaggagttcaagaccagcctgaggaacaaagtgaaatcccatctctacaaaaaatacaaaatattagccgggcatggtggtgtgcgcctgtagtcccagctactccagaggctgaggtgggaagttctcttgagcccgggaggtcgagactacagtgagctgtgatggcgccaccgcactccaaccaccatgcccagctaatttttgtatttttagtagagacagggtttcaccatgttggccaggctggtctcaaactcctggcctcaagtgatccaccctccttggcctcccaaaatgctaggatcacaggcgtgagccaccctgccggcctggaaccttcattttaaaaaacaaaagttaattattcaagttttgttttaaaaagagtgagtttttaaagaattgatttcagtaggttggagttgagaatttaatacttatttaaattgaaaaagtcttttctgttattgtagttcaatttgtggttacttttaaaaaaaaacttactttaaagccctcaataggccaggcacagcagctcgtaactgtaaccccagcactttgggaagtcgaggtgggaggtcaggagttcgaaaccagcctgaccaacatggtgaaaccctgtctctaccaaaaatacaaaaaaaattagctgggcgtggtggtggacgcctgtaatcccagttactcaggaggctgagggaggagaatcacttaaacctgggagggaggttgcactgatccgagattgcaccactgcactccagcctgggcgacagagtgagactcagtctcaaaaaaaaaaaaaaaacccaaaaaaccaaaaaaacaatgttttctccttcttaaacatacaaaggcattggtatgaatgtatttgtgtgactagagagggtcttgctgtttttcagtgatgtggagccaactgcaccgatggaggaacccacagtggtggaggagtcccagggcaccccggaagaggagtctccagccaagtagggcattttgttcattccccattgtggtgttggttctcttcttaatgatttcttttttttttttgagatggaacttgctttgtcacccaggctggagtgcaatggcacaatcttggctcactgcaacctccacttcctgggttcaagcgattctcctgtctcagtctcctgagtagttgggacaataggcgtgcgccaccacgcccagctaatttttgcatttttagtagagatggcatttcaccatgtcggccaggctggtctcgaactcctgacctcaagtgatccatccgcttcagcctcccaaagtgctgggattacaggtgagccaccgcacctggcctttcttgatgatttctaagagctcttcacagactgggaatctcaaccccttatcctatcacagagggctgaccttaatgtatgaatgactggtgatcaaactaattaataattagttcagacaacctaatgaatatcaatgataattaatgggtgaaagttgggcattctgtcctctgctcacaagctcttttccagcagcttgttaaattccttgacttggagtagcctgactcttgtatggacctctagtgtcttgtcccctctgtgctctcccagtcctccctccctctcttttcattatgtagcttagataccggctccgtctccagcacccttccaagttctgtttttctggggttttttttgagacagagtttcactcttattgcccaggctggagtgcaatggcgcgatcttggctcactgcaacctccacctcccagattcaagcaattctcctcctcagcctcctgagtagctgggattacaggcatgtgctaccatgcccggctaattttgtatttttagtagagacggggtttctccatgttgatcaggctggtcttgaactcccaacctcaggtgatccgcccatctcagcctcccaaagtgctgggattacaggcatgagccactgtgcctggcctccaagttcttaaatacccatgcgccttcaactctctggccctttggacctgctgctgtaacttgctagcaaaacccctcctgggtgactccactatctgccttctctctgcctgttcccacaagctgagcactacaagtcacatcgtgggcctggttggaaccccagtaaattcccggtcactgatattctgaaaccaggccttggcgatccccggttcttgggttcactctttctctcaccttctctaatgactgttttaatttctcctcaaaaccctgacactgcctcccactgtacccttccgccatcgtcctctttcattttctggatgcaacatttccttctatatcacagagtaattatgatccattaggtggcaacttcatcatcctcccactgccaaagatacaagactgctacacctgcacgcctcctgggctccttccctcgtgctaaccatcgggctgccatcccccccgacctcttcacgcttcagatctttcctactgacttcatgaaaacttcatactgttagttagctccttccttttttggtatattcatctccttcctcccaaccctagtcttccagtcagcatttaaacatgctcagtctctcctgcgtaagtgtcctctggaccccacattctccgtcagctgcctctttcagagttgcatgtggccttcttcacttcctcccctccacttattcctccctttagtccaggcctggcttctgtcctcactgtccttctgaaacagtcaccatgtctccagatctaatggatgctgcagtctgcgtctttcttgacctctcagaagcatttgactttattgatttcttcgtaaacgtgctctcctgttggtttctgtgatcactctgctcttcttttccttctgcctctcagcatctcctttgcaggctcatccttgtctttcgggtcttttaaaatgttaagttcttcagggccctgccttaggccttctctttctgtagagtttctttataggatcttatgcacttctgtgacttaaattgtcgtttacacactaactctggaatatgtatctctggctcttaacttcaatgtgggctccaggcctgtggctccatctgcctactggacactttccctgggacatcccagatgctcctgtgcccagcctgaccgagactgagctgactcctccccacacctctggtcctcactcagtgtttccatccaactgtacaaaccagaaacctacgagtcatccttggaacttctgtcttcttgaccctcctctttccaaaacccagtccttccctctgctctggtgattgtacccctaaataccgagcatcaccactcaccagcgtcgtctaagccattgttatctggaccaccactggagcccctcacagggctccctgcatcctcacctacgccaaggtggtgttcacaccgcattctgattgtcatgcccccaccccttgcttaagaccctccaatgtcttcctgtcctttttctgtcccctgttctgacctgcagagtcctgtgtggtctggcccctgcaaaaccctcaagttcagacattcctgtgccttctctgggttcaccatgaggcctttatttcatgttctcaaatgtacttttatcccacccctgccctcacacttgccatacagctttcacaagtgttgtttctttgttttcccaaaccccctttactcttcgcctatctgtctcttactcatccttcagctgccaaaaggcagggtgtctagtggttaagagcacagacattgaaccagtgtgatgagttgaaatcccagctctgccacttactagttgggcaagttatttaatttctttttcagtggctcagttttcttcatctgtaaaatgggaataataacgtacctacattatagggttcttgtaaagattttgtgtgtgtgcgtgcgtttatatctgtgtcctagagtggtgcctggcatgtagctagtgctttatcagtatctgctcttattattgttacttacttcaagagtgaaaggccacagtgattgatgattgtgaaagctgtattcaaaacaattgcaatgtattattcaaaacaagaaatgtgtttcattaaataaataggagtaacagttaatatgaatatttagacagtgagctaactaaggaactagattaacagtttatatgaatgttgagaaagttaactggataccttcaggagaacattatatcctttttgagccaataaacatttatacaaattcaggtaatataaggcagaataatagagagtaaattatagtattgttctaatctatagaattgattgagatactctagtattcataatattagacaaaaatatttagtcactgtgaaagaaaataaagcttgttgactgtctgtctgcagtatcccaggagagctagctggaaaatctttctctctcttttctgctgacctggggggaaagtgagcatctatttggaattgcaagtgcaatgcaggtattgagtgaccgtgccgagagattcttttttctgcactgccttgtcaaattttaacattattactaaaatttctaataatacaattataattttttgatactctaaaagttgggctggtatccgagaaatacattgagtgatagcgatgctctctggtgtcagccctgtttgaatgttgattttgcactctggcttctggcatttagcctgaatgtacattcagtgtacctctcagttctagaatgtcttgatagatgaatctaatgtactctcacttatgttcaaacacacaacccaaagtgcacttccattttcctcaaataggacatattttactgataattatatgtgcaatgcccttccatccttccatcttctcctttcattacagaagtattaactgttccttgttgcatagtgttctagtgtccgacgatacctgtgacgactctttgtattttgttttaagaataactctaacattggccaggcgcggtggctcacacctgtaatcccagcactttgggaggccgaggtgggtggatcacaaggtcaggagatcaagaccatcttggctaacacggtgaaacccagtctctactgaaaatacaaaaaattagctgggtatggtagcgggcacctgtagtcccagctattcaggaggctgaggcaggagaatggtgtgaacccaggaggtggagcttgcagtgagccgagatcgtgccactgcactccagcctgggtgacagagcgagactccgtctcaacaacaacaacaacaaaaaaaaaaaaaaaaagaagaaaaagaataacatttttagagcatttgctgtatgccaagaactgctgtaaatgctaccatgtcttaattcattcagttctttgccactccatgaaggaggagctactgctattctcacactgggacagaggttcaatacctgcctaaggtcacctggctcatgtgcagagccggaatttgaaccaggcagatgcataggcattcatactcctctagtgagtggtaggaatagcaaaaagtgctgttcagaacacctgctggtaactcaggagagggcaaaagatgttggccctggaaggtaagagctgccaggatctctgagcgtttccctactcaggaatatggagcatcaactcccatccttcctgaaaaatactttattaaaagaaactgtgagcaaacagtaatacaaactatctgcaataaattatttttattgtaatcggtttcctagtgtatttgcttaaacaatgaagattttcttatgttttaggttaaattcatttgtcccagttaaatatccgattagtaaagctttatttctggaacctactttctttgattcactgcactctttcatatattcaggtgaaaaggtattgcatgaatggaaatgtggacatttgaattgatgttttgtatctttcttctgcgcatatcatgactgttttccatctaggtatttttctgtgcccccttattccctgaatctcagtggagcacagaggttgagtgtgggctttggaaacgcaatgacaggattggaacttgcctcttctatttatttgctcactatgtgacctctctctgcctcgatattcttatctgtaaaatgggatattaattatatctaactattgatatcatgaaataatataaagcattttgaacagcatctggcacatggtaagcatacagtgttagctagtctcatccatttctaaataaagggaactgtggttaaagcagtatgatttctataatttcacgtttagaaacaaatatataactatcaaatttgtatatagcattattcacattaccatagatttgaccaccttatatccataagtcattttgatggaaaattccctcccaaaagttttttataacaaaccaagaattgtgaaggtctttgaattactcaaaaatgggggtgttaaagcaatagcagttatgaggctctcagttgttagaaatatacttgcatgagtccttcctagaatcgaaggatacatctcttcctgttgaatatttagtcattgctaaaactgccggtaaaactgtactcagaaccaatcaaatgggaaatggggtatgcgtcacaggattgtcatagtgtgtgtttgctaataacttttagtgggtagggaataaggttaaggagcctgtccttggtgatactatgctgctttcaacgtggcttgttgaaactgcagctgataagcagggcattcgtgcctctgatatggggcatttgtgcctctattcttgaatgaggtgcattccagtcaacagcttcaagctgatactgctgaaggaggctgtaacttgtaactaatctgaattacactatatgctttactttatgtgtctatacacagtttcaagcttgcatttcatatataccttgtccttttttgatctagttctttgtttagatatgatgtcctttaagcaaacaaacaaactctgttaataacaactacttctgtggccttaatgtaaaatctattctttctagaattgaattttctggaatttataaacttgtattaggtcgtcttaagtatgaaagaattaccaaatttatagcattcagttctgttgatttttaaaattctgtcacaagtaggctaaagaagatttatgattccttaatatttctttatttttagctgtgtattaaaattttatattatggaaaattatacaaattaagtagtataaagaacttgtaagtaagttgttcagcttaaagctgttaccaaatcacggccactcctgtttcatgcatatttctaccaacttctgcctcccccagggtatcatataccactcataaatgtttcacagtgttatacctgctactcttttttaataacataactggaataccattactccattaaattttttttaatatacttgatatcattaattccaagacacttcttcagtttccctgattgtcttcaaaactttttaaaaagataatttatttgtttgaaataatattgaaatatacatgtcaattggttagtctcatgtctgtttttaaaacagctttgagatataattcacatccaataaatggcacatatttagcatgtacagttttacaagctttgatatatttgtacacttgtgaaactatcaccatgagcaaaatcatgagcatagccatcgccccacaaagtttcctggcgttcctttgtaggccctctctcttgccccatttccccccggcagccaatgatctactttctgtcactacagattagtttgcagttgctataattttatatgaatggaatcatgcagcttgtattcttctttggtctgtgttctttctccgagcatacttactgtgtgatttgtatctgttcattccttttcattgcagagtagtagtctgttatacaggtggaccaccatttatctgtttacctggtggtgatcactgggtggtttccagtttttgctataaagctgctatgaacattttttttttctttgagacagagtctcactctgtcacccaggctggcgtgcagtggtgcaatctcggctcactgcaacctccgcctcccaggttcaagcgattctcttgcctcagcctcccgagtagctgggattacaggcgcccgccactacacccagctaatttttgtatttttagtagagacggggtttcaccatgttggccaggctggtctcgaactcctgaccttgtgattcgccctcctcggcctcccaaagtgctgggattacaggcgtgagccaccgtgcccgtcctgaacattttaatatacaagtgtttatatggatatacactttcatttctcctgggtaaatacctaggagtggaatggttggaccaaatggtatgcgtatatttcactttgtaagaagctgctgaactcttttccaacatccttgctagaacttgctatggtcagtttttataactttcagtcattttaataggtacatatctcattatgggtttttgttgtcatcgtttttttttttttctttttttagagacaagatcttgctctgtcacccaggctagagtacagtggtgtgatcatagcttactgtaacttcgaactcctggtctcaaatgatcctcccacctcagcctcctgatgtccagcttattttttactttttgtagagatggggtctcgttttggtacccaggctggtctccaactcttggcctcaagtgctgcctcggcctcctggagtgctgaaattacagatgtgggccaccgtgtctagcttcattgtggttttaatttgcatttccctaatgactaataatgttgagcattttttgtgtggtatttcccatctgtattctttagtaaagctgctttgataaagaaccactgccaccagggacttgattgtttccagggcatttgggtggacagagatgggaaatacacacatacacattataagataaaatatgagttcattcaatatttccaattcgaagttaagatatgggatttttacctagactgcttgtttctccttttcttacatactgaaaattctagttctgagtaacattgtgcttttaatcatttgttgcacataaaacagtcacagcattaccaacattaccttcagtaacacagttactgaaaagttatgtcgaggagggagatgagtaatcaaatttgtatttcaaaatcatttgaaatagttctcttgatggttatatcaccagtttcataaacatttaggttactttgattcattttactttcaaattttagagattgaattttaatttaaatctgttttataattatgtaaaatatttacatgtttccaaagttcagtctgaaaaacatgattttttttttttctttttgagatggagtttcactcttgccgagcctggagtgcagtgatgcaatctcagttcactgcaacctccgcctcccgggttcaaagcgattctcctgcctcagcctcccgagtagctgggattacaggtgcctgccaccatgcccagctaatttttgtatttttaggagagacgggatttcaccatgttggccaggcctgtgtcgatctcctgacctcaggtgatcaactggccttggcctcccaaagtgctgggtttacagacaggagccaccgtgcccagccaaaacatggtattttcaaatagcttttatccctattgttttcctggcttatattccaatttaaaaaaaatgctggccgggtgcggtggctcatgcctgtaatcccagcactgtgggaggccaaagtgggtggattgcttgagcctaggagtttgagaccagcctaggcaacaagtgagaccctcccccacccagtctctacaaaaaatacaaaaattagctgggtatggtggtgcatgcctgtagtcccagctactctggaggctgaagtgagaggatcccttgagcccaggaggtggaggttgcagtgagcagagatcataccaccgcactccagcctgggtgacagagtgagaccctgtctcaaaacaaaacaaaacaaaaaaactatctatctctatcggtgctatgcatatatatttgtgtggctctccaaggtactgtacacccctccttgcttttttctcattcactctggaaggtgctccatagcagtatatacagatagtcctcattccttttttagctgctatactatagttttttcaccaagttcttttctagataggtttgggttatttccattaatttgctgttccaatgtcttagtatcttttaatatttttgccaatatatatttgagatctatattttgatattggtatttttccagcattttattgtgaaaatttcaaaacacagcaaagtttaaagaattttatagcgaacatctatacttaccactacctaaatgctaccatttatatcttatatattcattttacataagtattcattagtccatgttttttgacacatttcataataaattgtagacatctgtacacttccccctaaatagttcaacatgcatatcactaaatagaattaatatttgtttacaattttttcttctgatataaaatgtatatactatgaaatgtataaatcttaagtgtacattcactgttttgacaaatgcatgtacttgtggaatccaaactcctgtcgaatacagaacattaccaatcacgccagaaagttctttcatattccttcatgttatctttgctttgatgttttttctaccatcagcttggtattgtagagtcactgcaaatttgtctattttggatgctctgtggttaggtttctctactgattttgcttatatttttcataacattgatctgtgtatttctataatagaaccttaaattacatcagctcttcagtgaagatacagatttgattccccactccccacctactgttttgttttgttttgttttggagaaagagtcttgttctgtcgcccaggctggagtgcagtggtgccatcttggctcactgcaacctccgcctcccgggttcaagcaattctcctgcttcagcctcccgagtagctgggattacagggattacaggcgtgtgccaccacacccagctaatttttgtatttttagtagagacggggtttcaccatgttggtcaggctggtcttgaacacctgacctcatgatccacctgcctcggcctcccaaagtgctgggattataggtgtgagccaccgcgcccggcctgttttttccccttaaacacttttgagatataattctcgtactatagcactcaaatctctaagtatataggccaggtgtggtggttcagatctgtaatcccaacactttgggaggcagaggcaggaggatagcttgaggccaggagttcaagaccagcatgggctacatggagagaccccgtctctacaaaatggttgtaaaaattagctgggcctgatggctcgtacctgtagtcccagctactctcaggaagctgaggtgggaggatccttgggctcaggaggttgaaggtatggtgagccatcatcatgccactgtactccagcctggccaacagagtgaaacccagcctgtatcaaacaaataaatgagtaaacgactgaatgcatggatggatggtttggggtatgttacattattaattttttaaaattgcagtaaaaataacataaaaattgccatttttaccattttaatatatataatttaatggcatcagtaacattcatattgtgtgtaaccatcaccaccatccatctctagaactttttttttttttttgagatggaatctcactctgttgtccaggctggagtgcagtggtgcgatctcggctcactgcaacctccacctcccgggttcaagcgattctcctgcctcagcctcctgagtagctgggactacaggcacattccactacacccggctaatttttctggtattttttagtagagacggggtttcaccgtattggccaggctggtctcgaactcctgacctcatgatccgcctgcctcagcctcccaaagtgctaggattacaggcttgagccactgtgcctggccttgtagaactttttcatcacaaacagaaactctatatccatttaacactaactccccatttctcctcagcatgtagtaatctctattttactcgtgtttatgaatttgcctattctaggtgcctcatctaagtggaatcgttcaatgttccttttgcacctggcttattttaactattagcatcaagttttcagcttcattcatgttgtagcatgtgccagtcttcatttctgtttttctttttttgtgtgtatttttgtgatgattttcaaatctacgattttaatccttttaaagtgtacaattcagtggcatttagtacattcagagtgttatgcaaccatcaccatgatctggctccagaaggttgttatcatcccaaaaggaaaccccatgcccattcagcagtcactccctatcctccctccctgcagccctggccaccactgacctgcctcctgtctgtgtgaatctggctcctctgaatatttcatgtaaatggaatcatacacagaagtcttttctgcctggtttatttcacttgcatcattttttcaaggtttgttcatgtcgtaatgtgtattaatactttgtttctttttattgccagataatattccaaaaaatgtgccatatttggtttatccactcattagttaatagacatttaggttgtgtccactttttggctattatgaatagcactgcagtgaacacttgggtttaagttttcatgtggatgtgtgttttcatttctcttgggtataaacccaggagtgaaatttccgggtcagaggctaactcagcttagatttttgaggaaccgccagactgctttccaaagaggctacaccatttcacattcccactggcagtgtatgtgggttccagtttctccacatcctccccaacgcttgtcaaatgtcgttttggttctaaccatcccactgggtgtggactggtgcagctctgtggttttgacttgtctttctctaatagctaatgatgtgcaacatcttactgcctatttgtatatcttctctggaaaaatgttcactcagatccttgccttttttggggggagggtggtcatttgtctcaactaaagaggacttgtatctagaattcataaagcattcttttttttttttttaaagagacagtgtctcattctgttgcccaaggtggaacacagtggccattcacacgtgtgatcatagctcactgcagcctcagatgcctggcctcaagcgatcctcccacctcagccccctgagtagctaggactatcggcatgagccaccacgcttggctgttcataaagaattctttatgtattctagatacaagtcccttgtgagatatattatttgtaaatattttatcccattttgtggactgtctttttactttcttgatggtgtcctttgtagtataaaagtatctgatgatgttcaatgtatgtacttttgttgcttgtttttttggtgtcatgtggaagaaaccattgcccagtccagggttaagaaagtttctgcctaggttttctgctaagagttttatattttagctcttgtatttatggtgtgaggtaggtctaacttcattctttcttttggtgtgtgtggatatccagttgcccaagcaccgtttgttgaaaatacttttcattctccattgaattgtctttggcaccacggttggaaaaaaaaaatcagttgaccgtaaatgtgagggtttatttctggactctgaattctttgctctcaatctatatttctgtcttttgttttctttttaaaactcattaaagaggatatttgcaaaagtatgcattcatgagccactgctttaaaacttgtttatggtttcctgtattttatttcaacccattgtccataattacctcattttgtctgtcatgctgtctggaagggagtgccagtggtgaagtgtgatgttaatgtcatcaggatggtgatgttcccatttttcaaagattgatttgaacacagataggaagtatcttctgttggcagtgatgacataaaatgttgaaaatgaaatatggaagcttgtgagtcaaagatttccttaccttatttgcatttgaaatgcagtaccacaaaaatatgttgaattaatggttataactttttctttataaagtagacattttagtaccatcaaaaagtattctttatgattatatatctctttatagagttcctgagttggaggtagaagaagaaacccaagttcaagagatgactttagatgagtggaaaaatcttcaagaacagaccagaccaaagcctgagtttaacatccggaaaccagaatccactgttccttccaaagccgtggtgattcacaagtcaaaatacagagatgatgtaagcattgcatttcgtatgtagaggtaatctttacttttaccttactggaagtgaaatgtacctttccacttctgtcttgaaaatggaacattagtagttggcagtctttgtttctaatcagagatgatgcatgcctaattttactgtattgttcattaagaaaaggaattgaaacttgaggtattgacagatgcacagagcagttagagtgacagtgcatcttctgctcaccctgggactatgcgggtactgtacacatactgtgtattaactgtatttcatttttctcaagggagagttacagattgtgtcttgtacaattcagagttaatcaaaggagaactacactctgtgtcccctgagtaggttactttcaactctgtttcttgataagagcatttcactgagtagttgatgacttttttttttttttgagatggagtttcgctcttgttgcccaggctggagtgcagtggcgcgatcttggctcaccgcaacctccgcctcccgggttcaagcgattctcgtgcctcagcctcccaagtagctgggattacaggcatgcgccaccaccccggctaattttgtatttttagtagagacggggcttttccatgttggtcaggctggtcttgaactcccgacctcaggtgatccaccagcctcagccttctaaagtgctgggattacaggcgtgagccactgcacctggccgagtagttgatgactttttaaactgtggttgaggttccatgcacttctgacgcctttcccatgttggttcagcagctttgcgccccctgcctaactgcagacgtggcgggagatgagtccccgaacgcttggctgctcggtcaggcactgccacagcggccagcgtgctgcaggggttgctcagggagctcctccgtgttgtgaggccttattgctcacggcttacgtccagctcttctcagaagcttcagttttgcagggagaggtttcggggaaacatctagcagcatatgttgatagggatgccatggggtcatcaagtccccgacttgttactgaacttaaggctaggtccactgaagcattcccattatgggatttagaatctgtatcattccatctacagcttgataccagtcactatttcgaggtgggagtgagcaggtagcaggttcttcctctctgtggggtattagttattgattttcatgtggaatctcaggaatgttatgctattgtagagttgtcatttacactttggttagtttcattttctgagtgagtactttgattaggtgtcatttaagatacagggttcttgggaggccaaggcaggtggatcacctgaggtcaggagttcgagaccagcctagccaacatagtgaaaccctgtctctactaaaaatacaaaaactagccgggcggttggcgggtgcctgtagtcccagctactcgggaggctgaggcaggagaatcgcttgaacccgggaagcagaggttgcagcaagccgagatcacgccattgcactccagcctgggcaacaaagtgagacttcgtctccaaacaaaacaaaaaaaaagatacaggattctctcccatcctcttgttttggtcagtccaagctgtaggaggccttactgagttttgagctgttccacaagaaatggctttttgtagacataggcggccggagctttatttccctggcaatctctgggaggtgttttctaactccattagcaagctgggttggttcttaacctgtccacttcctttgttcttttttgttctaggcattgtaaataaaaatttctctaaaacaaatgtgctgtcaggattgaaatatgcagctgacatgttaggtaaaaatagaagctgctctttcttaatccacaccagatttgtcctcccgggctccagaggtctcccagaatatttgaagcaagtgggttagctgagtcatcaagcctggtctcagtgaagcacacatcttggtccttgttaatcttggaggattgaagattttagctaggaattgttcttaaagcaacacaagccagatcttgggttcatcagtttactttgttctggacacctgaagaggcagaagcactagaatacctagcaaagttcagacctagtaacaacctcgcgtaaggcactgggcggtgaaagcacttgggccagggccagctggagctgcaagtggagcccaagccttagactgtgtccactccctgctccactgccccgaggcccttcctgccccttcctgcagtgggaggcgactcagagcagggaccccagggagaccttaccagcgcttccctgctgagtgccaaacaaggcaagggttgagtattttgcctgttactattttttgtgtgtatctttttacagaatgccagtgctcctggactgtttttcttcacctttttagcattaagcatccaactacctaaagcctctgctttattttaacctgagacctcaaaggggacacaaatgttaaacatgaaggctgtcatgagcatatggcctaaaggtgttgatatgctcgtggaaactttgctccatttcctggttgtaggaatgtttaatgttgtagcactttggagattctcatctgaaatcactgacatatcttcctttctgtaggtttttactttacttaaagtggggtttttgtgtgtgtgtgtgtgtgatacccattattatgagttgaagccaaatcaaatttggatcagatttaattaatttatttaatatagctgtcacaagagatagaattttaatgaaagcagttcttaaaaagcagcttgacttctttgtgcagtgttggtagaacactcaggtaaccatactcttgtttttataaagtttctctatattttgagtcagaattgtttattataaatcatgtgatttttagcacatggtattataatcagcacccatgctgaaaggaatttctctgttaagttctgttctgggaaggggatatttccttatttatcaaagcatttgtgaacagataagacagaaaataagcagaaatgaaaacttttttatctcagcaaaatacacttagatataaaacatgtatattgtttgctattattagtcatgccaaatcttatatcttaacctgctcagctgatagaaatttggtcccacttgaaatcataataagttcaaagatgtttggattaagattgtaattgcaagaatgtgggactctagaacatacagaactcactgtcttagaatcagaacagcagtgctgtcttcctttgtccagctctgcagcccagggccagagacaaatccagagaatggctctgactagcccctgatggtgttttagctcctgtgtagcacactgcagccactaagccagatgagtgtggggatggctgtggacttgtgcgtgtttgatgctgtaattgtgtttcagatggtaaaagatgactatgaggacgattcccatgttttccggaaacccgccaatgacatcacatcccagctggagattaattttggtaacctccctcgtcctgggcgtggagccagaggaggcacccggggaggccggggaaggatcaggagggcagagaactatggacccagagcagaagtggtggtaggtgtctgtattgacggtttggcgaaagaagttaataaggacagtgccctgggcccaggatggtctaatttcagagggtcatgagtttctgcagtcacttctttctgtagctagtgtgggactgatgttggggcatttggacggtgttgtagcatcatggacatcttgcctagagaccgttctgtagccctggcttccagggtctgctgtgaaggcactcccgggatcagagagaaactcactgtcacccgcattagacaagatccccaggcttgggattgaactggagcacctgacgttttgcttactgtggcctgattgtgtgccttgggctcaggtgatgctgtcagagtggacagaatcctccctaagatctcaagccctttgtgaggggaccttcctcaacccctccccggctcacctgcctcacaccgtcctcagccaaggctgcctgattctagctctcaacacagcacgctccttacccctggcctctgcctgctggcctccattcatccttccagcctcacttcctcacaggtttctttgatcacatctcctagaccgatcaaggtctcggagcaaaggagtttcttttcattgaagcctgatctccgtgtgcggctgtattctcactggtgtggctatcggtcagcggctgcttttgctcattaccggtttacgcagtgccacgcagtgcctggcatgtagtaggtgcttcctaatgtggtatggacacttattcattggaaatcagccccgaggccccatggcacagaccccttctctgtggctggtcttggcaatgctcctcctgctgcccggttccctcgctctagggagcagcccctggaagcagtgtctatggtttgtttttgcttaagcaggagcaaaaacacaattttttgggcggggggtgtaggggtatatttggggccaggttggaaatagggtctattctgcgataggaaacacaccctcactcctttcctatagcggagctctgtcccctgcagcactccagggagtgtgttgggaaaccactctgagatccagtgccacccacctcttcactggcatctgtccccacctccacaacctgtgcatccctccacctcagaaccgcccttagggcccgcccccgcccccatcaggtcacactgtttcccaatccaagtccttgttccctttgctcatccattgaggttcatcccagggagaaccttctcttcccacaaaaccttgcctgaccttggtgtccactgtgccaccaaattgcactggatggccctcctgtggcccctccttcccaggacgtgttagtgaagctcctgattcgatggtcagtttctccagcaccgtgagctccccgaggataggcactgtctgtgctcctccagtgcccggcacgcagtaaccattctatttactcgatgaaggacgtgcccatgcagaacccccagtaagagcttgcaggacgtaggaagggaggcagctcctttttcgaggaggctggaggcctgtgtgggagggggagctgtactttcctgggttagcagtgacctgtgactctccccttcccactgtgggtcctgcctctaatgcaggcccctcagcgttggtgccaggcccttgttatcccactgggatatcgggaatggatgaaggggcagtggatttcaaagtatttctttttttctttagatgcaagatgttgcccccaacccagatgacccggaagatttccctgcgctgtcttgaaagagccctgtttcccagcaccgcggagctgcactgcacacctgtggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaagaaattaaaatacaattgcacttac

SEQ ID NO: 37328 - DNA, 32683 bp, Homo sapiens
gccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccggtgagtgaggacgcgcccctccgccggcgggcgggacccagccggggcaccgggagaccccgaggcgtaggtctccgtttgcccacccgcctcctaggaggcgcctctcggttctcctcgccttccctccctcccctccgtggtggcgcctctgagctgtcagcgccgaggctaaagggagccgggcttggggaacagcggggttcggggtgccccgacgcctcgcctgaactagtcttctgcccctcactccgcctcccccagagccgctgcttcgcctcgtttctcgccctcttgacgggcgccgaggtgcgtgggcttctgagcattgaacaatggttctgcctcctctgccaggcgcagtgttgggaaggaggcagagggccaagacgtgtgcggcagcctcgggcgcaccctcgaaccccggggagtgcgggagcggacggggggagaaggtgagcgcctccggggacgcggagcgccaggggccggccgggcttcagagtcttccggcggccgcgagctggcgcacgttcggtgggcggcggccgggaggctccgcggagccgagggcacccggactgcgactcccccggcgcggggccgcctctccggcgtgcggggtaggggagcggcggggctttacgcaggactctgctctgggcgcttctcctctcccttttccccgcctcgggcggcgtttggaaaccgctcgggtctcccgtgtagctgaacgcggagggggagtggaggggagacttaatcaggttagtttgctgaccctccttcccggtgacgtttcctcgagaggaattgagtcctaggctagtgactgtaattagccttcattctacacaatagctcaaaggagcagcgcgagagcgagcgtgtggccctgtcttgttgggaagggcggcggtgactactgtcgggtccccagactctgccgcgggggcctgggggccccgcctggtcgtcagccacgttcccacttggggcctcgtaactttcctggacaggcgacaggaagcctttctgagaggactcagtcggaatcctagcgcgtccccgaagtgatcttcagatgtgacgccgaggggcttgcttgccagctgcagggaattgggactgaaagccgcccaggcccttaacacccgttccagagtccctggctcccgtcgccgggtggcttcaggggccctgccggcctgcagtcacgtgctcctgaagtgagagcgaactttaaagcatgtggtcaaggagcctgtcgggcagcgcctggggtttttacgtctccgaatgcccctgccctttggttgccactgtccggagcgtgtgaactgggactggcctttccgccctctgcgattggttagcggtgcgatcacgtttaggttggtcacatggttccgcggactcttaagtgggcagcatgggcagtgttattttcaatggaaagtaggagactccacaggctcttacgggctgttctctcaaatgccttcccctgcctggactctttgaagaggacgaatgtgtagtgaacatggaatctgatgtgtaacaagcctgagagcctagaaaagctctgcttacaagagtttccaaacgctagcattaatcattaatagatgagtaatactaacttattaaacgatttctcagtatagtgccatgacttgcattatgccttttgtaacatttcaaaacgctaaggtataccagaaggagggacaattatccaggaaggtgagagaaaagtttcgtttttgctgcatgtcccttccactagaggttaactttaccttatagaatgctaggaatgcacctaaactactgacatgagttagtcaaagccagatgttcaccttgtattgggcaggtgaggatccttttcactttgtcacatgtgaaatatttgacatgccatgaacaatggaaaaacaaattcttcaaaggagaggaagcagattcttccagaactggaggaaatttgggctgaggcagttattgaccctaaaccaatcccaaccggcatctgtcttaagttcaaagtctcagggcatgtgggctgactttctaccctggagcttctacacataccccttctgtccactggcacatggtgctgttccacaatactcctggacaagacaggtgaacactgagactctggcaaggaacttaaggctaacaagaagttggtatacctgattgcacaattcctgggggttctgggacattttccttcagcctaagtagtcaagattaagatctgtggtatgatatattctttaaggccagagtctaaaagaaccaaggttttttgagagctattcatatatggctagcaactagcctaagaatagaaagaaaattccctcattgtgagaagtgggttggtggtactggtggtagtaatagacctggaggtaggaaactggttggcatggaaagtaaacttggctcatccagatagcaccaatgaaggtatgacgatgatagtaccccttatcaaagactgatcactcatgtgagcagggactgcgtaaaggaaggtcaccagccaagccctccttggcagtaacagcttcatgaaatccagtgtagctttgttccctggatcaccctcttgcccactttatgtggcatttacctatagtgcctgtcctgtgtcattttgattgtttgcttttatggcctgagtccccagatacttaaagcatgtataaaggtcaagtagagctgccaaatattaagactttagtacaatagactgctatttaacactaaacattgctagcaaaggtgacagtctccatgctcaaaagaagtgaagacctgatccaagtgtctctacctgtcataaaattgaataaccgtaaacttgacttgagtagtttcattacagttttggaagaggaaaaaagttgttacaagccccttctgctccaggagaggtatcaaattgataagacttaacaagaactcctagagtagaacatgaccataagatcaagggaacacatagtacccagccgtgtggcttcgggttttgatcccaaaccttgaagacttggcacacagcatagaaatacagctaattcattttaaatatctagcccattttctgtttctcacagaatgtaaatttgttcttttcagtgcagggaaaagtgtttaagacaaggcagttgcctacgtgacttaaagtaatgattgcattcactttggatactgactttcatttggaaaaccaccttcacatactagcctataagaaattaaatgtattaaagggcttgatgaggtctataatgatgttcgttgtaaatgtacctgccttagggagctccttgtggtggctaatacaactgccctctacatggttagttgataaattcaaaattgcttagtttggtccctactaatttaatctcaaaagaatacttggacaacagagtgatagactactttcaaggcaaacagtccaaaaatactgtctgctgaggttatgggcgagatatacttgttaagcggaagtaagtagtccagggacaattttttctgccacctaaagagttttgggctagaaaatctgaggactgatagtttttctgaagagttggggcagagtctaacctagctataggcgaatctggcttttaagtaaaaatcatctcaattttactgtctgcatttttcaaactaaatcagtgtctctttgctaagttcgtctattggcttgcaacaaaaactctaaacactgttaataccacttagttaagtacactaactgcactgcaggaaccaaatgagatggcaggtgataacacaggttaagtgtcctttatctgaaatacttgaaaccagaagggttccacagagtttagattttttcagattttgggacattcacacatacataataaggtatcttggggatgggacccaagtctaaacatgaaattcgtttatatttcacatacaccttatacacatagcctgaaggtaattttatagactatttttaatgattttatacaagaaacaaagttttgactgcaacttgtcacgtgatgtcaggtgtggaatttccacacttacggcatcatgtcagcactcaaagttttggattttggagcatctcagattgcggattagggatgctcaacctggaccataaatttagcatacttttccccttgagtgaagtctcctaggaaagcttgggcccaacagttattttgagtctctaagcaagagaatgcctgttaggtcctgtgagagtaagtgtggagattctgttagaaatgtttcaatgcttgcttagagatcctttgcctactttgtagtttagagatgctggaaactataagatgaagcctctggctagagcagctgattttgccaacttgggggccatctggggagcctttatgtatgtagacgaggtggtggggatggggggacttgcaatttgccaaccaagggacataacaaagcctcggcgatagacagcatttgtgagttacatcacaagtttgttagaacttaatagttctcccacatgctgtgagtaaacagggtttctattttatagactgcctctaatctttcattttcttaagaaagacttccccacatctgaggtattaactgatctgtatgttcactaagtaggttgcagattgatgttggtcatctttgtgcatcttctggaaaccacttaatgtacatctactgagtacctaccatatggcaccaggcatggggacagagtgaccatagcactggttccttcctttgtggcacttagtctagtaggggaatcaaagcaggaaacagccaaagaccgcttggaatagaagctctgaagaggagtgagcagatccagtgtttaagacttaatcataaaagaggcagatagcagctggagatttctggaatttccatatgctatctgggttctagcttatgaagtttccctaaaattaccaagaacttagactttaatttcaaaaagccagaaataattctatgtctgcagataatcctacaaaagtgatatgactaaagcaacaatggattactgccagtattaccaaagagcattaaaacatgtcagaagtaaaatctgcgtctgatatatcacactcaactttaccagttagccgctgctaaccttctcaggtgttggaacctctcttttcacatggaaatgaagccaacacacccaaagggacacactcattctgacagacaagtgtgtgaaaatgcactgtttttaaatgataaattgcaacaaagaggccgggcgcggtggctcaaacctataatcccagtgcttttggaggccgaggcaggcagatcacgaggtcaggagttcgagaccagcctggccaacatagtgaaagcccatctctactaaaaatacaaaaaaattagctgggtgtggtggtgcgagcctgtaatcccagctactcaggaggctgaggcaggagaatcgcttgaacccgggtggcagagatttcagtgagccgagataacgccactgcactccagcctgggctacagtgcgagaatccatctcaaaaaaaaaaaaaaaaaattgctacaaagatgaggtgaaggtaccctcataggcctagggaacagggacctttataacctagagtctttcaaagtattctagctagtaaaacaaccagtcacacttggtttcaagttctgaaaaagctgggggaaatgtttttgacaaaagtttttagttcagaccagctttattagtaaactaataaatcaactcatgcacccaagactaccaactagtgcctagagaatataggatgtcaggcaccaggtcctgagttacaaatgtgaactgcagcccatgccttaggggatctctgtgtctaaaggtgaaaaatggtagctgaactcatctccttgggtgatggctctgtgacagggactattatgagaaagcagccagaccatacctagtttttccaaaaaaggcattgaggcctcattcaagaatacaatctgagcccactcctggtgaatgggtggacaagggcaacatgaacaaactgagacaaagcagccatgaggaagggcaaagccatggggaagtgagtgggtcccctttgagctgttagctcagcccgtatagcagatggtgggtagtgaccaatagggaaaagtctgaggaaattagtagggaacttaatcctagagatagtggtaagccaagaaatgaccccattcttggctattctaggttgcttgaatcactaggttgcttgatatgggtagagaatgtggcagcctggaggcaaaggaacaagacatttaaattgacatcaggtgagaggagggcttgggcatagccagggattgatggccaaatgtcagggaagaatttgggctcatttctggagtactgatttagagtaagtaatggggccaatcaaagatagactacacagggagggaaggatggattttagaagaacctctgcctagtaagacacccaaataaattttttctgcaaaatagttttgagggctttactcacatgttactatcatgtgtattgtaaaagaggcatttatctcctgtgtccctcctgtgatgaacattaggccttatgagggtgttattggtatatgctacaaccctgaaaatgaaagagccacttacattatgggtagaagctgtagcttcttaaccttagtgcagtggttctcaaagtgtggaccgaaattggcaacattaattcaatgttaattgagttcatgtgtcaacattgactcattagaaatgcaaacttaggccctgttctagacctgctgaatcagaatccaggctggggcccagcattctgtgttttaacaagccttcctggggattctgatgcacacgggagcttgagaacgactgacttagtttaccactcacagaagctaacgattttcaaggtatatccgatggagggcctttcctctgacttgaaccctagacaagaaaaccaagagctataatccttttagaagacttgctgaggaattctagaaacatttttaaaaacttagaatgaggaaggaaagcaggcctccatctcaacaacaaggctaaatctaagttgatgcttagtaacacagtatctagagccagtgcctgggttcaactcctagctctgcccagggcaatctgggacaagtgactgtactttccttctctaccaggtttcctgatctgtaaaagaggaataatagggccaactgtgcaggattaagaattttaaaagctaagagatgtgaagtcttagagcagtgtttgaccaacaacaaaaacgatttgattatgtccatgattcttaagatcaatttgatgtaaatggaaattgaatgtaactgacaattgaactgtaaaattcacttatttccatgactcagaagaattagcctacatattcaccactttttagtggcccccgaactagtgtttttgttgctgtttgtttgtttgttttcgagatggagtttcactcttgttgcccaggctggagtgcaatggcactatctcggctcactgcaacttctacctcccaggttcaaacaattctcctgcatcagcctcccaaggagctgggattacaggtgtgtgtaatgcctggctaatttttgtatttttagcagacactgggtttcaccatgttgaccaggctggtcttgaacccctgacctcaggtgatctgcccgcctcagcctcccaaagtgctgggattacaggcatgagccaccgtgcctggcccaaactggttcttacaatgtttcagaggctgactttaaggccagagcacaatctttgtgcttgacagctcagaacatttcccttaacacctgttgtggtactttgcctcttacaaacccttctccccttaggaaaacttttttgctgactcagaaatttgcttgtcctgaaaggagttttagcttacaaatagaaacactgtcattaaagtggcaagcagtagaagtgaactagactaaaaataaatgcccttggtggccccagaagtgccaaaacaaatggacggaaggaattccagcaagtaacacccatatgctcaagcaatgagtaagggcatgagagatgtaaatgcttggccctggtggccccagcagtgtggcagcatgagcctctgtgcaggctgaagtacgctctgagcctggtacccagagacactttctctatattctgggcatgcatcttggagtgctcctgccagggtgctgctcggagccccatagggagatttgtagtccgtttggaaggcttggtatttactcgaaggcctatgcagttttttactgaagcttatgtattagtcctccatgtcaaccgctacagggaaaattagacaatggcggctgacttctatatgcattaaaaaccctgagtttccctctaggacattggtctagacaaggaatttatgaaagagacctcaaaagcttaggccacaaaaacaaaatagacaaatgggacttaattaaactaaaaagcttctgcacagcaaaagaaataatcaacaaagtgaagaacaacctgccgaatgggagaaaatatttgcaaactattatctgacaggagactaatatccagaatatacaaactcaaacaatggggaaaaaataatcccattaaaaagtggagaaaggacatgaatagacatttctcaaaagaggacataaaaataaccaacagatacatgaaaaaatcgttaccattactaatcattagagaaatgcaaaccaaaaccaaaatgacatataatcttataccagtcagaatggctattaataaaaagacaaaatacaacagatgttgctgaggatatggagaaaagggaagtcttatacactgctggtgagaatgtaaactaatacagccaccaaggaaaacaatatgcagatttcccaaaaaactaaaactggaattaacatttgatccagcaatccctctactgggtatctacccaaaggaaaaatcagtatatccaagggatacctgcactggcatgtttattgcagcactattcacagtaacaaagatacagaatcaacctaaatgcccatcaataatgaaagggtaaagaaaatatggtacatatacacaatggaatactattcagccatgaaaatgaatgaaatcatgccatttgcagcagcatggggatggaattggaggtcattatgctaagggaaataagccaggcacagcaggacaaatatcttatgttctcaatcgtatgtggaagcttaaatatttcattccatggaggtagatggtagaaagatgacagagactcagaagtagggggaaagggagagcagatgaaaggaagtgggttaaagaatacaaacctacagtaaggtagaagaaataacgtcaatgactgtagttaacaaaaacgtgctcgcgtgatggacaccctaaatcctcggatttcatcagtatagattcattacatacatgtaacaaaattttacatgtacctcataaatttatacaaacaccaccaagaagaaccctgtttttcttggagccagtgaactgccaatgtgtctgtgtagcaaagttaactacttagagaagcaaggctcccaggaaaataggtccttgaagttagtgtgcatattctatagtctgattccatctatataagtgacagtaaaagtgagaattttttgacgctccaggaattcattcattacaaatttaaataggcacataagtgagtaggtacaagcgacttccaaccccctcacccaaaggagcagagatattctaaggattagagctggaagaaaacctagacaatttcttaatagaacccttttcaaattcttacaccaaaatccaatattcaaaagaaagtcttggtagaggcagaggtggaacacccagggcctctgctactgtggcctttccctccacttcaaccacccctctagcctgaggcattcttgtgaaacctcatggctttaaggaacccactaacaattgcattttgccccatcttctcacctgtctgagcagaaatgcctagcacttctacttccaaggtattttttgaggtgtcattggctttagtttagcctgaagaattaaaagaatctcgagtgtagatgatttcaagctcaacttgttccctttatgaaagtataatactgaatttgagacgtaactttcatggatggaaatagactgcaggtccacaatcctataatcccaaagctttggaaaccaaaagcctcttaactcatttggtgctttcagttctcctagagctctgcacagcagcagtcccagctgagcaccagaggtggataggtagaaccttttaaaaacttgaacagaaaacttaacagtgttccagtcaggtggctaagggctgggcattcgatttagtgtctgagctctccctctctgtgggaagcagagaattaaacagaactagggagcactttctgcccagtagcagtccctcaaaacaaagtgcttaggaaactaggaaacgaagaggcatagccataaagcttaaggtctttatttgcctgtctttaaagagtcctttataaagccagcttgtcttcccacccccaccccaatgtcattcttttaaacaggcagggacattttagtagcacactgtactcctaatgcctgttgctactccttattggagagagagagagagagagagtgtgtgtgtgtgtgtgtgtgtgtgtgtgtgtgtgtggttgagagagagggagtaaaacacagctttatgatgatcaggcagaagcttgagtaaagtggaaatatctcggataagaaaagctagaaattaaactcctttttggcttcggatattttcttagtagaaaatgctgatgcctgtcctgagtctcctcaatatagactcttagagcagagctgctaggattttaatagaatttattactgttgatagcttgtatattacaactaaattcagagaccctctttaaggcaatagtagagtaaatatcagccttgggatactgtatgcccatacttaatcccaggccactctgagtgcctaggaaatctgtagcttcaaactcattcttaaggaggttgtcttccaggtaccttaaccctgaggtgggaaactatcaattgacattgacctttaagttgctattcaaatctgattacaaggtttccattttgattatgtagatatcaatgtcaatgttgttgtctcattttgacttaataacctttggtaactaaaaccttaaaaaaaaaatcagaggctttcagtctttactgtatcttaactccaacctgactattctttccaagtatatttatacctatgttctcagactacaaatcattcttttcctgattactcaaggtagagtcttaccactttcacagtccccaaaggtagtaaggtcatatagaactgcaagacacgtaccctcagcattgagaatattgcaaacatattaagaatccagtggcaatgaggggagaggggagaggcaccaggtacctcagatttggtttagcagtataaaacaacacaggtgatgcttcctgacaacaatctctaccctcctctagttccccttctaaatccctagtatattacaaccaataaaacgtgaagaatgaaaaagtattatgaaatgaaggtaggaaaccattctgctttgtagctgggtcctagcttaattagactcatgggagcagagtgatagatgcagttttaaaagcaacatatttaatatccaaggaagtaaccacacccatatggtcatcttgatttgggccaaattttaatctccctgggaagagccacaaagcacgaaatgctcccagacagcagggagtagctgacactagggagaccaactagggtattgtgcacgtaacacaagagttccagtctgtgcttgtctctgtaatatcagttcttatgccagcatgccacagctgcaaatgctgaaaggtggcaggaaatcggaaggccttctgctgggacaccctccctaagtaatctgcgtgaactatatgattccactgtttttctcaaatatttgcagtatatttgctttaagggccacatctgtgccttttatcgtgaagcaatcacatccgccagaaggacggaactgctaatgataggaagcacctgaacattagctggcctgtgccgggcaaaacaccaactgtcccacttagaagtcttagttcacaccattgtgtgaattaaatatccatacattaagcatagaaaaccagattcagagaaatcgaaactacatcttcagctccacctcactttcctttcctctcctctttaaatgacaaatgatcttcctttccctcttaactatactttcttgttgcttttatcttggagctgttttttaaagctgtgtttttccaattagacctcagtttctaagaggaggaatcatgtattaaatctctatttctaccctattcttgctgctccttctaaatcttcttcactgtgcttgtaatagaaacatcattaatggataatagtatggatgtggacaagaaatgccattaaaggattaggacttggctgattatagccacacacgtagtttcaacaaatgagagaaatgagtccacaggcagagatgatgccccttgtggtctctgggcaatctggattccttctattttcgtctggctccatttgcccgagatcactattccagccaccatgcccaattttcaggtaccaggaatgaagagatggaaagaaaatggatcctctatcctcttaaggacatttcccaaagttgtatataccattttagtttacattccattagtcagaatgtagccccttggctgcacctcactgagaaagaggcttgaaaatctagtatttagtcttagcatgcacccagctaagaacgcaattactgtcagtcactggctgaagagccatcctactctggcccttaggatgtcatagcctgccgagtctgcagtatccttctgagaaggtccccatccatgggtattaggtatcttgaatctataaccaatccttgctttaccgaatgttcccttcttattctagggagaaaagccaaatgtgaaccctcccaattccagtgcacaaatggtcgctgtattacgctgttgtggaaatgtgatggggatgaagactgtgttgacggcagtgatgaaaagaactgtggtaagtaaagagtttgatgacttatgcattttgttaaaatatgatgttatcttagtctgcaaatgtattgagattctgaaaataaaatccacttctaacaattgctttgaaagaatctatacttctctgtgtaaaggaataaaattgaatgtttgacgtggggttatcaacttgagaatggaatgataaggtgatgttccatttaaatgacaggacctagtttatcttagatcagacaaacgtggaataggaatctgggagaagggagaagaggaccagaaatagagacaaacagaagattgcttagaaggggcttttttccccttttaattttcaaatggctctgatcctagaaaagaaggcaagccatggacatgagaaaatcccataaagtttcagggggttaattaacccttgacatagaaactacaagccagcacagatcaaagatcagataaggattcttttttaattctctgcctacaatagttgctaattctaaagcattagcagggcggaagacattctctccccaagagaatggggatacagtgtcacagccatcaatcagcatctattaaaagatcactgtgagaaatgcctatgtatgcaatctatacaacctcatgtcaagccaaaatagctgagaactgcatggcaagattacatttacataccatgaatacatgctgaaatttgctctacgatccctttgttcagggttgtaaacattctgaaacaatattctatgtgaatattggtgctaacattgtcatttatcttttaaaagatgttatataaagatgttcactatacaaggtagaaatacagaagaaaagtagagtctaaatgtaggtttcatcaactgccatcttgttatgcctttacctacttcttcatgcatcattattaaaatgctataaagtatgcatcatggcagaccttgtgctacacctgatctctcagagcagtatcacaggtgttttcatgccaatgtgtaaagcagatcagtagctcctttagaagcataagaaagtccattctaccatctcagggaagaaacttacatccagtctcaggaccaagaatagttctcctgtgcaacactttatcatcatttgcattttaacactaagattttaatctattccacaagacactgagtctcatgctatttctgggttacctaggtaatttagttctcttactaaatatctccttagagagtcctcactcttgtcaactattttcctgttgtaagttgcaattttttttcctctcttctaaacgatatatttggcaaaacccattgcttgttcttaaaaagtaattattctctttgtgttgcacaagtctttttttaccatgtgactcagtaggaactaacctgggtcaacttgggatttttctaaaatagtcttgtataagtactctctactagccacatggtaggagagtttggcaaagaaaaagaggtagatgtatatctaatcaagatcatttgaggcaggaaaaattatatccttagccaaaatttgtctctacttcctgtgtgtgacagtagagaaagaaagtagaaatattacaatcagggaaggtctgagtgcttactttgtttctctatggaagaggaaagctatagaattacttaaaacttccaaagctgcctcctatttttagtctaacctcttaatatggaacttggttacaatatttagcttagttctttatttccagtatgtcaatgggcatagtcaacttaaccttagattctattagccatgtgcttctgttggtcccattaactcattcttttataatgttaggctgagctaattaatcagcaacctaagtactctaaatatgtaactgctaattctcttcctctgtagcacatctaaattcctatttgtctctcaaggcccagttcacatatcctttctttaccctcccagtctatgctccaaatgaagagagagaaccatacggcaatttgtctgtctctgtttatcttttgctcaaacactgtggtatacagccaatctttcacatcctccttacgttttctaagacttaaaatcatggagggccgggtgcggtggctcacgcctataatcccagcactttgggcggcctaggcaggcgaatcacgaggtcaggagatcgagaccaccctggctaacacagtgaaaccccgtctccactaaaaatacaaaaaaatttagccggacatggtggcaggtgcctgtagtcccagctactcgggaggctgaggcaggagaatggcgtgaacccgggaggcggagcttgcagtgagccaagaccacgccactgcactccagcctgggtgacagagcgagactccatctcaaaaaaataaataaaaataaataaaaaatcaatcaatcaatcaatcatggggtctctttacagccattccgctactccctcttttgtagcttccaaagaatatcacaggttgaattatagcaactaaccctgcagaccctctgacttcttcctccatgctcaggagaacacagaccttgaatagcacttaattcattaacattagtgtttgagtttttcagtgattttagaaacaggcatgaatctaaagctagcatggccagtcttgtttccttggctgtgtaattcaaggagataatcctttatagatcatcataatttgtcaacccatcttgagttctagaaattaactgtaatcactgtctctctcctttacaatatcttactctcaaccagagtggtccaagggcacactctaagctctgagagttctacctgctttaaaccagtgatttgagaaacagtccctttcaaatgttcatcaaattgtgaatttttcacttatttaccttcacagaatatatgttatagaggaatgttttaaaatagaaattgggtagaaggtataagcatataggcaagaaagaatataatctaagaaagataagcttagggtatcctgtgtggctactttatatcaagattcatcctgctccgtgattccttcatgggtaggataatcaagctgcccgatttgcttaggacagtcctggtttatgcttatcttccagatataattaaaagtgtcccctttctgctgagactgtcccagtttggacaaaaaattgcatggtaaccctaagtataggggaaagacctgccccaggaagaattagcaacagaatcaattcctctccttaggctattttaacattagcaggcagttatggatattagcactgacagcttcaatgacttttagctggttgatgttagcctaccccttggctagaaaggctaaaatcttctctcccttgaattctaagtacaacatctcttgttacactgattgagttttctcccctttctacctgatgagtttctttgcccctgtagaccagtatgggtgacaatattcagtactggggtttggccttcattctccacactaaacacatgtgttgttaggggatgccccttgaacagtatattagtcagctcagactgctgtcacaaaaataccataagtgggtggctgaaacaacagaaatttatttctcatagttgtggaggctgagaagagacctgccagtagatctgatatcaggtgagggctgtctttctggtttgcagatgaccatcttctcactgtgtccttacatagtagataacaaagagagagagagtaagcgctctggtttctttttatgagggtgctaatcccattcatgggggctccaccctcatgacttaattacctcccagaggccctacctcctaataacatcatgttaggggttaggatttccacacgtgaattctgggtggagacaaacattcagtccccagcaagcagttctactatgatccagtcagaagatggaatgtttagctgttaaatgaagtacttgaatgacttggaagaaatgcatgtagaaaatgaaagtgttacttaatctcaacattataaaacaggcaggaagttaaatgtaaggtatctccgagttgtaagataatgggcaacctctgtctgaccttgacttcagtttcctccaagtctctcaaatgagcatcttcctcctctgaaaaaaaataataatttttctgaagtttcccctggatattggcagttgagtgcccattgactcagcttttttttagagcaaaacatgccaaaatgcagtatgagccctcatgtgaagctagggctgtgggtaaatgacttcaactttaacccttcaaataaacgtttgtagtaaagaagacgtgtgctgaatctgacttcgtgtgcaacaatggccagtgtgttcccagccgatggaagtgtgatggagatcctgactgcgaagatggttcagatgaaagcccagaacagtgccgtgagtgtaacttgctttggccttgaactttgccaagttgttcggtgtctaacatttctaagtattgcttaatctcctacttggtattcatttttctttgcctgccttaaagtttaggtcaattgactccaagggcagtcaaatcattaccagtttatcagcctcctttaaagaatgttctccctggtccaacaagactgacattctcttgggtagcttcactattgaatacttaaaactgaagtcagcagattcaatcaagaactccttgactaggtgcatagatttcaaatgtctgtttataataactgagcagatggtactctggtcctggaagctaagtcaagaagtgagggttccctatgggccaagcaaaagcttttagaagcacagcttatcatactattaaaaagctattactgaagaggtaaggtagctagtaattgggtgatatagtgactcctgacacacatgtaacctcaagttactaaaatggagatcttacagcatattcttaaataagagaaacttcataggtatgcaagtatatacctgtgtccttaggaaaaagtctatgagaccataaagaatgatggtttgggatcatataaattgagatcacacgaatgtcaaggcaaagaaagtcttagagtttgagtcagtagaggcctgcactggtagaaacactaaaaaaggactaacatgaacacagtttaggtctaaagtgtgattatgaaagaaaatcaaatagaaaggaagataaggctgttactttcaattttctagataagaagtgaggggagtaatattggtcaaggcaagtgagttcaaggcctgtgagctaaagacaggttgtgtaaagattcagcctcaacttttagtggagaatgacctggtcaagtcaagcattagggcatgcttctactttgcaagatgtcaatctaaaggacattgtgaaggaggcccataaaggaatctaggcaatagaagattttgtaggtgtttgaccatctgacttttcatgtatttgagattagatgacaatatctaggtgtgcccacttgacatccaacagataaatagtggtctaggagcaggccagccaataaacttcaccacgccaagtaaaacaaaagccagaactgagcacgccatgggaccttgaaggagtgacgtggtcaaagctgtcacgtacactgccaggtagcataggttggcacagcttctaaggagtggagctgatgaaagagctccccgggcttcagccagttagtagaatttcaccagtgtgccaggctactgagtcacaggtattagcgcttccaggcagcacaggagcagcagctttgcattgatcagttctgaggctcttttgagactgtatatcatcaacagatatgagaacatgccgcatacatgaaatcagctgtggcgcccattctactcagtgtatcccagtgtcctggagatgtgatggtgaaaatgattgtgacagtggagaagatgaagaaaactgtggtaagaagatcagtgttgagtgacgtaacccaaagacccttttcctaaaggaagggtgggcaggggaaactaatctaagcctgaagacgcactgacattgactcacttttcagtgacttcactatctgctcaattacttgtccttcataactgccctaaaaccctaaaagacattcatgtggcaattgaccatcgcttggtgtttcttttaggcaaatagaaataagaaggtaagtcattcaaggcacttatatatagaagtagctcagggaagcagcaattgtgtgggcttttgttttgacagtaattcatgtgtcttttgcactttggcacaataaaattagaaggtgagtagggttggcaaacacattcataggtctaaatttgattgggttattggaataaattatttgagtattatacaagcatttctttgcccatgaactagattctggcataactttcccagaaaaaaaaaaaaaaaagacacagaagcatgaattaacatcttgcctcagatacccaaagaaaagtctacccaactggtgatacctttgtctcctgttgcagttcctgtctctgaaagctaactctgcttcctattctttcatgtttctggtcttggaaaatctttaataaaatgctgcatgttgaaggtgagggcctgggaaaatcactaggttgaacaaacagtgctttgaatgttctttcaagctactgccctttttatagggcctctaaaacctacagctcccaagtctgacaagcatgggcctcctgatatggtagtagtcaagggagctcagggcacttacagttgaaacaccagtcttgtgtgtagaagtcgcctcctgaggtcaataccactgcacctagtccaatgagttttagtgttcaatcctagaattgggttttctgtattggtaagccctggtgctgccaagtgtttcccttataaatctagactttgcttcccaagagagtcgtggtctctattctaattgccaccaaattgtgaccttgaaacatttggcaggaatttaagtcaaagtaccaattggctagtaggactagcttatcattgtcagcatacctgattgttaaatggtgattatagccctggcagtgactttttcaaaatggaaagtgtttaagacttgttattcctgatccttatttaaaggaccaaaaagaggaaccatatatggtggtatgtggttcacctcttttggtgacaaagtcttaatgcttgttgtgagtattacgttgcatgatattctcaactagtgataagatctgacaagcagtatgttgattcaaggacaactcaatctctgccttccaaattgaaatcccttgttacagtttgttatttatgatggccacttttagaatcaattgtggttctcatctcaaattaatttccagtcttcaactattttcttggttctttatttctgttcttcttatttattgtgtgccttcattttttgtacaatgagactgtacaaaagttcttgatttaactccattgtagcctttaagttgggctagtaagttaggattaatgaataaagatcaatgtattagattttgggacaagaatcttgaacggaccaatcttgatgcattttcagtggggcatcctctctcttaataggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtcgtaagtagctttctagcatggcatgttcagttctcttccctgtatcaactgggacaatttgctggcttcattccatggtgtttcctccctttgtagcctctcgaacttgccgacctgaccaatttgaatgtgaggatggcagctgcatccatggcagcaggcagtgtaatggtatccgagactgtgtcgatggttccgatgaagtcaactgcaaaaatggtaagggtttcttcttgttggttaagcaatggattgctctgaccagacccactcatggaatctctcttctttgtttctctttgtagtcaatcagtgcttgggccctggaaaattcaagtgcagaagtggagaatgcatagatatcagcaaagtatgtaaccaggagcaggactgcagggactggagtgatgagcccctgaaagagtgtcgtaagtgtacttgttgttcaagtacagatcctggaagtttgacacaatccagtatagctaacactgtgtggaccccccgtgatggctagttaaacttttgaatgtactgaagttcaattgtagacttcagagtgaaactttatgacttaaaagcccaggtaggacaaactagtttatagtttttgtttttgttgttttttttttttttttttttttgagatggagttccactcttgttgcccaggctggagtgcaatgatgcaatctcggctcactgcaacctctgcctcccgggttcaagcagttcttctgcctcagcctcctgagtagctgggactataggcgcccaccaccacgcccggctaatttttttttttttttttgtatttttagtagagacagggtttcaccatgttggccaggctggtctcgaactcctgacctcgtgatccacccgcctcggccttccaaagtgctgggattacaggcatgagccaccgcgcccggcccaaactagtttatagtttaacctccttaaagataactgatcatcaatagagaaacttgactaaatgcttgaccagctggtaacttgccgaggagttagataatccaccctgaaatatatacctataaaataaatgattaggtcttagacaaatcgtgggtttgaccaggccaactagataagttatcacaaatagcctgggttttaaatgtgaaagatattaattgaaaataagttgtcaagtgactactacatttttattccagatataaacgaatgcttggtaaataatggtggatgttctcatatctgcaaagacctagttataggctacgagtgtgactgtgcagctgggtttgaactgatagataggaaaacctgtggaggtgagtctaagaagaaaacctggaccctgcaggtgatgggaaaggatagtatgtacctagtaaggtataggagcagcaagactaattctgatttccctcccagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggtaaatgaacttggactggtatggctgttgtacctttatgagtaagtgcctctaaaaggtacagccagtgactacaatagtcaaactaaacatgaaattgtacttgagaacaatgctgctaacctcataatacagcagtataggtcaaatagcagatctctcccctagatatgtaccttgatcattccttttgcatatgataccatgaatacctaccaggtttgcatgctctgtttccaaaacttgagtccaactcaaacaagtgacttattcatcactcaccctgttcttgaaggctgtaaccccacgactgccttcctaaactgtaggaagcacttgcaggtcccaggggcaggaactccagaacagatactactgaggtattccacaatacctttattttctaagtgctcctctgctgggaggaggtggtttagaaagaccttgccttcttaaagcaaaactaagtaacccagacttccatcttgcaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcaggtaactttcagttccttttgtggtgtcttgacataagtcattgtcacttgggaagtgatctgtgggatagtttggaggagtttcttttgtgtctagccccatctagcatcgaattacctggggacattaaatctaatgctaattctttattaaactgttatcacttcctaattagaaactaacaattgtctatgaagtaaaagatgacatctttcatattttttatattttctcccttttctctacagttaattgagaactgttcattgttgctacaaatagaaatggtagtacagccttttcttaatgggaactatagaaactcagatgatggatactgaaacaaatagcttcacttagaaatttgttgttcttgtatatagaatacataccagcaactagataatctacagcattattaatttaggatcagtaagcagcatggttaaataatttgagtggtgagctgtggtgttaactggatttctttctgaacaaagtcattgaccattttgtaagcaaaaagtccattctccaagctctaattgtgtcaaactcttaaatttcttgtgacctattctgtttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctgggtttgtagtctgttttccatcacagactttggaatggtatctgtgtaggtcaggagctttctcatacctgaattagtactcaaatctcaaggtttatgagccttctgcaacaaagaattagaattctaatttaagatatcagttttgccccaggtgagtgaccctgggatgtccttatctatatgacaggtcctcctgtctgactctcgtatgactgattgctggctgacattaatgaattaacattcctgatttgatgtgtgtaccaaaagctgtatctgaacccttttgtccacccagtttctacgcaagtgattttttaatttttgactgaaagctttgctgggctagctctggatgatcaaacctaaacgacagcctgaattgtgaggatttgggtaaccacattgcatctaagtgtgcaagttgtctgaaagtccagcagaaataaacagacctttctagaaacatttcactaagggggttctgtaaattgccactaagtaacatagaagagcagctcaggaagttgactaaggctgtagttgtcatcacaactggcccccgtgcagcctcattagaactcagtcagccagccaacccctgctatgaaatttgaaggatgttcgtcttgcactcctctgtaagaactgaccttttaaaaaggaaacataaccttgtgactttgggccgaaatttaaatgtcagacaaacatagattattatagttaataatgagcttgtagattcttaatattcaattttatttacctagaacataatttagacccttaagtgttactatttgtcactagagaatgccttgagttttctgctcaaattttaaatttttgtttccagctactacaactttattccttctaaaccactgaggcttatttctcatttaatttttcacagctttgtttactggtcagactggggtgaaccagctaaaatagaaaaagcaggaatgaatggattcgatagacgtccactggtgacagcggatatccagtggcctaacggaattacacttggtatgtatgttcttccttctcgaccacccactcaactatcttcatagtgtttccatttatctccatggtgaattctggactagcagatgactctactgcttccgcctaaattctagcaggaattttcaatgggagtaactgaacaacacaagtaaaatggtggattaacaaattacacattccataattactggcctgttgtccagctgggcctaatatgtgacacaaattcagtgaacgttgggtcttgggtgcactcatactaaatattctgggcatgagtgccttagcatttcctgaattgcaggcttttaacagttttcttctggctttttggaggagaacaacaaaatggtagcctcttttaatattttctgtaatgtgagtaatatttcttaagtcatttgctttgagaatctcaggtaccctgttagtccccaaaaatgaacgtggatacaggctctgcatgctgcttcgcaaggtttatggtgaccccgttaagaaaccctgctggggaaagaaccgtgaaagtagattattaattcattagatatttttaatggaagccagagtagtagtggcttgtcatgtaatgacaattcttttcctacctagaccttataaaaagtcgcctctattggcttgattctaagttgcacatgttatccagcgtggacttgaatggccaagatcgtaggatagtactaaagtctctggagttcctagctcatcctcttgcactaacaatatttgaggtaagatgtgtctcacatcaaagtgtgtacctttgagctactatatcactttgagaagaaataacagacatagcgggaggagggaagagcagctgaacatggcttgagaaactgctttcacttaaaacctggtacaaatcagacactaagtcccagaagcactccacacctaaacttgattcttttacagttttatatccagtgtcccagttcagcattcagtaaacttagtccattaaatgagaagtaaatgatgatgaccttagaaatggacttgtgttaatcctggatgtacatgctaattgtgggcttctgttttaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaccgtggagaagcacagtccttaataactactttaagggaagcagcatgacacagaacctgctggatgtcagtagctcttggcaactcagttttctttaaaagggaacttttgccctcctgtaccctaccttaaacatttcacatgttatttttttatttctgctgcctcagagaaatggcttctcaacttcagctcctggctttcctcccaagcctcagtgtcagagcttttatttctgtttcattcatgtccccttggccttcagcccctcttgccaagactattgcagtagcctccaaagtagcttttgtgctacaagctttctctactgttagtttgctaggatttttgcaatgaagtaccacagactatcttaaacaacagaaatttattgtctcaaaactctggaggccagaagtttgaaatcaaggtgccaggagggttggtgcctcttgagggctgtgagggaagggtctgttccaggcctcttcttggtctgttgatggtgctcttccccctttgtctcttcacatcatcgtccctctgtatatgctcgtgtccagctttcttgctttctttctttttctgttttttggagactgactcttgctctgtcacccaggctggagtgcagtggcacaatctcggctcactgcaacctccgcctcctgtgttcaagcaattctcctgcctcagcctcccgagtagctgggactacaggagtgagccaccacgtccagctaaactttgtatctttagtagagatggggtttcaccatgttggccagactggtctcgaactcctgacccaaagtaatctgcctgcctcggcctcctaaagtgccggaattacaggcgtgagctgtaataacagtcatattggattagagcccaccttaatgacctcattttaacttgattacctctgtaaatatcctatcctcaatatctccaaataagatcacattctgaggtactaggacttcattatatgaattttagggaggaacaccattcaactcataacacctactttccccctgtgacacacctgatataggattgtgtagattctcaaacacatcgggttatattatctcctgctgaaaacacttggctggttctatctaaataaagccttcaaaccttcctaaggctgagtttccttccactttgttggagcaagtcaagagaaaaccaggagaacatgcctagtctcctttctctgagccttcacgctaaacctcgggcaaatagtgagagccagtcctggtccctcacctcccttccccacctcctcttttggcatctgtctcttaaaggcataacttttacagtctatctcgaagaggtcccttatctggtgtccttagagcatgctgcctgtacctgtatacttattcttccttgatactgttctcacttgaaggattagcagagtagacaagtttaagctcttgggggcaaggactcaggtcttcaacatgtagaacaaggctttatatatactaggcaccggaatacccattttaatggtattttttttcctgactaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtaaggcattttgtgtttcaaccacaagtagaacctacaacaagcaatataataagacacaagcttggatttttaagaattctgtcttagctaattctttgaatagatttgagaagatatctgctattgtatgccgggttatcatgtcatttctttagaactgactttaacccatttcaacattaaatgagtttataggagactaaagtgtcaacataccttacactaatttgtacctagtcccttaacagcactgagctagccaacttgcaggtaattaaatgaggccttaacatttttcctcaaaaggaggaggacagaaattatgcttaaggaaggccatggttacagaaacctcattgcctcagtgggtgacgctaccctaaaataacacttaggctgaatttgcatttagtcttctgttcttaacttttgattaagtggcaaattaaagtcatttgtgtgatcaaggagcttgtatggtgaggctgatgaggtttttattagcgtaattcatggtcaggcagggattagctcagtttaccaagaaattagttgcaagacagtctggtatgcctggtataccagagcatcttgagaacatttctcgtagtttccaggaacatgggatgttgtttagagggataaaatgtggttgtccatcattttgaattgtcaaattccaaacaccgactgtccttcccaaagtttcatgtatctcttttttgcatgaagattgctatttcaatgttgacacatcagctgtacaacttagttcagcagtggtttgtctattttacctggttttaaaataaccttttacatggcttgtctggacaaaacagctagccatgctggaaccctggcattaaccaggttcttggtttttataattcaggtactgcaactactgtgacttacagtgagacaaaagatacgaacacaacagaaatttcagcaactagtggactagttcctggaggtattgagttcagtactgcaaactgttaatctcaactaacagccacactctttgtatctacagcttaaataattaatgcagcctttaactactatttctgccccaattggtaacctatatttaaacaccaaagacttaaaacttgcatatcttttcctgactgatcttaaaggtttctagtagagaactgtcagtgaaatggctactacagcatgtgactcaaatacttctaagccagagttgttcctggtgttcaattgttgtagatactgaacatcaatattggatgcaaaggttttggctccttacctgatgggtaaatttctaagtctgaatacagatccttctaaactgattccttttattcctctgtagggatcaatgtgaccacagcagtatcagaggtcagtgttcccccaaaagggacttctgccgcatgggccattcttcctctctgtaagtagatttcctacaagtctgggttcaagaacttcttagataccagatgaagattttttgttcatctggagctacccctttcatgggcctttatgctgtctagcatttatgacactgaattacgttcgctttctcccccacataatacactaaattaaggcccatatctttctcttcagttgtacctttggcacagtaactggcaatgataagtgttcaacggttaatgctttctacttccgcactgttaacctggcttatccccttttataataagtctctttaactagtgtactgttctgttccccctttgaaatgtgtgtaatgcttcatacagaggagatgcacaaatgcttaaatgctaagagttacaggacttgttgaggataaattaaaagcagttaagaattttcaaacctatggaaaaggacctctaaacgagacacgcaaattctaaggactttgctataaaaacctttgtcctaaatgaagagacccaagcttagctaacacgccaggaccacctgaatagctctccagaaccttctgcaattttaatttggtgagcctaaggtgggaccgaggaccctgcccttgcctggatggatgtggctagtccagctccagtgcacagagctacctctgggctgaacttgtttcaagctcctggcccatgtgtattccaacttctagttatcctagctccataaaacatggcatttttactaatgtcaattattatggattcctgaacgttattacctttcttgtatgttccaatactagacttagctcacttagctaccctctgatttttttcagtgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcagtaagtcagctttgtgtctttatacaccatggcttgaagtgagacttttcagaaaggagacctgggtgagagagagagagccattaggatgatggagttaccaaacacttcatctgctacctggctattagacagacagtatagcctgttagaacataagtcactcagttgatcagcatctaaccctcaccaactgacaagtgggtcaacttaaagtcaccactatattaagatatttttggttatagaaatgacatgtaaatactagcatgaaccaagtagctcattactgaactattaaatccattgcctactggatatttgaaagtaaattagcatatcatatataggggagttggcttaaagtcagtgtattgagtaagattcacttagccaaaattattatatgctttgctttaaaaaggtatcccaccgcccttagtatagctagcttttcttccagcaatagtcactcacttgttcttcagatgaaacccaagtggagtatttggccttcacgtaggaaacaggctgaacaaaacaagtattgatcactcccctctcaaactccggtgaaacatggaacagtggtcaattcttgacacacacatggcttttcacatttttccccaagacttatgatcattaagtagaaaagacagaattagtcacactatcttatctcactaccaagcaggtatagttgaattcaagttaaatgcatgaatgatacaactcagtattcttttgtatctgactgacttttcttctaagcactctgagtgtttgaatgaccaactcaaaagcaaggtccattttaaagactagagttgccatcagtgagtgatcaccaagctcattctatacttcttcttttccacagatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatg

SEQ ID NO: 37329 - DNA, 80448 bp, Homo sapiens
ggctccttcgggaaacccagccccgtcaccgggctccgagcggctcgcaggcgagcgacagcggcctcagccccggcagcgcccagcggcggctgcggaaagcggagggagtccgacgcgggcgcgggcggggagcgtgcgtccgttcgcacaggcagcgggaggaggggcggcgcgaaccatggccggggacagcgagcagaccctgcagaaccaccagcagcccaacggcggcgagcccttccttataggcgtcagcgggggaacagctagcggcaaggtacggcggggcccggagccgcgctcccttcccggcttctgtccctgggcggcgcatgtggccggcggccgcgggccgtgtcagttgcggcagccaccgcgtggcccgcgcgcctccgctcccggccgcgctccagcgccgagtgcgccccgcgcggcctgggggcgctgcggcgggggcaggcgaagactcgggccttgggggttccgggggtacgcggccacgatcgcagggcgggagtgctcctccggcttttctccccccgcgttaataactcgtggccggggtcctatgggggaagggcagggaagcggatgcttattgttttgcaactccagtgtcgggggagagggctttccgcaggatcccccactaacccccgatggactccctcaagccccggtctggcacagacgtgctcgccccgcggcgcagcctggtgccgagggcggagcgagccgggaagcgcggccgagagggcgagggtggcgggaacgcgcgaggcggcatcccggggaaggggagcccagtgtggggctgcacgcaagggctggggattacaggggtttccgggtaaaagtctgagagccaaataggtgccgtgacatcaatgaaacgataatagtaggggcttctgttttttaaggttataagaggaaacgtggtcggcttcaatgagaaagttgtactggctccaagctcttcggtgtccaggacgtacgcgtcttggatccacggaagggggtcatcgtatgggtgtctgaccctcttaggagcctgtttcctttgttttatccgcaaggcaaggagagacaagggaaatgacttcctagctttacccggggttttttctgcaggtggagaagggtggagtcctcccagatggttctttctttgctcccctaacagcctttaagatgtggctacttgtttttcccaccgtttaacaccctccaacttcatttggagcacgggttcctcaagggatcctgagagctgggtgctgggtgctggtttggagaggcaggatgatgcttctcccggctggggagagcagagcaggaaggctggttggcgccatgaggaaagagccacgaggttttagctcccgaaccgactcgtcagtagcccctcctccatgttggttttacatttttccctcctggtctggactactttagcgcaaggagcccagccagacacggcggctggcgctgctggacttctttattgatgaagttgatctcgtccgtagctcccggggttaggaatcggcctgctttaggtcctgaagtttctgttctgtgtgctccctggttgaaggcttttaaaaaaatttgtaatttttgagtatgttctttactatgacttatactagtaattcaaagcaaaaccagaatgctagcccttcaggaagctttacctgttcttttagaattattcttgctcttctggcatattcctgttggattgggagcattttttgttgttgttgttcatggctgttttcccagccctcctagcacaatgcctgcctggcatgtagtggggtccaaattttaagctgaagtccagtcctcctaaagtggggaggaggcttaaacttgcatatgagcttttagaaacaaaatgatcttggtaatcatctgaataatttagttaccacgagggtgaaaactgcgaccctaaaaggtgaataactctgttattgttcttcttgtgtgtttctcagtcgtcacctgttctaacttgataatcaagcttttggtgttacttgggtaaagtgagggatgggatagtggtgagccaatgtgggagtagctaattctctgctatttttatccaggaggaagagtgtagaaactctcaagaaaggaagggtccgtttttctgcagttttcaaagcatgttgtacatttttatttattaatttaatttttgagacaaggtctcgcatttccacctagcccagagtaagtggcactgtcacagctcactgcagcctcagcctcaacctggagtaactgggagtacaggctggcactatcatgactggctaatttttttgtttgtttgatttgttttgtttttgagacagggtctcactcttttgcccaggctggagtgccgtggtgagatcttggcttactgtaccctccacctgttgggctcaagtgatcctcccacttcagcctccagagtagctgagactacaggcttgcaccatcatgcccgactaatttttttttttttgtagagaaggggttttgccatgttgccaggctgatctcaaatgcctagacttaagtgatccgcccgcctctgcctcccaaagtgctgggattacaggtgtgagccactacctgggctggctttttaatctttattttttttattattttttttttttgagacagagtcttgctctgttgcccaggctggagtgcagtggcatgatctcggctcactgcaagctccgcctcccgggttcatgccattcttctgcctcagcctcccaagtagctgggactacaggtgcccgccaccacgcctggccaatgtttttgtattttcagtaaacacggagtttcactgtgttagccaggatggtctcaatctcctgaccttgtgatccgcccgcctcggcctcccaaagtgctgggattacaggtgtgcgccaccacgccggcaatctttattttttgtagagactaggtcaccatgttgcccaagcttgtttgtacatttttgacatacgaatgattgatagtttgtcatcctttaagattattgatatttttgttattaaaaaagtccaagactgggcctggtggctcacacctgtaatcctagcattttgggaggcagagacaggaggattgcttgagcccgggagtttgaggccagcctgggcaacatagtgagaccccatctgtataaaatgaaaattgtggtgggtcgagaaagttattttgacctatgtttaaaaccagattctcagcttgggcaacatggtgagacttgttctctacaaataataaaattatccaggtgcagtgctgcaggtctagaggctgaggtgggaggaatgcttgagtatgggaggtcgaggctgcagtgagctgtgattgtgccactacactccagcctgggtgacagagcaagacctgtctcgaacaaaaaccaaaaaaggttatggctgagtacggtggctcacacctctagtcccagcactttgggaggccaaggaaggaggatgccttcaaaaccagcctgggcaacagagagagaccccgtctctacgaaaaattaaaaattagccatgtatgtgccaccagcttctcaggaggctgaggcaggaggatggcttgagcctaggacttggaggctgcagtgagctttgatggtgccactgtactccagactgggcaacgtagcaagaccccatctcaaaagcaaaccaaaccagattttcatatttccccctaaaggacaggtgtaataacactaaaaggtggaaaaaaacccaggctaaacttctttgcctgcatacatatctgtgacttttaggtgtcattctgtttccttttcatctttgcctgttccttgttctgtaacctcttcattggacaactaaaatagcctctgaaacgagaaaaatctgctccattacactgccatcagagtggtcttccttaggaatagctctggatgtgccattttcctttttggaaaccttgggtaactccccactgctcagtacaggtcaaacacttcagtacagtacaaatccccttggcccctaatatggtcccaggctattatttttattttttattttattttttattgagatggaatctcactctgtcactcaggctggaatgcagtggtgccatcttggtttactgcaacctccacctcctgggttcaagcaattctcctgcctcagcctcctgagtagctgggattataggcatgtgccaccaggcctggctagtttttttgtatttttaatagaggtgggggtttcaccatgttggccgggctggtctcgaactcctgacctcaggtgatctgcctgccttggcctcccgaagcgttgggattacatgcatgagccaccgtgcccggccttatttttctacacagccaaatgcacacagaccatcttactgaactgtcttcacttacatttttgctcagtggtcttctttttgtaatggcctttagtctttttaaggctcagctctgttaatactttcttgagggagctttgttacccatttccttaatgagaattattttttctgtcttctgcttccatagacttaccatatctttcttgtcttatgcttatttgttgactgcttcttcccgtagagtatgtgttctgtgagagaatactttttcttacttaacctgtttaagtgcttgggattgaggggaaataaggatttaagaaaccatgaaagaaggtctctgtccttagcagtttactgtttataaatttcttccactgtgtttattaccaagtcactttatcattaaagcatttgattatctattccctttgaagtcaggcatgtgtcttccctactggtagatgacaatggaagatgaggttaggggaacttttgacttagtggtaggactgggattaggatctagggttttattttttatttatttttgggacagagccttgctctgtcacccaggctggagtgcaggggtgcgaactcggctcactacaactcctgcgattctcctgcctcagcctcccaagtagctgggattacaggtgcccaccacaatgtccggctaatttttgtatttttagtggagacggggtttcactgtgttggccaggctggtctcatcttctgacctcatgatccgcctcagcctcccaaagtgctgagattacaggcatgagcctctgtgcccggccggttttttttcttaaaatctgtacctgttttgaactttctccacaagcagtggcctcttcgtgtaaatatttttagggaggttggcctgtgtgtgaccattataggataagagaggagatgctgtcccctctgaggtgtggactgccacctcagtgcagcttggccgtgagtcagcatctgcttttggaatgcttcagaatgtgctctggacccgtgtcggcgcccactgctctgttctggaaccttggtcgccatccccatccagccagatcacgtattccacaccttcctgtcaggtgttcccaggactgtggggctggtttggtccttttgctgcttttctcagagatggcattgtgtgttttccgtcacctcaaactgctgccatgatctggcccttcggaccttcttccctttcccccttactctagctagtccagccagacccactcttggcatggcaggctttcccccagccaaggatgtccgcatttgctgtctgctctgcctgaatctctcctgcttgttcactgagccatgcctagcacgatgtctggtagaatgaagaagaaaccctgggtcctgctgcctccagtagttcctatcctgctgcctttcctcaggctgtatttcttctttgttccttgagtgtctttgaagtatggtttctgatgctcactctgtttgtggtcacctaccagttcactacatagcatttgctttcatgtcatttctttgtcaaatcttgcttttatgaggttctgtgatggagacagattgtctttgggaatttcactgctgaagacctgaccttttttgctagtgggctctgtgatggtgctgttggaactacttaaggtctctaaatcttagacttgtatttcagtattttaaaatcaataaaaaggggttgagagtatacttttatatgtgagtgtgtatgcatgtctgtatgctttcgtgtccattaaaccatttcagtcattaagctgatttgtcatgaaagcattcgatcttttcatcatatatataaaatatataagtataacccatatataattatgacatacaaaataggaataaaaaatgagaaaaaggaaacatttagaaacataatttctttaatggtataaaatcttttgatactaaaatattttttatttgtgactgaagattgaaagacgttttatttttaaaaatcttgtttaatacttggtgagtcttggatgaccttggtggtgttagttttggtggtcattcaagactgaaggttttgttctaagtttagtcttctgaatttttatttaatgattatcatatttgaaaaagttacctctaaaaagatccaagtagaggaaagtcatcattttgtagtacttactaaatcatgatattcccatcctccagttatgctatggcttttccttaaaacgagctagaaaattttcatcctgtagtcccagctacttgggagactcaagtgggaggattgcctgagccttgggaggttgaggctggagtgagccttagtcccaccattgcaatccaacctgggcaacagagcaagaccctatatcagaaaaaacaaaaaaagtgcaattagtagacaatttaatagaataacctgaaaaatataaagaaccatataaagccctccagcattaggctttcaggcctcataagccataatttgattggatgagggggcagtggttctaaatgtatgcctgagaattttgaacaatgacagaaggtgacaactctgaaaaattcagtttgctttgccaactcgctattggcaatactctttccataacatgggtttctttctttctttttttgttttttttaaagcagttgtttttacttggtttctccctgtgaaactacaggaaaagtgtcagtatttctgtgaatgcctacacttaaccttcagtaccctatgggacaggtgaccagcaggcagtactttttcttcctgtcccatgtagtgtttggtaagaattttgcctggtacgtacatggcagaaacataacaattttgtgtgggttgtagagttgtgcttctttatttctttattcagcccataagtatgctatttggtctgacatttttaccttttttttggctgactagcagggagcaagggctgttttgtcatctcagctagcatgctctgctttcccttgcctgtcctctagaagtccaaagttctgtgtttctgggattgcttttccctgggagtggagatgagcactgtctttgcccttcgcaggcttctagtctcctaggctgtctagagaaagcttgtgatagaatgggctgataacagtgctgattttggactatggtctaaaagacatttttgtattcataaccgctaagagaattctggagaattcttcatcccattttgcacatataatatatatatttttatatgttgtaaaaatatgtatttttaaaattagttattattattattattattatttcagagactgtgtctcactatgttgcccaggctggcatgaactcctggcctcaagcggtcgtcctgtcttgggctcccaaggtgctgggactacaggcaagagccactgtactgggccccatcacatatttttgacatcagtttttttcattataaataaagagttgaaaaggaagtgatttctgatatattgtaaatatacacttaaaaacaacaattgtttcattattcttttaaatgtatctgatgggctctaaatctataataatttgacctattgtcatacattttaaaacatgtagatgaacaagctcttatttgagtcagaaatgtttatttttcttttttcctcaatcatatttcagttccacttcccctgcaaaatattaatttaatttcatttatttttatgcttgaaaatattttattggtcgttctatcacacgtgacagaagtatacattaaaattttatttcctgttctcatgaatctaagtatttatttcttttcgattgcattactactgtacttattagtataaaattcatcaaaacaaatggatactgccgggcgcggtggctcatgcctgtaatcctagcactttgagaggcctaggcaggcagattacctaaggtcaggagttcaagaccagcctggccaacatggggaaaccccgtctctactaaaatacaaaaattagctgggcatggtggctggtgcctgtaatcccagctactccggaggctgaggcaggagaatcacttgaacccaggaagcagaggttgcagtgagctgagattgcaccactacactccagcctgggcgacaagagcaagactccgtctcaaaacaaaaaacaaaacaaaaaaaacaaccaaatggatatgttatacatttttttgaagaaaacatcttgatgagatagagccttccacccccaattatttgatgattctgtggataattactatttaatactagaataagatttttcatttgtatagatctaagctttaaggaaccctgttgacataaataagtagatggaaatggacagaatattgttatatgaaggtcacttagactcagtttttacctttaaaattatatgtcaaaatacagtggattttttgaatcaactagcttgccattcatctcctctaattttgtagaaagcaggaaaactggaaacctccagacttgtaaaaggaattgttattcagtcattaagtcattcatcttccagtatcagctcgagtattttagatcacctttttgcatggattcagagtggaggggtgatgggcctttattttgtaaagtgggagaagcctgattgtgaaaaagtatgcttgctttcatgtggctcaggaagttttcatgtaccctagtttgaagacaactgatttaggtagcttggtgtcttagtctgttttgtactgctatagcagaatacctgataatgaacagaaatttatttcttacagttctggaggctaagaagtccaagattgagtgcctgacacctggcctttttgctgtgtcatggtcatcccgtcctggaaggcagaagggcaggaggagaggagggggagggaagtgcctgtcctcgtgcacaaaagtttcaaacaagaggttccttttataaggaacccacccctgtcataacgaatctgctcccacgataatggcattaatccagttcatgatggtggtgcctccaagatgcaaacacctcccatcaggccccacttcccaacactgccacattgggcatcaagttttcaacacgtgaactttggaggacactttcaaaccacagcccttgtgttccagcccactgttgccacttacttattaagtatctgtatattcatctacagaagagggtccttacaagcccttacattttgacagttctgtaactagccttgagtatcctgtaattgttaccactggtcacacaaagtacttcttgaatctgaacctgtgtaagtggtagtcatttgtaagctttctttggtggggttctgaaagactgacatcccctgccgtttgctaacattcatctcaactggataccagttagatttcctgaaggtcctgggacccttcagtatgcttactgtcacttttaagcctttgcaggtgttgctcttttgctctttttggggcctcctcttctatgttgccaaagcatcctaaacagacctcagttacagaatttttttcccttgccctgtgtggtccttgcttgtttagtctatcttctctagactgagctctcaggatcagggactttgttttacctcactattgcctgaagctaacaagtgtccaaaaacgggaaggatgaggaggttctcaaatgtttgtagaataaccaaatattaagtaattttttttcaaactctgtgtatcataggaatctcaacatttccaatattgaactcctcatctcaccccttgaacgtgctcaatctttaacctcaccatctcagttgatgacagcttcatctttctagttgctcaggcctaaaacctcggggttatccttgactactctttatttcttctgtagcctctcaggctgtctagagagagcttatgaagaatgggctggtaagagtgttgacgttggactgtagtcttcaaacatgtttgcattcataatcgctaagtgacttggatccattcccttaggaaatcctgttggccctgccttcacaacatatctgcagcctgagcacttttccactcctttgcttctaccctggtccaggtcatcatcatctgtcagttgcatcattgcagttgtctcctgacccatctccctcttctttctttgtgtacacattctattctcataacagccagagtgatcccgtgaaaatgaaagttggataattccctgctctgatacaaccctgcagtggcttcccattttactcctagtaaattaagtctacaacaagatcgggagggccctagaaatgcatcctttgcactggctgttcattctgccagggcatctcttgatatcagtatcgttaaccaccttccctccttcaagtgttgctcacgtgtctccttctcatgatcactctatttaaaattgtaaacattagacactcaaatatctgttgaatggttgaagaatgagttactttgctcagttactgcttctaatactagttttaacattaaacctgttgctgggggatgtggatagttgtccctttgctgttcacatttgtatttcctcttggggtaccatcacctggataagattgctggcacattgtcagtcactgagcttggtcttgtaagtgtgcatgctagatggcttaggtgcctgtttagtggtgcattaaaaaaaatcaggctgggtgcagtggctcatgcatgtcatcgcagcactttgggaggccgggatgggcaggtcatctgaggtcaggaggtcgagaccagcctgaccaatatggtgaaatcccatctctactaaaaatacaaaaattagctgggcatggtggcgggtgcctgtaatctcagctactcgggaggctgaggcaggagaatcacttgaaccagggaggcggagatttcagtgagccgagatcgtgccactgcactccagcctggatgacagagcaagacttcgtctcaaaaaaaaaagaaagaaaaaatcagagagtgactttaacttaaacttttaactttaaattcgtattgtcaagctcttaaagaactgtcacctattttgtttaactcaatgctttttttttgattgaggtaagatatgctttttttattagtcaatggctacatttttctctacctccttttgtagagaaagtaaacatttgagagcagaaggaatagaatattgagtgatacatagtgtttgaacaagagaggtagtgaatactcttcaggaaggaaatgcaagctgagcgagccctccttgtctgactacagagggatgacagaagctgaagtgggcatcagattggccatttgatttctggaggaaggggtcaggagacatccattgttaaggtggaaaagcttgtgttttagacctgtcttctgggaagaactcagtcctagcctgccatgaggctcttcttgctgggtcttggtggagtttaaggtgtttttttggtgtgatagaattgaagctttataatgtgtccacttcaagttaagatagagaatccctggtttgttcagaagatgcttccttgttgaggtaagcccaggaagcttgatggagtggagaacgtgcgtgggttttggagtcagccaggcttgtgttaacatccctatttggccacttttaatctgtttcttctgaacctattcctacatctgtgaaaaggagatgatgtctggtttggagaggtgttagggttaaacgataaaatgtatgcagaggtatatacatagcaatgcttctgcagtgggccggtcacttgccggtaccgtgattcatgttctgtgcagatgtgctgtcagaacaggctggttggccagccttcccccaccccggcccccgccccagacagagtcctgctgtgctgcccaggctggagtgtggcgcgatctcggcccactgcagcctctgccgggttcaagcaattctcctgcctcagcctcccaagtagctgggactacaggcgtgtgccaccatgcccggctacttgttgtatttttagtagaggcggggtttcaccatgttggccaggctggtcttgaattcccgacctcaagttatcccccggcattggcctcccaaagtgctgggagtacaggcgtgagccactgtgcccggcctggtcagcctttaaaaatgtttttaaatagttattcattgattttaattgacaaatgaaaatatatttatggtgtgcccattaatgttttaatgtatgtatacattgtggaatggttaaatcaggctaattagcatatctgttacctcacttagtcatttttttgtggtgagaacaattgaaatctactctcttggcaattttcaagtatacaatacattgccattgaccatagtcagcatgtggtgcaatcgatcccttgaacttgtccctccagtgtatctttggtcagtcttgccgtccagttctagccagcactgctccctggcatctgtgcctgacagggtccaggaatggaggcattgatagtgataaggagcctttatagtttaagtcccactgactaatgtgagttattacttctttgctgataagacccatagctagtcagatattgggcaccctcttcctgggtcgacctttgaagtttcttattcttgtcttaccagctttctgtaggccttagcgatcctttcctgtagttaagttgtgcctttttcctaaaggagttaaggtctcttgttttgtagtaggtagttagggggagaaaaaacagtttattagcatctttttaaaaaaaccttttaattactaatagaacacctagcaaaatgtataaattctaaaagcacggttcaatgaattatcatatggtgaacatagattattcccagcaccacagaaagccctcccattgctacctctcctatcaactgtttcttgataacctgctagaggcaaggtagtgtttgaccaatatctgtgtgactctagtaacttagccttgtacaggagatatatatttgtgtgtgcacacgtatgtgtgtgtgtgtgtatatatatatatatatatataaaatgaatataaaaatctccatgatcctagcaaaatcctactgctgctgctgctgctttttttttttgagatggagttttgctcttgtcacccaggctggagtgcaatggcacgatctcggctcactgcatcctccgcctcctaggttcaagcagttcttgtgcctaagcctcccgagtagctgggattacaggcgcccaccaccacacccagctaatttttgtatttttagtagagatggggtttcaccatgttggctaggctgttctcaaactcctgacctcaggtgatccacccccaatcagcctcccaaagtgctggggattacaggcgtgagccaccgcgcctggcctgtactacttctttaatccaggtcacaaattgcagtttttgaagcttccaccccttcctgctcctgaaagaaaaggtccatgtcttcgttcattcagccattcattcagtaaatatgtgttgattacttatagtgtgtcagacacttgtgaggtgctgggaacacagcagtgcattagagaaaggccctgacctcagggagcttgtatgtttaggtctgactcatctgtgctaacccagtgcccagtgtcatggttggtgtttttaagcgtctgccaaactgaattaagtagtactccctttactggtttcctgtagcagtcattctcttgtgtcatggttagctgtttacacctctagattccaggatcctgcagtgtcagttatccctcttgtgtccccagtctcgtgcacagggagggcttcagtctgattgttgaaagtatgctaaataccaagtaaatgctacagtcataaagtgttgtcgcaggtggagaggagtcagaaagtgttaatgactatgctaaagcttttcttgctaaagtcaccagtaatcacctagtctctaaatcccgttggagctgtagattctttaccttgacttttctgtaacacttgacagtgcccttgtcctctgggaaacttttcttggtttcactgctcttggctggttggctttcttcactctcaccattcttctcagtcatctctgggcccttttctgcctatggctgtgtcatgcctcagaatccccttcttgattccctgttttttccccctccatgttctgtattctccatttgtcagtgcttcgcagattgggtatttcctgccttgagtcctttcctgggcttctttctcatttattcagctgtcactgggcatttccacatcatgttcttcaccaatgattatccagaatgagacccctaacaatacctgcctcctgttcctagccacagacctgctgctctacctgtattttctctccacacagatgtacaagacagaaaccttacagtcatctctgtcactcctgcacttccacattctcccacatccatcctgtctcctggtgcagtcaatcttgctttctgaatttctcttgaaataatttctcctcccaatccacatccatatttcttgcctgggtaactctccactgactgatttcccagctgccaatctggaccacctccaaaacattttccacattgctgctggagtgatcttttaaaaatgcaactccgatgttgcctgtccgtcgggtacattcttcaatagctcttctttgccttcagtcttgctgtcatcctgttctcccagctaagccacaggaggcttagtccctccagccttgcttcctgtcactccctctttgccttatcggtcctccccaaccctgagttgtcagcacttccagttcccagctcttgagagctcacctccacactagtgcacgtgtgttgatgctgctgcttctgatgtgcctcttttgtgtggtcacttttactcatccttcaaagacctcttgagctgtcacttcccctaggaagtgttctgtcagttgactgcaatctgaattgaggtttgcatcctgtgtttttctttctctgacaccaccccatactgttctcttctcagtagactgagtttcaggtcactgtctttatctctgtccattgtgcctagaatattgtagctgctcaaacatacttgagtgaatgtattcaagtcctttttttttttaaaccatgattgtgagattggattacctgggagttcatctgggtcttttttgtttctcattctcatgtcagaatttaagatttgaaaactgaatttcacatgtatagttttgggaaaagtcatctttaaatgaaccctacatttatggcaaaaattagggacaggactgagtttcaagaagtcgttaggccacaggttttttgagggatggcacaggcttttaacttactaaaaaggacaacttttggctgggattgatgactcaatgcctgatgactcaatgcctgtaatcccagcactttgggaggtcaaggcaggaggatcacttgaggccaggagtttgataccagcctgtcaacatagtagaaccccccatctctacaaaaaataagtaatgagccaggtgcagtggcatgcacctgtagtaggagctactcaagaggctgaggtaggaggatctgtggaggccaggagtttgagggtgacagatggagagaccctgtctctaaaaaacaggagaacaacctttatcatactttgccactttttattcttaatcagaagtaacacatgttcttgtaaaatgttgatttaatactaatggagtgcctactgcaactctcttgattccactgccttatttttttcttatatcactaataccatttgaaataattttgcacgtgtttattgtttatctcttttcaatgtatttcttttggtaatagctaatacttcccgagcactaactatatactgagtgctattctaagtgttttatttgtattaatgcctttatttcctctcacagccctttcaggtaaggtactataattatccccaatttcaacatgggaagactgtagcaccaaggagttaagtacccactgtgtatagagtgccaggtggggctggcatttaaactcttggcttcagagtccaaaaaacctactctgctctattgagtctcagtgcaagcctgaaagggcacgtatgccttctcctgcagtgcctgcacctagaacggctccctcctcgtagttgacattcagtgtggatgaacacgaggtattccaagtaagaagtaaaaataaaatccttcagcacctgtggtactgtgatataataagaaatatgtgtttggtctctgccccctcattcctggcacagagctcctaaaaccctgtggataggggcactaggagaacctcttgttctaatatgttcctgacacagagcaccctcaaacctttgtaatttcctgggtgataacagagctcctaaatcccttagaatttcccaggtgataggagcatcttttgttctaacaagataactgtggtgggctcctggatagccaggatggtggctggttgctaagggaacgaaccgcgtgattacggtgttagaactttcagccccatgcccctgacctctggggaggtgagagggagaggggggctgaaggtcgagctgatcactaatgacagcattgtgatcaatgatgcgtatgtaacgaagttttcataaaaacccaaaaggacagtgtttgaatgagcatccagatagcagaacaggtgggggttcctggagggtgactgcctcgagagggtgtggaagctttgcacccttcccacatgcctcaccctttgcgtctttttaatctggctgttcctgtgtttcctttataatctttataataaattgttccctttataataaatgggtaaacataagtaagtgtttctttgagctcagtgagccaagctagcaaattaatcgaacctgaggaggggtcatgagaaccctgatttaaaaacctctgtcagaagcacaggtcacaacctgggacctgccattggcatctgaagtatggggcagtcttggggactgagccctcagcctgtgggatctggcgctctctccaggtagatcgtgtcagaattgaattacaggacatccagctggtgtctgctgatgaattgattggttgctggtggggagaaatcgccatacgttttggtgaccagaggtgaaatattctgtgcacggtagagggtaggaaaggcactttggtttttttcctacatcttcttggcgcactcttcctcagaggttagttgctgtaatttgttttcctcataaagcttttccttttcaattacaaatatatatttatgcacagatgtagtacttataaaatgaatgttacctctcttgggaaacagactttttttcttcgcaactctttggagagcatgtcccttgaggtgtgacattattttagctgtgtaacaattaactggatctgagttgttttacatcagctaaatatcagtctccttgagatttgggaaatatttaagtctcatcagcagtattttggggaagggggtgctcctgcagacagcagctgctgttttctgtttgtttgttcattgattgattgattgagacacagtctcgctctgttgcccagactggagtgcagtggcatgatcactgctcactgcagcctcaacttgctggacccaaacaatcctcctgcctcagcctcctgagtagctggtactataggagtgtgccaccatgcccagctaattttaaaattctttttagagatggagtctcacttttttgcccaggctgatatctaactctgtactccagtgatcctcctgcctcggcctccgaaagtgttggggttacaggtatgagccactgtgcccagcattctgtgcgttctcactggctgtcatgccctgcaaagaaagttgaccaggtgcagtggctcatgcttgtaattccagtgctttgggaggccgaggtgggatgatcacttgagcccaggagttccagaccagcctgagcaacacagtgagatcttgtctctacagaaaattaaaaaagaaagtaaaaaaaattagctgagtgtggcacctgtggcctagctagctactctagagactgaggtgggaggatcacttgagcccagtagtttgaggttacagtgagctatgattgtgccactgtgctccaacattggcagtagagtgagactttgtctctaaaaaaccacaacattttaaaatttatttaatgtccctggattcctacaggtattgaattcctatgggtatgggattttgactgtggtcttttcctagtttctataactgtgctgataagaaaaaagagactgcccttttttttaaacaaaacaaaacaaaacaaaacatctggaagttggtcaagtcttatctttccttctgtttctctctggtggtagcagacagtttacctgtaggtcaagagtttttagattagcctgggatccatggataggagtcagaagggctatctatcttctgaaaccacatgtagaatttagttaagtgtgcatttcacatttcactggggagagtgtttcatgtcagatcccaggatgaggataagcacgaacactttttgatataggtgtattctttgtcaagttggcaacaaggatcctggaagctgacttgatttagggattagaacatgtttttcctttttattcctagtcccagaaaatgatatcagtgggaataaaatgagagagggcagtttggactgttcctcagtgaagaacaggggtttgcactcatcaggtggatgtatgggcttagcctgtatgcgggggcacctgttcatattaaatctcatgttgtggtgtgacagcaatgtcatgactgcctttgtccccttgtgagctttgtatcatgtagagtggagatagctcacaccctcatttaactggccagttaatgaggctgctgctgctgtgaagtgtgtgtgtgcttgtatattgttaaaaacttaacatataggttattactttggtaaaagtaaaaaaaaaaagtatatggtataaaaagacaaatcacactgtctcagtggtaccacttcctagtgaaatgatcttgggcaaagttactcgctgtgtgtcaattttcctcatcaataaaatgggtaccaaagtagtgcctgcctgtattgtgaggattgtaaagattacataaaacaataaataattcagaaaaggcaattgaaatgttttctggtatatggaaaactgacaataattatctcttatgatggtggtggtattgataacaataatgacacctagaaaggcctgtaaccaaaagtcagtagtccttctttcttcaccccagcccatttttaagaaacaaccacttttaaatcctctagctatttcttttatctccatatttcaaaaaattacattttcctaatttgcatcactccctcagcctcgactatgttaagcttctttattgactttctcttttagaagatcagatcaggtttttatttttttctagagataggatctcactatgtttcccaggctggagtgcagtggctattcacagataccatcatagcacattgcatccttgaactcctgacctcaagcgatcctcctgcctcatccttcagagtagctagggctacaggcatatgccaccattcccagcttgaagattagggttttttctttgtttgttttttgagactgagtcttgctctgtcacccaggctggagtgcagtggcgtactcttggctcactacctctgcctcctgggttcggggtttcaccatgttggccaggctggtctcgaactcctaacctcaagtgatctgcccactttggcctcccaaagtgctaggatttacagccatgagccactgcacccagccgaagattaggttttaagtgacacctcctgtttccctacacttttcttcatcttctgatgcaattatatgaagttttggttaaattggcatttagtgttaacataatgatcatatgaacattttaactgctaacctgagttgaaaaagttgggtgaaatattgtttattgactttagttatgagtgaagttaaaggttgttgtgtggttgcagtttatttaggtttattttatgacttgctcatttttctcctcagatgctcagttttaccttactggtttgtacaagcagtctggactcttagaaaatattggtggaggttgaacttcttgaagaaacgttgagcttttgtcaggtgtggtggcttacgcctgtaatcccagcactttgggaggccagtgcaggaggactgcttgaggccaggagttcgacaccagcctggccaacatggtgaaaacccatctctacaaaaaatacaaaaattagccgggtatattggcgtgtgtctgtaatcccagctactcaggaggctgaggcaggagaatcgcttgaacccaccgaggcggaggttgtagtgagctgagatcatgctgctgcactccagcctggatgacagagcaagactcttgtctccaaacaaaacacacacacacacacacccacacacacacacacacccccaaaaaccccctgagctttacatccatagatgaggagtttggaatacaaatagatgacctgttatctgtgtcagcttttgatactatctgcccttcacgtctttattcttagattgtcatctgtgggtggaaaaccttaagtttctacccatagaaataagcccaccatatttcagaaaacatggtgggtcataggaaagcactcagatgggacaacctagttggatttggtacaaaatgagccagatgtgggaaaaggcaaattaatatgattatgaaaagtaagaatgatggagctgggtgcggtggctcaggcctgtaatcccagtttgggaggctgaggtgggagggttgcttgaggtctggagtttgagatcagcttggccaacaaagtgaaacgccatttcttaaaaaatatagtagggaagagcagaggtttcttaagagtgcactcaacaaaaggattaggctgatctaataattggaatgtcagtattgatttagttttccttggtacagtctacccagagtgggggaaggggcagagcataaggataaagggggagttgtggttttgtggatctcaggtgtttaccaatgaactaggtggaggtggtcaggtggtggagagcttctgttctgagaacctgaccgagaggcaaaacattgtctctatgtagtgcttggcacaaccgtgggctccgatctgggaaagagtggactcgggaccacagcagatttctctatggggctgcagtcaatgaaattgtcctgaagcaagcctggtctagggcgttctggcctctaagattgagagggatggtggacagggcagtgggccagaggtgaagtgagatgaggaaggccaagcctttttctcctgaggaagccagtgctagggcactaattatagttttacacaatgccagcttccagcctgcatagagaaacatgaaatttctgcttaaaacagagttcctttttccatttttggctctaaactttttgtgttggaagttaggaaccaattttggagagtgattgtagtgagggaatctggaaaacctgcgaaaatggagaagctcattttaggcaggaaaaatctgtctcttggaatgagtagcagagggttttcttgctcaaggtagttttcttttctgttcttggtgtggtgcctgactccacatttttcacccagctcttaaacaggttttgctgagtagctacaggcaagtcatcttctctgtaaattaggtgtagttaataacacctgttactcagagagtgactggattaacaggtaagagtttggactggagtgacccagaaatggtatgaaatagtgagaagaacttgagatcgctacgtgtcccagagaagacaccttccttagatctaagttgaggagactgaattaaacagcctttgttcatttaaaaaactgtttttatttttatttatttattttgagacagagttttgctcttgttacccaggctggagtgcatgttgtgatcttggctcaccacagcctccacctcctgggttcaagcgattctcctgcctcagcctcccgagaagctgggattacaggcatgcccaaccacgcccggctaattttgtatttttagtagagatggggtttctccatgttggtcaggctggtctcaaactctcgacctcaagtgttccatctgccttggcctcccaaagtgctgggattttaggcatgagccaccgtgcccggccttattttttaatttttaaatttttcttagagacaaggtcttgctctgttgcccaggctggagtgcagtggcatgatcacagctgtctgcagccttgaactcctgggctgaaaccatcttcctgcttcaacctcccaagtagctgggactacaggtgcacatgccacaacatgcgactaatttttaaattttttttttttttttttttgaggtggagtctggttctgttgcccaggctggagtgcagtggcgagatcttggcccactgcaagctccgcctcccgtgttcacgccattctcctgcctcagcctcccgagtagctgagactacaggcgcccgccaccacacccagctaattttttttttgtatttttagtagagacggggtttcaccgtgttagccaggatggtcttgatctcctgacctcgtgatccacccgcctcggcctcccaaagtgctgggattacaggcgtgagccaccacgcctggcctttaaatttttttttttttttttttttttttttaatagagaatgggtctcgctatgttgcttggactcctgggctcaagcaatcctccccctttgccctcccagagtgctgggattacaggtgtgagccagtgcacccagcttaatcagcctgtgaagtcccctccaggtcacacagggtgaatcttgggaaggcagactggagattctgctccccctgttatctctgtcttgtctttagagttggtccagtgcacctgggtgtgtctgagatcatgtgcccccaggggcagcagtagtgagaaagacggttgtgaaaggcacattgtcatgatggtttttctttctgtggtttatccttatttcctggcttcgcccacaagcacagattctcagcctcttgcctttgtctactttcttttgaacatttatttggaagccctcattttgtgcccatgtttttttttcctggatctggatgtggttaataggagtgccctcagcccaacctgagtaccttgtgtagatagtctggctaatttaacattctgaaagacctccttatagcctgatgagaatcaaagtcaagctggtaaagctactgttgctactctgtgcatgccactccccgacccctgcaatatttattaaaatgtaaccgtttcagggctcaaggcttgaagctgcttatggattttttttttctttctaacacaaaggaaaaaaatgggatacatgtgcagaacgtgcgggtttgttatatagatatacgtgtgccatggtggtttgctgcacctattgactcgtcctctaagttccctcccctcatccctacccccagcaggccctggtgtgtgtttccctctctgtgtccatgggttctcgttgttcaacttgcacttacgagtgagaatatgaggcatttggttttctgttcctgtgttagtttgctgaggatgatggcttccagcttcacccatgtccctgcaaaggacatgatctttatggctgcatagtgttgcatggagtatatgtactacattttctttatccattctatcattgatgggcatctgggttggttctaagtctttgctattgtaaatagtgctgcagtaaacatatgtgtacatgtgtctttatagtagaatgatttatattcctttgggtgcatacacggtaatgggattgctgggtcaaatggcatttctggttcagcatccttgaggaatcaccatgctgtcttccacaatggttgaactaattacaacaaaagccaaaattgataaattgataaagttgatctaattaaactaaagaacttctgcacagcaaaagaaactatcatcagaatgaacaggcaacctatagaatgggagaaaatttttgcaatctacccatctgacaaaggtctaatatccagaatttacaaggaacttaaacaaatttacaagaagaaagcaaccccatcaaaaagtggagaaaggatatgaacagacacttctcgaaagaagacatttacgtggccaacaaacatgagaaaaagctcaacaacactgatcatcagagaaacgcaaatcaaaaccacaatgagataccaccacacgccagtcagaatggcgattattaaaaagtcaggagacagtggatgctgacgagactgtggagaaatgggaatgcttatacactgttggtaggaatgtaaattagtgcttatggtttttaaaaggcttccagagcaggggacccatatatttagtcccatagaacacatcccttaacctgcctcttagcatttcatctatccttccttatataagttctttcttctggagttgggacaggaggtgtcttgttatttgggtagaaaggagaaagaatgggtgggtatgtggacaaacggtgcagggaaatagatagcatgggaagtgttgccacagctctatggaaactacttggatattatgattaatggatagtcaaacatctctcaaataaatatcaaagagtgatcttcccttaaaggttattgttcccaagtttatccctctcttggtgccctggctctggtttcttttcttctaagttgcccctttgattacttgtcatgtgaatatcaaggcctgatccttcctctgtgtgagctccaaggggccgccttccagtggagctttgtagaatcatatgtgtcatagagaacaggttttaatgctgggctgctgttaggctttagcgctagtgctgagaggccccacaaagagctgaacctactgatgaggcctctcccaaatctaatcagagatgggggaaaatttgggtgctgggaagagcagatcatctcagtgattttaatgcccacctttatttgcaaagtgaaaggagaaatatatttccctattgcatttcctacccttcacttgtcaggcatatttgatatttttttttttgttttcatttaaaaaaaattccaaaaacaccatgtcaaatatgtcaaatatttattttttaaaaagtaggccaagtattaatgtctttctgctaaatctagtgggttctctctcacccacccccgctccaaccaggtgtttgcagaaaggatctttttttttttttccggaaaggatctttatccagaaaggaattttaaacctcagagttaagttcttcttcacctcagtgcttccctcactaaacatcatccttacccagaatgtatttcatagagtgttcctctttccatcctttgatgctttatgacccatgaaaataatgaaaagtatttgtttcgggcccctagtattaccaggtttaggtactattgctatcctgcatctttttcattcttatctctgtgctgtaattctatctcccttcttgagtatttcacaactggagacaagtgagttatcttccctagaactcttaacttaccctaagtgtaaggctctggatagacactcaagggcttttggaatgtccactcatgggagcagctgtattttgttgctagaatataaagacctcatctttcaaaatttctttcttaacagttaacagttttagattcttggatgctgaatgttcaccagttctttcaactagatctgtgtagtcagaagtccatgctctttgggaagtctgagaaactttaggtgccattcctatctcctctcattttggggttcagattgtgaggcagaatgcctgttgagactttctgagcgcataggaagcattggagcagtgggatctggagtggcttcaccaggcacctcagagcacagtggcaggctgagaacgtctgtgtgatctcacacaaaaagactgtctgggagttggaaaccactcctgcctgtgtgttacttcctgctgctggacgtatgtgtggtatttggtgttgccacactaggtgggggatggagaacaaattatgtctgctccttggatattagttaacctcattcagatgattcttgggtgtcccatggggaagtaaaccgatttccctggttttgctgtaggacctgattagtcacatactgcagagaaccaacatgtagcataaggcgccattgccagcctgaccagtgtagtagggaactgggtcccacttccgcagcccccagccctgtcttctagagttagactgtacattgctaactaggcttccttttttaaaaataaataaataaataaataaataaataaataaataaataaataaagtgagtgtgtcttttggatctcttcagattagaaaaaaatctgtatttgacttttcctatgtttgttctgattttgttcagtcctttacgctgaagcagctcccccactcttcccacttaactcctatcttacttcaccatatcttttctagtccatgaatactaccttccatgctttattctggtcctctaaatctttcctttatacttctgtttttcctgccaatccccaactcgtacagaaccctactgtaggagaacataactgagaagaatttaactgggtttgaataattaaataaattcccatacgaaggtataataaataattttctagatactttgtacacatgacactgaaaagagagggacatattctgtaaagtagctcactgggggaaaattaccattgctacattttcagccttaaattgtaaggagtgcagatggttagccagcctatgtttctcccacccaccttcgttttaaactatcctaccctggaaagatggatgcttataaaataaatgaaaaagactttacctttagaatgacatagattgtgattgacaggtccaggtagctcttgtgtatgtgaaggggagttatataatgtattaggctttcttaattcattccacaaacacctattcctagttcttgtctgaatctccatttattttgcagcaaagatgtccccaaataaggtgcttatatatagcaacagattctacttccttacattttgtttcaggacagctcacacagtttttttaacacatttcaatgggcccagaatccatcgtggtaggaagtaaaactgtttttacatatatattcggtcacttcccagttttttcttttcttttttttttttttttttcttgcaagctccttctgtctgggctgactgagacccacataacatctcagccagctgagttggacattcccgggtttctgttggtgtctgaatatgtgcagagcagtagaatatgtgctacttgaatcttgctgtgcgtgagctgctggaagtcgctgtgtctgactagtgtgtagaagctggggctacctgtgatggggaacatgaatattcgaggagcacaggtggatgtggggtggggacgtggggtgtgcatcgtcacagagccagcctggccctctggagagttggaaccctgtttccttgtcctggccaatgtgaaaccttgggaatagttgcagagtagagaaatcaaaatacacaatctattctctgcttggcctttttacgccctggtgcagattgactaacctgtggtttttgatcatctctggtccagcggttgggaatctgtgctgtctatagcatctgagtgttgtgagaataaaatgtgaaaataggtatgaaaatatatataaaccataaagaatttccccatgttaaaatgatgtgtgtcttccagtgtagaaggttttatcttttctatatctgtatatataaaaaacatttattacatattataagatacatatgtctgcattcagatgataaaactaaggcccggaaatgaaagtatcttcccaagctcacacagctaatcagtggcctagccagtgcttgaatcttctctttgaattctgatatctagtaagctgagtggggcccattgaagcagtagccaaattatggtactaagtaccgtctgatacattaatttattcagcaaacattacgtgcctgttgtatccccagctcctggtattttgggtattaggtgattttttttttttttgtcattaaaatttcctccccccacccccaccccacaagtaacttgtaatgagcttcagaggcatttagctttaaaacaaaaatcttcctccctctttttaaccacactacccttggttcttagtttaaaaatttagttgacattcctgtgtgtttttatcttgcaattggccggagggttatttattaggaaaagagattttgaatgatttcagtaagtgaactaggagttgtgatacacgattatattaaattgcttatggttagttttccaggaggtgatttaattgttcaccttcctaagtcttcagtcttaggcttatccagtgggagctggaaagctttaataggcaagtttattggaacacacttccagagtcaaatgtcactcttggcagctgcagatgtcaactgggacaagtattcagagcctgagaattaaggatatgtgttaaatatggccctcataggcggccccagggtttttttttttttttttttacttttgcgaacatgttgacagagatgaggctcagaaggcaggtatacatgtgccttgtcttcattctctgcagagagaatgtttttaggggcttgggaaagtatttcaactcgaagaaaggacttatagttactagaatcttcacatctgctttctcgagtgaccttgagtcaaccacagtcttgtggggtagatggtattattcacccctcttttgttacatattaacatgacaaaactaagactcagagaggaagtgccttccccaagcacatgcagctagccagtggcacatccagtacttgaacccttttctctttgaatcatgctttgtactaagctgatcacggtccactgtagcagtaggtgacttatggtactaagtaccatctgatacattaatttattcagcaaacattgagtgtctgttgtatctctagtacctggcattgcaaagatgagtaaggcagtagacagataactgacataacccatgacagtgcagttgcgtaagtggcatgatctggagtgcagagtactgtggggacacccatgagggagccacaattgcctggggtagggagttggaggaggcagatgacaggaggtaatgactgagctggagctggagggatgagcaggagttaggcagattgcaaagggggtgcgggcatgtgctgggtggcatttccagacaaaatcggagggcttggaacagcagtgtgtgctcacacctggtacgtagcaggagtgagaggcaggaacagcagtttgaggcttgacagccctgtgtgcgaagcgaagcatttgaatgatgtctcattaccactgtataccacatgtccttcccctgcagctttggctgacatctgtcattctaccctactcctgttggccttactttctcccttttacccctctcaacgtttgctttaggctgtcagtgtttactgcaccccataaaaggttagatcctcccaccaggcctgatctgactactaggagagactgtctgtatctgctggagggattgagagaattggtacagaaggagttttgtggatcatgacatctagaattagcactctgagaaagagggagtaagcatggtattaggattggaaaaaggtttttttcctttcagaccattacaaaaactcatgagttcaggatgtatcagttgtgtgaataaggtggatgtttgaagaccccactagcatgtgttgagtttacagccactgtgcaagatgcatcttaaagattgatagtctgtgcacttttatcccgaggtgtgaggtactggacctctgtcataggggagagagtagaggctcagagaggttaagtaacctgcctgaagttgctccaccagtaagatatggaaccaaggattcacatgtgggctggccaacctcttcatgccctgtgcctcctatgtgtgtaggtgggtctgtcactactgccctgggtgtcctgcagaatggctgtggttcccagtccacccccttgggagccttgcctacattagctcgatttgctgacaggtgaacaaacaagcaaccagctgctctgataggcctgggaacttgtccccggagagaatgcccaagtccaggaaggttatgccaggtcatgaagcagaagtgtctggacatgtcacacagtctgctgagccagcagtgcccacttcatagccctttctgtagggcccctgtgttgactccctgcatggtactcgtcccttagcccaggagaggccccatgggaggagggagagttgcagcaacttctggaccctgagccataggaacttccccttcccaatctctgagaagatgttcacagtgacctggccagggtcactgcaagaaagaaaatggaatgctgatggggcaagggtgacagggaagccaggcattccagctgtgttcaaagcagtgacaatgactgtgggagcgggtcctgttttatatattcatcattctgaggccttcagggactattttgttagctacataagtgttgaaagggctgcgtaaaccagaaatcaaattctgtagattggcatctgctggataaatcttctgctgggattgctacaacatgttgaataaccgtgtgttttgaagaatgaaaaagataagacagttcactgagttgcaacgtttatgacacagggaatggaggactgtaattaaatctacataaaaaggccatgttttccaagtgtactttgaacttggggcaggtgttctgagtgggtgggtgcatcatctcatttccccctgcggaggaggctgctggcaacctgggaatggaggttaacaccatttgttacccctgaagtttctggatgtctagaggaggacccccttcctgcgccccgcccctccatgcaccagtccagagctgtggtctccttcctgtgttggagactcgctgctggtcctccgctggtgtctgagttggttaaccttaactgaaccccttaactgaacttttcttgttacatgtattccagctctcagtgaagtgacattctgccctctgggcccagatccctgaacccttccctgcatttcagacctaaatagcaccctgtcagaaagatcagtggggccgggagctgtggctcacgtctgtaatcctagcactttgggaggccagggtgggtggatcactttgagcccgggagtttgagaacatcctaggcaacatggtaaaattcttgtctctacaaaaaaacccacaaaaaattagcagggtgtggtggtgcatgcctgtggtcctagctactgggtggggaggagtagggggaagctgaggtaggagagaatcacttgagcccaggagttcaaggctgaactaagtcatgagtgagaccctgtctcaataagatcaatgggttggaagtgaaagtcccttcccaaactcaactctggggaagaagctcttgccttctctggccctcccctgcccaccttgtccaccctgctttgcccatcacagcaggcctcccgttccactgcaataaccctccccactagtctccttgtgcgggaccagtctttactcttctttgggttgctgtttgcgtcagggctcacagctttgaaggaggttcaagccaccatcatattttgctatagtccagactgctggacattgatcagtcctctgtccccaccttaaccctgtgcacgcagttgcactgcggggcagattcaagatgctcaccctgtgtcccactgcttgttttcaggctgtgttgatcacacctgcctgctgcctttcaggatcaccttcttagttctttgtatccacctttgtccccaccctccacagccttgtcttgaaggccacataccacacctttgaagctgccctcttcctgttgaagccttccttgcttttccaattgcttttctactgttgacaaaagtagaggggactgtgacctagggttataattcatctccctgcagttgtgcatgatgtttgtgcagagtgaattcttttttttttgagacagggtctcactttttgagacgggcctcactccagttgcccaggcgggagtgcagtggtgcaattgcagctcactgcagcttcgacctcccaggctcaggtgattctcccacctcagcctcccaagtagctgggactacaggtgcacaccaccacacctggctaatgttttgtatttttagtagagacagagtttcaacatgttggtcaggctggtctggaactcctgagctcaagtgattcatacgcctcagcctcccaaaattctgggattacaggtgtgagccacagcgccccgccccagagtgaattcttaaccttatctcatatctattcgctattcttgactcccttgtttctattataatccttagagccgtggtggtcaactccaagagagtaggaaccaagtctgcatgatttgcctaaaatacttgatactttactgggagtaagtataatacttgaaactgctttgttgagaaaaataaaagaaagcatctgtccagtctactataataaaatagcttagactgggtaatttataaacaacaggaatttatagctcacaattctggagtctatgaggcccaagttcaaggcaccagtagattcagtgtctggtggggggcccattctctgcttcatagttagtgccttttatggtcttcacttgatggaaagggcaaaaggtatcccccaagtctcttttaaaagggcgctaattccattcatgagggctgagccttcatgacctaatcacctcccagaggtcccacctcttaacgctattgatacgtggattaagtttcaacacaggcattttagggggacacaggcatgccaaccttagcagcaacttttcatataatttgtatcctaaaaacagtaaaactcggccgggcgcggtggctcacgcctgtaatcccagcactttgggaggccgaggcgggcggatcacgaggtccggacatcgagaccatcccggctaaaacggtgaaaccccgtctctactaaaaatacaaaaaattagccgggcgtagtggcgggcgcctgtagtcccagctacttgggaagctgaggcaggagaatggcgtgaacccaggaggcggagcttgcagtgagccgagatcccgccaccgcactccagcctgggcgacagagcgagactccgtctcaaaaaaaaaaaaaaaaaaaaaacaaaaaaaaacaacagtaaaactcaatagctctggtttattgactgtttattacatgcctgctaagataggcattccctacctggccattttacagatgaaggaactcaggttaaaggaggttaacaaccttgtccaaggtcagacagcacatctggattcagacatcagcttgtgtgacttaagcttatttttctcttcaccatgccagtcctgcctctagcaaaatacacgcagatttcatgataccacttttaatttcagcaaattatgttatcattttcaattaactgataattagctggcagtccttggaaggtagaaggagttctgatggaagccctcatcgttttttattctttcatgacttccacttgaaggtccttgcttactgaaatggaagccataagtcctctcgtcacccttggtagaagggtgctaaatcatccttgctaaatacttgacggaaaccatcagtcatctcgtttggctctcatcaatctctttgttcatatgcacaggctcttaatctctgttttccctttctttagagtaccgtagtctcagatgataaacttctctgaagctaatttcttcactgctgccctggagtgtctcttcatgctgcattctaaacaagtgaagagcaaagttgctcttggtagggcagccaggttcaggacagtgctgcttccagatcagaaaacatccatagggtgtagtctggcccacgcttgatgtaggcacaaggcagaggcgaatgaagatcatgggaggtcctttggtgtaaaaaccccatctgcctggagcttcaggattagcagtgtttcacagcccgtctgaagtgccagcacttgggaaaacttacaagagagatgtttgggaagtatttcaagcactgctttgtgtccttaaggaacagtgagtgaatggcccgttgcaggctgagtctgatgtcagtttttgacttccgtatagtagtacatcaggtggcagctggctgcaacccagcctccactgactttagagccagccaagtgagttctagtttcagcccacaggtcttatgttgttgccgagggacctttacaagacacttaaacccttagtttcctcttgtaaatgagaattttaaaaagttcccgacacagagagagaggccatcaataaatgttggataccttccctttcacttccctgtttatggtttttgaaatttggaaaagaagcttgtcagatctgtgtgtagaaataataaataataggacttccctgtgtagaaaagaaaaactttattttttagggattttgttaggcatttgcctacttagagatcgttctgatggtcttgttctcaactgtccccagccagatggggaacataggaaacctattatgtgcgagccaatgggtccagagaaaagagatagacagctattgtgatgtctatcagaggacactgtcttctcccgtgccaggtgccaggtgtgctgaagatctactttgcagattgaccccataaggatttatgcacttgagggctcatctctggagacacatggaaaattagcaaggcaaaagtttggagtaaagatgtctgcacagagtgggcagcttgtgtgttggagaacaagccatgttggccatttgttgtgaatggcgtgaggaaaaatgcttcagaaacatagacttttctggatctgcaagcaccagcatttttggtgttcttttttacttcagttttagatttgcagcagtattattgtttcctgattttgttaagcagatcttcagtatttcatcagcagtatgggttaagttggcattagaagctatgctgggaacctaatcctcacccgtttgtctgggaaaatgtgtttccgtgttgcacagtgagtgaactttttgatggcagtgtgtttgtaagttggggactgcctgtagggcattttgtaaagaagagaacattcttttcaaaccaagggcttctgagagataaagggagttgtcattggaaccacatgctaaaaaagcatgcttgaaattagttttgattttaccttagtacagttgagctgaaataacctctagcagggtgctctagcaatacagaatattagtagtagactcatggaggtcatctagtggtttctgatggagagtttacagactgatttggtttgtgatgaaaattacattctctgaaatttatatagaaagcatgtattatatatcacttatataacgtatttgttaaatatggcagtcaccttatgtgttttataaaaagtcatgtagttttttagtagttcctgccttattttttttccttcttttcttttaagacggagttttgctctgccatcttggctcactgtaacctccacctcccgtgttcaagtgattcttctgcctcagctttccaagtagctgggattacaggcacctaccaccatgcctggctaatttttgtatttttagtagagacaggctttcaccatgttggtcaggctggtctcgaactcttgacctcaggtgatccacccgccttggcctcccaaattgctgggattacaggcatgagccaccgcgcccagccgggtcctgccttatttttcaatatccaggtacatgactccaccaggtcctaggtctgccacctctttgtgccttctttggcttttgtgatggtcacacccagggtgccaagtgagaacagtttttttttaaatgatatttcagaaacaaatgttttattaattatttttataggtatcagtatattgtgtatggggtttaggatttcacctcattatgcttcagcctgattattgggtatacaaaaagtaattagaatagaatagtataaagaagaaaaaactttcatgacccaaacctaaccattaactaatagttaacactgttacatttctttctaaacttcttaaaatgtatgtatggaacttacatatataagtaaggttttagacaaaaaggttttggataaaattgagattttagttttatttattttaatttttattttttagagacacagtcttactctttcactcaggctggagttcattggcatgatcatagctcactgcagccccgacctcctggacttaagtgatcctcccaccttagcctcctgagtgtccaggactacaggggtgagccaccatgcctggctaatttttattttttctactttttgtagagatgaggttctcaatgtgttgcccaggttggtcttgaactcctggcctcaattgagcctcccatcccagctcccaaagtattgggattacaggtgttagccactgtgtctggccaaaattgagattttacacacacacacatgcacacacacacttttggtaacttaatgtatactgaacatctcccatattaccaaatattcttttcaaatgtcctttggtagctgtacacatcacatcatatgtgtagtgtactaaaacttaacaacccccattattggtgaccatgtagtttgttaatccacttttgtgcaatgacgggcatcttcctaagttaattttttgttgttctttaattatttccttaggataaattcctagaagtggaattcattggttaaaaggctagacatttgttatactcctgccaaactggtgtgcagaattcttggtgcttgctgttggtagcactgtgagtagtttcccagatgtagtgtgttgcaggggtgacagtactgaaaggccctccaccccctgcaaagcatggcaagtgcagcagcaagatctgcggtggcaaaaaccaggaagacagtcattcccatcatcttttgacattgcttttttccccattttttaggggggacaattgatgttctttgtcaattcaatcatatttctttctttttttaatgtacgaagatagacttcctatattatattgcctttttaaacatctttcccacacaaaaaagagagctaccgacagactgtccattccgttgcactaggacgctcttcaaacaaagccggtaccttgaggagacagtaaaggaggtctgaaatgaacatgccccgatcaccagccaagcactctgatgacagagcttggaagccagggtctggggtaagctaactaggataaccacagtcgtaacgaccaattacagaagaacactcgcacaatgagactttgctttcatcaacagtgacagaactcaggccagttcttttgattctaaaaaggtaggagatcaaacccaatgcttaccacctgctaagcagaaagatctgatccgctttcccaaaccagttatttgttgtgtggctggaaacagaagaagggctgcctaaaactgagtggtgggctaggtagtacggggaatagggagaggaagaaggggaggagcagggagcaaaggtactttcagggagcagtattttaagtcttcctggaagaggaagttaactgggagactggagtataggctgtgctcttagcatatataccgggaagtaaacacctcttaggaggctggcttgaagttgacagttagtaatgcaagctattgattttttttgaaagtatttgttaagagtgaattggtttctataactgtgaaaatggctgtaggacaacgtttcccctgcccaattgtggtttcagatgctacttttcaccactttgaacctggaggacatcttggttttagagactctacctgaaaaatgtaacttaggttcattgtacttttattgagggcttggcactggaataagtgttcacagattgataacataagatccctgcccttgatatattcagtttagtggcagtgagaggaataataatataaatagataattttattattctggcaaaatatacataacgtaaaatttattttcaagtttacagttctgtgacatgctcatgttgttatacaaccgtcaccaccatttatttcccaagctgtttcatcttctctaacttaaactctgtatctgttaaataataattcttcctcatccccaggccctggcaaccaccattctactttctgactcagaattggactattctaggtactttagttaagtggaatcacacagcatttgcctttttgtgattggctgattttacttaatataattcctcaagactcatcgtactgtattgtatgtcagaattgtctttttaaggctacgtatcattgtatgtatatatcaatttattcatcaataggcactgggttactttcaccttttgactgttgtgaataatgctgttatgaacatgagtgtacaaatatacacatacctcggagatattgtggtttcagttgcagaccacggcaataaagtgaatatcatagtaaagtgtcacacaattttttgtttcttttccagtgcacgtaaaagttatgtttacactatactatagtcaattgaatatgcagtagcattatgtctaaaaaaattgcagagaccttaattttaaaatgctttattactaaaaatcgtagataccttaagtttaaaatgctttattgctaatggtcatctgagccttcagcaagttgtaatctttttgctggtggagtgtcttgcctcgatagtgatgccggaaggctagggtggctattgcaatttcttaaagtcaacaatgaagtttgccacgttgattgactctttccttcatgaaagatttctctgttttatgtgatgctgtttgatggcattttgcccatagtcaaacttctttcaaagtgggagtcaattttacctttcgacccagcaatcaaaaaataaaaaatttaaaaaaaattaaagtcagtcctcttaaaccttgccactgctttatcaactaagcttatggaatattctaaatcctttgttagcatttcaacaatgcccacagcattttcagcattagattccatctcaagaaactactttcgtaagaagaaacttgttcatcataagaaactccttatttgttcacattttattatgagattgcaacaattcagtcacatcttcaggttccacttctaattctagttctcttgctgtttccactacatctgcagtgacttactccactgaagtcttgaacccctcaacatcatgcatgaggcttggaatctacttcttccaaactcttgttaatgttgatattttcacctcctccaatgaatcacaaatgttgttaatggcatctagaatggtgaatcctttctagaaggttttcagtttactttgcccggatccaccagaagcatcactatggcagctgtagccttacgaaatgtatttcttaaataataacttgaaagtcaaaatcactctgatccatgggctgcagaagggatgttgtgtaggcaggcatgagaataacattaatctccttgtacatctccatcagagctcttgggtgactaggtgcattgctgatgagcagtaatattttgaaaggaatctttttttatgagcaataggtctcaacagtgggattcaaatattcagtaaatcatgctgtaatgagatatgctgccatactggctttgttgttccatttacagagcacaggcagagtagatggagcatacaagggccttaggatttttggaatggtaaatgagcattgacttcaatttaaagtcaccagttgcattagcctctaacaagagagtcatcctgtcctttgaagctttgaagtcaggcattgacttctctagctgcgaaagtcttagatggcatactattttaatagaaggctgttttttctacattgaaaaaatctttagtgtagctaccttcatcagttattttagctagatcttctggataacttgctacagcttctacatcagcacttgccgcttcatctagcacaatatgttagggatatggtttcttaacttaagcctcatgatccagcctctgttagcttcaaacttttcttgtgtggcttcctcatctttctcagccttcataggattgaagagagttagggccttgctctggattaggctttggttcaagggaatgttatggctggtttgatattctatccagaccaaactttcttcgtatcagtaataaggctgttttgctttcttatcattcatgtgttcactggagtggtacttttaattgccgtcatgaacttttcctttgcattcacatcttggctgactccttggcataagaggcctagcttttgacctgtcttggctttcgacatgccttcctcactaagcttaattatttctatccattgatctacagttagagacatgtgactcttttacttgaacacttagaggccattgtagggtattaattggcctaacttcaatattgttctgtcgcaggaaatcatagggaggcccaagaagagggagagagacagtggaatgccccagtcagtggaacagtcagaacatgtacattaatggattcaatttgccattttatatgggcgtggttggtggcaccccgaaataattacaatagtaatgtcaaagatcactgatcacagatcaccataacatataataaaataatgaaaatgtttgagatattgtgagaattaccaacatgtgacacagagatacaaagtgaacacatgctattggaaaaatggtattaacaagacttgcttcacacagtgttgccacaaaccttcaatttgtaaaaaaaacgtagtatctgtgaagcacaataaaatgaagtatgcctgtatctacttgagtttcaactttaagttcttttgggtacatccccacaaatggtattgctgggtcatacggtaattctatatttagttttttgaggagttcctatactgttttctacagtggctatacaagttcacattcctgccagcagtgcacaagaattccttttcctcgcatgcttgctaacatttgttctttctagtttctttcttaaaaaaaaaattgccatcctaatgggtatgaaagagaatctcatcatgggcctttttttttttttttttttttttaaagagatgggggtcttgctctgtcactcacgctggagtgcagtgtgtcgtgatcatagctcactgcaggctcaagcgatcctctgcttcagccttccaaagtgctgggattataggcgtgagccaccaccagctaatttttaaaaacttttttgtggacgtcttgcagtgttgcccaggctattcttgagctctcagcctcaagcaatcttcccaaagcacaggaattatattaattatattaataggttgagccactgtgcctggcaaaagttttaaattttgatgaagtccatcttacttatttttttcttttgttgcctgtgctttcagtattacatgtaagaaatcattgccaaatccaatgtcaaagtgctttatttttatattttctcctaagacttacagttttagcccttaagtttaggtatttgatctgttttgaggtggtggtttcttttgttgttgttgtttgtttctttttttgtatggtgtaaagtaaggaaaggtctaacttcatttttttttttttttttttgcatatgaatgtccagttttcccaataccattagctggacgataattttaatatgtgaatgaagatacttttgctcacaggagtttttgagcctcagtgtctggctacagggttctcatttgaatgtccagttttcccagtaccatttgctggatgacaattttaatatgtgaatgaagatacttctgctcacaggagtttttgagcctcagtgtctggctacagggttctcatttgaatgtccagttttcccagtaccatttgctggatgacaattttaatatgtgaatgaagatacttctgctcacaggagtttttgagcctcagtgtctggctacagggttctgctttaatatgtaggaggaagagattcaagcctcttgctccattatgggtagacagcacactacagggagcttccctgagggaactttctgtgtactgtttcctagaaatctgtaggaaccatttcaagtgacgtggaaggaggttatcaaggtaggattagaaacatgtatttattatgctgcttactatccagtcttcagttatatatgtgttattattttacagaaggcttcattggacaaaaattccttgttagtcttttttttcgagaaggagttttgctctgttgccccggctggggtgcagtggcacgatcttggctcattgcaacctccgccgtccaggttcaagccattctcctgcctcagcctcccaagtagctgggattacaggcatgtgccaccatgcttggctaatttttgtatttttagtagaggagtttcaccatgttggccaggctggtcttgacctcctgacctcaagtgatctgccagcgttgcccctcccaaagtgctgggattacaggggtgagccacctcgcctggcccctgttagtgtttagtatggtttctttttgtgtagggggagtgaattttttgtgtgtgcgtgtgcgtttgcttattgtacccatttctcatggtatggaaaaaaacaggatttcatactcttaacaggataccctgcacaaggtgggaaaatatacctcgtgttttaaagaaaaatagtttaacaaatggctttcatctgggttgtactccagacttgctgctgcttcatgcttttccaattgtgccacaggcctgatcccttagcatgtgtgcagctgtgggctagagggttgaaagcaggtcctgtgtctctttcctggtgaactccacagggacacagctgcaggtcttttgtaacgctctgtatatgcacaggaagtcccttacaacccactctgttagatctcatttcctcttcggttatttgccctctgtggtctctgggtgtcagcctggcctgccttttcagggttcaaggagctgctggattggtgccctcttgtggtctgcctttgatgtggttgggatcttgggagctgaaggcaaagaaaggacaagtgagctaccgaggagtaaggaagacatgaagttgagaagataacagagggaagttaaaaaaaaaaatctttggttgaggaaattgtttctgaatataacatgataaaatcagtttaggttaatcagtttaactgcatcaataaagaatttctttgcaaaacactacttaaaaagacagttaactagaaagaatttgtgaggcaaatgagaaatggccagtttccttaatatataaagagcttttataaatcaataagaaataaaagaccaataaatcaacagagaagtgaggacaggatatcaacaaaccagttccagaagaacagaagccttttaggcatatacatagtcttttttttttttctctttttgccggctgctctagccagtttacttattttttatttttatttctttgagacagggtcttgctcttgtcacacaggctggagtacagtggtgcaatctcagctcactgcaaacaccaccttccaggttcaagcgattctcctgcctcagcctccgaagtagctgggatcataggtgtgtgccactatgcccagctaatttttgtatttttagtagagacggggttttgccatgttggccaggctggtcttgaactcctgatgtcaagtgatctgcccgccttggcctctcaaagtgctgggattacaggtgtgagccaccatgcctggccgtcttttaggcatataaaagatgtttaccctcacttaaaataggacagcaaattaaacagaccaaaggttaaatatcattaagagtgagggggaaatagtacattatatataaattgttgatggtgggggctagctgggcatatatatggaaattttaaaaaatgcagattctttgccctagcaaatccactactggaaatctattctacaaatatatatgtatatccatacattaagttcattttagaaaaagttgagacataatttatgtctgtcaatggaggactagctgcagttccttcatatagtggaataccttgaagcccttaaaaaggaggcagtcttaaaagtattgacagtataatctttgagatatataagtgaacgaaggtgcagacagcgtgtattagtgtctgtgtttgaaaaaaatcattcacacatggttttatatgtagggactgcctctgaagggatgtacacgaaactgaaaacagtagctgccagagaagtgatcagcaatccggctgggagatagagtaggaaggagacaggctttgtgccttatactattttgtaccctgtgaattttgcatcacgttggagatgcaaaaagcaactaccttgaaaagggcagtcgagatcaagtggagtaagatatttattcagcgcaatgttaattataaaaagtaaagtaagtagaaagaccagggtaggaactaccgaaaaacaaaccaacgaacagaaaagaaaaccaaaaaaacccccagaatttcatgtctggttttaggttgccacaatttaataatgaagaagggacagattatagaattctgagatagagaatagcgagatacaataaaatgtagttatcttaaaagaagtcagtatgcaattgattgaatagacttcacccctcactggaggaatatcttgcccacatagggagggaagaaactgatggccaccgtcttggacacaagctaccatgcatgcatataaacacggaaaaatgcttgccaaaatggtagctacatttatttctagcagtaggacttagccaatcatttctgtctttgttttacctacttgtactttttagaaaaagattattacgttcattttttaataatgagaaaaagtgaagcttcccatttctgtgtgattctttatatcttcctgaccttctcttttttcacttcttgcagtgtgaaaaccctttctcccgttgggctgtcgtagttcatcatcagtaaaacctccatattctcaaccctttcttttgagtgtcctttaccttttctgtcaaaaacttgctctttcctgatttccctgtttttcctgccaagcctcaggagaagcttttcccacatgctgcttatctttgggccttagtgccgagacgtggggggtggtgcttccttcttacttcctatttctttcaaaccattctccctccctccctcctgcctaaaacaccagctttggatctcacatcaccagagccactcactactcctgagctatttctctgtgattttatctcctaccttattgtctctttctttccagtatcactgcttcctttagttcttggcaatttcagtgtaaacataggtaatgactttagccattgtctccctctaccttagaccttatcattaccagtaattgcagtcctccataaccttaatttcatgcatcccatcctctgaggacaaccttctattttatgaatttacttctctactacttttattttaaaaacaaaagagacaggggtagatgggaacttgatgctgccctcataagcactgattctctgggctccacaatcacctgggccatttcctgggccacccagcctgcttcttgagggaatgctttgtgatttgattgtttatagatgttatgctagacccctgttgactccaatagggatgacaccatgtttgagagactgaagaaaagacccggaggtatcaaatgagacatagggtttatttgggggactcacgtacagagccgtccagtggcagcgggcttggcaggaagcatgctgctaccttttgtaaaaaacatgtagctcatatagcattttcatttagcatcctccccctggcagcctcccaaaacaaaggtctccatcccctgcgttaaaagggatagggcagggatttggatgtctttaatagacaaagactgaatctccaggttggccactctcagatttcttagcctggaactccaaaccaacactcttctcattcttaggatatgcttcagttatggctatcaggtgcctctgccataaaacaggaagattttttttttaacgtaagaattccttttcttccatctataggttgttaaaatggaagatttgttttaccgaggacatgaaaggcattgcagttgcttgggcattctagaagagggtgctgtcctttgccctggtgttttcttaggtggctgtggcaggaacactaactcttaaggaaatggatgctttttctttcctggtacataatgtatgaacactagtgtgttgttttcattgtgtagtgtggtttaatagtatgataatgtagttttgtgccgttttatagacgtgaagaaaataaaactaatgggcatgaattgatgaagttttcaactgagttaccaaaaaaaaaaaaaaaaagcttcctaatggactttcctggaaagatttgtctaaatgaaaatttggtggatcttaaagaagagaataatttttattgaacatatagtttgtgctagccactatcttaggcatgtagcttattaacacttatggcccatttgtggaacaggtatggttacctgcagtttaaaacaaggatgccagtgttctaagaggttgagttgcccgagatatcactggtatgttagagtcaggaatcaagccaggtcctgtgtgccctgcccagcctgactttaaaggactatgtagggaaactctctgaaaccacatttttcctttactctcacaccacaacagttaacacggaagacttctgtgaccgattgtggtgagagaggggggatttcctcacacagcaaggcacagacaccagttgagtgtcctccaatttacttgctacactatttacctggagatagtgtcaaatcccacaggttggaaactcaagtctctaaaactgcccctgccccctgcagacatgcaaacctgagcctctggaacttctgattgattgacttcaagtcgaggttcccataaccccctcttagggtttgattaatttgctggagtggctcacagaactcagggaaacacttatgtttactggtttattataaaggatattttgcaaaggacacagatgaagagacgcacagggcaaggcatggggaaagaggtgcggagtttccaacccctcccttgtgtgccaccctccaggaacctccaggtgttcagctatccggaaactccctgtacccagctttcttgggttttttggaaacgttccttcctacagtgcttagccctctcaggggagggtttgagacccacaatctgaaaggtggggaaagattagattcctgcctcgggccaggtgaaaggaaggcaggaaagagattctgtttcctgacccaacattatcacaaaagactgtaacaagggctgtgggagttatggaccaggaacctggttgaaaaccattataaatcataacaccacaaggacctatattttgctttttaggacattgtagtaggtgggtagttttcatcctcttgctttttaaaatctatcttgcccagaagtttattgggcatttctatggaaacacaacacctctcttaaatggcagtttcacacatctgcagcctagtaattgctactcattttgaagaccctgaagcacaccactggatctggaagtgacatcttcgtcaccaaggaaacagtagattaagtcctgtgctcagtatagttttacttctgagtatttagtaagtatgataaattattaaccaggatatttgattaggtagacatgcctatattccagatagcaacagtttaccattagagcaaacagaaaacaccaggaaaaattctgcaggacaagtttgtaaaatgcaatgatacatctttatgacatatatcctctgtaaggagataaaaacaatgtatgtacaggagtgtacataaataaaagttgaagaaagtacatcctctgtgatttaaaaaaagaaattcaatatacccattaaaaaagtgacaggtgtattagttttctatggctatagtaacaaattactacaatcttgatgacttaaaatgacagattcattctcttatagtgctggaggctgtaagactgaaatttaggtgtgggcagtgttggcctcttctggaagatctgaaggagacccatgcctccgtcctgtctcccagcttctgctgccatttcttgtatcaccccagtctctactttcacctttatatggctttccctcatgtctccgtgtcttcaccttttctgtttcttagaaggacacatgtcatggggtttagggcccaccctaattcaggatgatctcatctcaagatatttaacttaattacatgtgcaaagaccttttttccaaataaggtcatattttgaggttgggggagttagaatatgatcgtagattttggggggcaacaatgtaactcacttataaatggtccactgacccccccaaaatttgtcctgtgtgcagaatgcattcatctcatcccaattaattattaacactgctttgtgaggaaaaattaagaattttgaaaagtgagaagctatacctctgggataaataaaaagacaaatggcagaagatggatagtcgctaatcttttttttagataaacattttgttttgagatagttgtaggttcacaaacacataagaaataatacagagagatcccatattacaaaagacaccgggatgttgacgttgatacagtgaagatacagaacacttccatcgctactgctgttttgctgtttattacctgccccggatttcccgcccctccactgctccctgtccctaaccgtggtccaccactaatcgttccacaattttatacaaatataaccatactgtatgtaaccttttggaattgcccttttttactcagcacaattctctggagattcgtgcaggttgttgtatcagcagtcattcgtttttattgctgagtaatagtccattgtatggatataccgtagtttaaccatcggcgtaatgaaggccatctgggtggcttctaatttttggctctaacaaagcttctatgaacatttgtgtatgtatttttgtgtgactatgttttcatttctgtgggatcagtacaattgcctgatcatatggtagtttagttgcatgtttattatcttctttaatatgctttttttaaagagcagttttaggttcctagcaaaattgaggaaaagatagagatttctctgattccccttggcccaacacatgcacaacctcccctattatcaacaccccccatcagagaggtacgttggtcacagtcatgaacctacattgtcacatccttatcaacaagttaatagttgacattagggttcacttttgctgttgtacattgagtgggtttggacaaatgtatgataacatgttatccaccattatagcatcatacagaatagtttcacttccctaaaaaatcccctgtgctctgcccattcatccctgcctttcccctaacccctggcaaccactgatctttttgttgtcctcatagttttgcctttttaagaatgtcatatactgtagttgaaatcatacattatgtgaccttttcagattagcttctttcacttagcaatatgcatttaaggtttctcagtgtcttttcatggcttgccagctcatttctttctttctttttttttttttgagacagagtcttgctctgtcacccgggctggagtgcaatggcgcaatctcggctcactgtagtctccaccttctgggttcaagcgattctcctgccttagcctcctgagtaactgggactacaggtgcgtgccaccatgcccagctaatttttgtatttttagtggagacggggtttggtgaaaccccctctggccatgttggccagagtggtcttgatctcctaaactcgtcatctgcccaccttggcctcccaaagtgctgggattacaggcgtaagccaccgtgcccggctgccagcttatttctttttagcactgaatcacattccattgtctagctgtaccacagtttattcattcacctactttagtacatcttggttgcttgcttccaagttttggcaattatgaataaagcttctataaataccatgcgcaagtttttgtgtgaacatacattttaaactcctttgggtaaataccaaggaacatgggtgctggattgtatggtaagactgtttagtttcacaggaaactgccaaattgtcttccaaagtggctataccattttgcagccctaccagcaatgagtgagagttcctgttgctccacatccttgttagcacttggtgttgtcagtgttctacattttggccattttaataggtatgtagtggtaccttgttttaatttgcatttccctgatgacaatagatgtggaacatctttccatatgcttatatgtcatctatatgtcttctttggtgaagtgtctgttaaggtctttagaccattttttgttaggtttgtttcttattgtcgaattttaagagttttgtgtttttattttttgttatattttggataacaacctcttatcaggcatgccttttgcaaatgtattctcccagcctgtatcttgttgtcattctcttgtcaggatcttttgcagagcagaccaccatgcttggcttgaggttcatttttttggtcgatggatatccattcagttgcttcagcaccacttcttgaaaaggctgtccttcctccactgaattgcatttgcatctttgtcatatcagttattcatatttgcgtgggtctgaaataagagtttggcccatatctactgatagttctgccagtttcacaaattaataaaagaaaatcattatattcaaaggatgtttgctttttattattattattattattattattttgtcagtagtagattagccctgaaaatttatgatgacttccagtgtgatgaacttactcctccttatacagtaacgtggtctatgtggctttgggagttcttttctcttttctcttttttgattcttggagttttggggccctggagatggtagtgatgaatgacgaattcagcaaaacttagaagggaacagtcgagggaattgagacagccaatagaggacttgaacccctttcttcaaatgctatgaagaataaataataagattagttttcaaagatgtgaaagagactctgaaaaaggaacggaagtgggtgcttggcattgctttctctttccttcccctgttgctctgtatttgggcattagatgtgggtgctggaggagaaattaagaagaaaatgttaaaaatcttgataactagacagtctgatttctgattttccagtttagataaggattactggatggaggagttaactaaaatatactttgtacaacaaagcactgttgtgctgttacatccacattaaatgtttactcatgtgcggcctgcaatttggaaagattcggcagaggatccaactggcacattgtgctctcttgatctattcagttttttaagaacggaggaaagtcagctttcgttttgtgtctcatacccagaaggacttcagttctttctttcagtccataatttctgtaataagcatattatctttgctcagtaaacaggtccctagcaagtgggtgggttttggtgtgtcacccaggacaaggggcccagtttgttgtttttcactatcccaacttgcctcttaacgctcaagtaaaaggggaaagaaatagacccagcctcacttgcacccacaagtcagtaataattagtcttccagcaggtctcctctttgtttctgcttcttggagagggcatcataagcagcagttcaccaaagttagcaacaagcctagatccattcagttttttttgggggtgtgtgtgtgtgtgtgtgtgtgtgtgtgtgtgtgtgtgtgtgtgtgtgatgtcttttgtgtttgtcctgtggggacaaatacaaagtaggatccatagactccatattcaggcttagaataaagactgaaattaatcactattctatatggaataatcttaattcagttgcgagggatacattgccccttgaatctcaagcatagccctgttttgtctttgcttggtggtagctgttaaccaggctctgggtgagcctagaacttggtctcacatgagcagtgtagatacctctctgcctttttgtttaagatgatgtagcaggctgggcgtggtggctcatgcctgtaatcccagcaccatgggaggccgaggcgtgtggatcactttgggtcaggagttcgagaccagcctggccaacatgttgaaaccccgtctctactaaaaatacaaaaaatttgctgggtgtggtggtgcacacctatagtcccagctactcgttaagctgaggcagacgaattgtttgaacctgggaggcagaggttgcagtgagctgagatcacgccactgtactccagcctgggcgacagagtaagactctgtctcaataaaacttaaaaaaaaaaaaaaaaaaaaaaaagagatgatgtagaagaaccatagttctcatttttggccagtttgccttccagattttctctgtcatgtttacctatatcttttacatggttatagtcagagtatttgtactatattctcccctgtcctcatatgtacttactcagggtttttttttgtttgtttgtttgttttctatcttgatcaatttcactgtaagtttgttacttggcatgagggtagaaatgttgattcttactctactgcttactctactgtgtggtggcgaagagcatgcatcttgaagccagcccatctgactttgaagacaggctcaactgtttttcagacgtttgactttggtccgagtcacttaatctgcttctctgactcagtttcttcttatgtaaagtaaaataggggtaataagaatacccacttcatagagttgatttgaggattaaatataaccaagtatatgtaaagcttttagaatagttcctgacatatagcatgttctgtgtgttagctattattatcatcactcagttaattttgaaccacttaatttccaagtgctggtgagtctaaagagcagagccaaacatgtaattacataaacccagaagtgaatttttcaaatgtcttttctagtaatagagcttaatgagattggcacttcagggaaaagtcctaggaacttgtttatgttggtgactgttgatcagccagaagatctctcagacgcagtctaacatctgcatctttctaggctggactacctttgcggcaccaacagatggatcaggaattaaaactgggagcttctgttgtggggaatctttcatcttctactgttaatagccttgtgggtttccctctcctgggtactactttctctacggagagcttggtctgtggcacaaacaggtgccgaaagggggaagaaacacctctgggtaaatatctggaggtcggcaggtgacagagcagtggtctggggacactggttcaggtgtatgttcatcaccctaccctttaaaactcacatggaaatgacttggctgataagttacttgtggttcctgtgataattaaggcagcctgttggaccaggacaaaggatttcctcagctttcaagagaacgtttctaccaagagccatatactaaggtgtgctggttatgtgagtgttgacctcagtattagtatcacttctgttgaaagtgacagaaaacctctaaaacagggtttaaagatagtgtacctcattatttcagaatgtttgtgctgctgtaacaaaatacctgacactgtgtgattcatgaagaacagaaatttatttctcacaattccagaggctgggaagttcaacatcaaggtactggcagggttggtgtctggtgagggccgctgtctgcttccaaggatgcaactggttgctgaatcctctagaggggactaatgcagtgtcctctcatggcagaagagcagaagagaatgaatccactccctcaagccctttcataagggccctcatcacctcctataggcctaccttctagtacaatcacatcagcagttaagtttcagcatttcagcgtgtgaattttggggggacacattcagaccttaacactcactcttttgtttttttttgagacacagtctcgctctgtcacgaggctggagtgcagtggcatgatctcagctcactgtaacctctgcctcccgggttcaagcgatcctcctgcctcggcctcccaagtagctgggactacaggcgcgtgccaccacacccagctaattttttgtatttttagtagagaccgggtttcaccatgttggccaggatggtcttgatctcttgacctcgtgatctgcctgactcggcctctcaaagtgctgggattacgggtgtgaagcactcactcttaatggctctcagctctaattatttgaatcttgggcttttatttagctgctctcccatccttagttagaatgatagcagtgctgcaaggtggctgcttgagcttcagctatcaggtcttcatttgagtcaacaggaaggaatgtcaaaagagggaacagttgcatagtcatgaggaactgcaaaggtggctgaaaaatgcagtctgtgtgcccagctaaaattcaaggactgatggcttgagtccaggagttcgaggctgcagtgagctaagatgttacgacttcaaaaaagacttctgataaattttgacatttctatttaacagacatttgggagacacacccccaccccccagtccaggtgcctgagaataaaaacttagtcacactattggtccttgtgctccaaaagctcttcagttatttgattgacccatggctgctttttggtactgaagaaccttattagtaatttagtgagtttttaatttagatcctgtatgtggtggcatgggtgggtggtggtgattgtattgtagctaggagctcctagtcagcaatgcatgggctctggggccatgcatgacttcaagaatagatggcctagggcaacccacttgggtccccttccatgctgtggaagctttgttctttcgttcttcacaataaatcttgctgctgaaaaaagaaaagaatagatggctttgcagatattccagggaagcatttgagtgacacctctctattgtgccacttaatcagttggattggaagttgagccagcaggtttgaaccttgttcttagttttaaaccagggcaaattactggtgctttggttttctaatgcctgtaaattagagcttctgagccatgtggggagcaacccctacccgcaaaggagtgatgtaatgtctgggggctgcaatggttttttcctttgagatggataccatataagctagtggtgatacttactttatgatagtgacagggaaagctactgccaagagtaattgatgtgacccacacatagtcccagagccaaggagctagatgggatcttcctgcctgaggaggccaagcgtctggccttcaagcattcttctctgctgtgatgttgtttcccgtcctgaaaagcagggaggaaatgatcaatcagtgtgcctcaacctggagccgattggctgtggttgctaagttttcttccctctgagcagccctccctgtgattctgaagcagctcattcggagtgttacaacagacatcttgatgggattcaaaaatgttgggcagcatggttatctggtcttcttctgtaaggatgactgtgaggtgtgccagcccattcccgtagggacacacctaacccgacgccctcccaagggctgaattgttctgagctgtccaggcttgggctatgtcaggttctgagcactgaagtgtagtggagggtatatgacaaagaggcgacagagctgattaccctgcttgttttcttttatttattcagtggtcttggaactgggcaagaggattttatggattagctcctggaagacacacactagaactaacatagtaagattgtgtttaggctgtcagagccacctccagggtgagaacgattttagagaaatatcctttgtgtagcaatacaggaacctatgctggctcaacagctgcccttttggaaactgccagccgaaggggcctgttgatgagctgtttactgccactggggcttcccaaatgggaagtctctgctaaaggagttcattgttcagcatgtctagtggaccctggctcctaacagctggattcttttgaacataataaacatttctagaacaggttttcttggtgagcttttagcttccttttaataggcacatcacttgcctgcctttagttctatgaagttcaacataaatgttgactttagtgatgcagtgggacaaaacagtattatatttctcatcagttccctccctgtctcccttcccctgtcattgttttccagaggtaaagtacatttatggagaacatcggggtgaatgccaaagcggcttatgttctaaaatagtgaaaagaattgtgcagttggagttagacctatggtttgagactcagctttgggactgagcaaatcatttcacgtgatcaattttctaagctccagtttcctcattaggaaaaaagaagacaaagtaatacttgttgtaatggaattaaatgagataatgtcttcagaatgccatgtaagtaaagaaattgtgaatcaccttcactgatttgttccatagattttgttttttcctttcttaaaataccttgtattgaccttcacctaactttgtatttggacaacacccaacagtcctagcagacctttaaccctcccgactccaatttcagtaatgtgttagaagtggcagggacagaatatattctggattcattcactaaatatagagatattatacaaaatgaagctgaactcacgctccagtgggcagtgtcagtttgcctgtgagacagcgctatgcagctgcagccactaagtgtctaggcactggagatggacggctagagtgggaatcctggctccattcaacctctctttgcctctatgtttgccatcagtggtgtggatatgataataattcccatcacataagcttgtggtatgcaaatgagatcattttaaagtgctgagcccagtacctagcatatagaaagaaatggggcttttattatagtgataataatttttaattgtggtaaaatacacataacataaaatttaccatcgtaaccgtctttaagtgtacatctcagtggtgttgagtatattcacattattggatgaccaaattccagaaccctttcattatataaaatccattcaacaactcttcattttcccctcccctcagcccctggcaaccaccatttaactttccgtttctatgaatttgactttgcatagtgcatttcactttgcatagtgaaatcctatggtatttgtctttttgtgactattaatataattgttaagtcttagcccactgtaacagttgtaccctttcccattttagatttctataggctcaggattgcctgccttctcaaaccctggttattggtggattatttctctttcttttctttttttctctcttatttttttagagatagagtcttgctctgttgcccaggctggagtgcagtggcatgatcatggctcactgcagccttgatctcctgggctcaagcagtcctcctgccttagcctgccacacgtagctgggactacaggcacaaacaccatgcctagataatttctgaatttgtgtagaggtggggtctcacagtgttgcccaccctgggcttgaactcctgggctcaagtgatcctcctgccctagcttctcaagtcactgggattataggtgcacgccactgtgcccagctgaattattcttaaggaacaagatgacacctcagagctccatttcatccttttgaagagaggggcaggattaggcaaaaggagaacacagagatgatagtgaaagagatacagaggtgagtgttaagtaagcgaaagagcatttattcagggcagagtagagtctctttgtgggactcctccttccctccctgccttcttccctaccaggtaaaaattcaaacctacacaacaatagagaggatgatataaccaaaccctatgtacatgtcagccagattcaacagttatccggattttttagggcccatttgtaatatggcccaggaggaagaaaatgcctgaacaatctagattaacctagaggcaggtgtttctttgcttatttgtgcaattttatttatctccttcctgataaagggcttcttctgccttgggacttcttactatctaaggttgaggtaaagagccaggactctatgaaaccacattacttaacttggtttcctcatccatgtaggagagcacatgtggcttctaaaggtggtcataatggagtgtttggcacagggactgctgcctaataagtaatcatttacactgttagcagtggtagtgtgtttgtggaagggaagggtcaccagccaggtccttgaaaacacaggactgaaacatgcagcgggggatcaacacaattagtcatactgtatcattgatcaagggttgggatgagcgctgattttctagaattgcacctactgtatgttcattatcccattttactggccattgtacaggttctgtcctagattgtgctgggttaagggaaacagtagtttatctgcaaaattaggtagtgtaactttttaatatgcttttttgatggtgatgggattgctatttacattaaaaacattttatgggttttaaatataaataaaaatatcacaatttgaataactagataatatacatttggcttcgtgaatcacttttttgtttttgttctttggaattctaggaggaattctatctactaataaaggctgcagactttatcttcctacaaccttaggacgtaagaaacgtcctaagatagatgcctgggaggaaaaggaaattgagggcctacaggtgtttaaaaacctatagtttataattgcttagagcctttgatttccccccccacccatccatctgtagcacccagagagccttggttttgtaacattttcacttttgaatctagtttatcatatgaaagttttactgttctgtgatattttggggcatgggaggatctgtggtcccaaagtccagagtagttttaaatgtttttctgtgttaatatgcaaaagtatcatgaaggcgaaataaattgtttgcaaataattgagtcaaaatattattgttcctccaaagatccttacttagtcgtgtgtcacagcttgtataacaggacgtattttgcagagctgtttagtttgcactgacttgtgcaacaggaatggccagttttccttacgctcagggcaatcaaacacaactttataagaattgtaactttaaaagatttcatatttttgttgttgttgttgttaaaatcgttgatgaaataaattcaatagtaaaacttctaagatttgagtcatcaaacctctaaatatgctgtttttctgttctgttctgttctgttcttttctcttttttctttttttttgatgcagtctcactctgttgcccaggttggagtacatggcacgatctcagctgactgcaacctttgtgtcttgggttcaggcgattttcctggctcagcctcccgagtagctgggactacaggcatgtgccaccatgcctggctaatttttgtatttttagtagaggcagggtttcaccatgttggccaggctagtctcaaactgacttcaggtgatccacccaccttggcctcttaaactgtgggattataggtgtgagctaccctgcctggcctaaatatgctgtttttcctttctatttattcggttgaccagtttctttcttcttcttttttttttttttttttttttttgagatggggtctcactgtgttgcccaggctggtctcgaattcctgacctcaagcaatccacccccttcagcctcccaaagttatgggattacaggcatgggccaccgtgcccggcaggtcaatcagtttcattagaagacttgggttatgtctcctacagcttgtgtaatacagacatttttatttttacattagtctttgtatgaaatgaaaaaagaaatcagttatttgataaatacaatccttcactatctcattctattgaatgcacttgtttcataatgttccttttacgaagagtatattgaagggaaaaaggggcagacacatgtattactatctgtttttcttttttttaaattttaggatacatgtattactaacaacaacacacaaagcatgtaggtttgagttcatttggagttggcttctccactcttgtttgggatactcctaagttgttttagatgttggtggtgtttgtgttccttgtcaccctgtctgtggtgacacacgtttgtgaaaaggccacctggtttactgtagatgtgaagtcatggctgtggactggagcaaaagtaaccaacagaagtaggattaacgctgtgagcatagccttcttgctaactagctgagctctctggccatggtttttggttccgttgatataaagagatgtgcaggggctgagtggcattccatggatgtgcagtcaccttgtgattccaaggccctgtagcccctcagcacatcatcaccatgccttcattctactttctgctgccttttttgtctgtctataccagggcacaagcagacaggatcaggtagccctacctttatcagtggctctgggaaaggctcttctggaggaggaggtggtgtgtgctgccctccttcccccaccatcactgcaagtacctgacagtagtaagctgtgttaagggaagggaggaaggaactttggggatcctaagacttctctgtcacaggcgtgtaaggcggactcttctccgttagcctttttttttttttttttttaatttaacttttaagttcaggggtttgttacataggtaaacttgtgtcacagaggtttgttatacagattatttcatcacccaggtattaagcctagtacccattagttatttttccttatcctctgcttcctcccacccgccacctccagcaggccccagtgtgtgttgttcccctccctgtgtccatgcattctcatcatttagctcccacttacaagtgggaacatgcagtatttggttttctgttcctgtgttagtttgctaaggatagtgtcctctagctccatccatgttcccacatgagacgtgatcttattctttttatggctgcatcccttagccctttaactcatcatgcacgatagctgcctttggattcttccttccagagccccttcttggaaggtgtgcatcagcttggttactctcgggacttcctctgtaccacacgtgccctttctcttattcctgggtgctctcttctctcctcacagtcttccgtgtgtgctaagatcgtgcagctcctggggcagaatgaggtggactatcgccagaagcaggtggtcatcctgagccaggatagcttctaccgtgtccttacctcggagcagaaggccaaagccctgaagggccagttcaactttgaccacccgggtgagtcgggcattgaagggggtatgtatctgtattggtgtgttggggggaatagttttattttgctcatgaggaagttgcttaacctctcggaatcttgtttctatctagaacgtagggacttgataactaccttgcagtgttattgtggggcttatgtgaaagaaggaattttcaaatgcttcaagtagtgcttggctcattaaatactgattgaatctgtatctgaacaaaggtgattttgtatgagcctgggactcaagatgggccagacatgaggtcgaacatacagagctagtcctgctgcctctgatctgaggcagccctcgtcagaccctcctcctcaggtgtacatgtgtgttcaacccactgtctggcagagagggagatggaggggcagggtggctgccagagtggtttttgccctacagccctagatcagcacactgctcctttagctggcttgggtttcttataattgttagaagcaaacctgggcatggtgcctattgtgtgtactcccccagtcatgggtttgctttccaggtcagtttagcatgtgccaatcctaggatgataacagctaaacttggagaggggaaagaactgactgaagtcagggatggaatgtcaaaggagagaaaaaagaaatctatttgtcagaactcatttatacaccctattttgagatacagggagcatccattctgctttgggtaaaaatccagctttttagggagcagtatgattacctttaaagtgtgatgtgcccatatacatgtttatgaggatgccttgtgtatgattataggagatcctattttaaaattaagaaacattttaacaatttggtatttttcagatgcctttgacaatgaactcattctcaaaacactcaaagaaatcactgaagggaaaacagtccagatccccgtgtatgactttgtctcccattcccggtaagtgagctgttctgggccagggatggcacccactgctccgcagagcatccctggtctgcactgagacctccttccttacctctcgcacttcagacctctgtcctacccctgcctaatgccattccagctggtcagtggagtgggtggtggcagcagtgtgtgctgtgggattgtagaggttggggagttcatctgagcgctccctggaacagtcctgttgtcacgattccttaactctgaaggatgggatagtgatttcagcttgagggactgcatgtgcattctgatccacattccagtgctgctgttcctggaacaagatgtaaggggaggggtagaggaagggcaggaagaagagcaaagaaaactgttttttctgctgtcctggtttacttgggattggacaatgtggagaggcatgaggtcaccagatcgtgatctcagaattaaccaagccctccagaaagcttctcagtggaatcaaaccagtcctttccagtgaagcctcaattttagtgctcctgattaggaatagaggagtggccacacttccacctcatcctccttccctttgagtgatgggaatgggctcctagaagattgcactcctgctggccagaccccaggctccttcagagcgtctcagacctgaatgtagaacacacacatcttcccatgagtctgaactagagagcatggtgacgatttggttgcaggaggaagatgagagagagagagagagagaatgagcatgcatgtgtgtgcgttgaggtgtagagggggctgttttggtgcttacctccatgcctcaccagaatcttctgaaacacttccttctatgggccaggttcttctgtgtaggagagaggagagtgaaagatcaggataccatcctcacgcctcccgtgtcactctgttttcctaacccaaccactgcagatcatggaggaatgaatgaaggcatttcgtataggatttggagcttacacgaacatcaaggctgggagagtgaaggcctggaagtttatagtcagagaatcagacaaaatagtccccactgactctagcctgaggcactggagcagaagctggggttcatggaaaagtccaagaaaccaccatgtctgggtttgcagcctcaatctgggagcttatggactgtttgcaaagtttccctgtctcagtattatgatctcctgaatattgtggattttgcttcactctcaccttcgaagtctcttgttggcgtagtaacctggaagcatgtggggcaagggattctgagaattgtagttctcccttagggggaagtggtggtggtgtcacgttgacaagagacattccagcccaccacttcccaagtaaagaattaaaatgcagcatgatggctaaggcaagggcctgcagaagaatgtaaaggagggaggaagagcaggggattcagagcaggttgtatggaggaggtgatatttaagctttagataggaaaggataagaagttgtttgggaaagggatttccaaggtgctgggtagggaagcatttcagagctaggcatggatcagcttggttggggcatggcagtggagaggtgtggaggaatgggagtgggtgtgtgggaaggcaggcagacctcaggtcatgaagggccataggcggcagggccaggagcacagacattttggcaatagggagctacagacgggtctattgttgtagtggaaaggtcattgtggtggcaggaggagagaggatctgcaatgccatttgtgaagaagcctttggaacagccccagtgagagtctgataagggcctgaaagaaagcagtggaactgagcatggttgacaggagccagggcctgaccagtgcagtctaggagtggaggagggaagttgaagacctcgtgcatcatgagttccatcaagttgatatgccaacaaaagaaaatcctggtagaattcccagtgcagacatgtttcacgtttcctcctgatttatctcataccttatattttaaaaccttatcctttagtggctcaaagctcatgtcttagaaactttcactgatcaccctagacccatatccacccctttcctacctccttgcaaatcttaagggccacttaattggacatcgagccattcagggttaactgattccatcccacccatgggcgtttggtacaaacaaaaatttgttgggctaaaatgaagaagacatttacttgttgcaattacatttctctgagcatccttttccccataagccaaatgagatggttagactgggttatctcagatgatctaattggctagtttctttctggggcttcccagccagactctaaattcctaagtggtatattatgccaggtatgactccttgcacattctgggctagtagttgctcaataaatttgttgttgttttttaaaaactctgagctgttatgacagtttttagacctgcgtttggacttgggaaatgattaattctaacttcttaaggcaccaccaacaaattaggcagttaattttctccttccgaaggaaaaccacttttcctttttagtatttatcagttaggcatcctaaaatgctcttaatatctagtgtcagtacagattgaacatccctaatctaaaaacccaaaatgtgaaatgctccaaaatctgaaactttttgagtgccagtgtgacgttcaaaggaaatgctcattggagcatttcagattttggattttcatgttagggaggctcattgtagatcctctctccccctgccatattagggatgccctaaatataatgcagatattccaaaatctgaaaaaaatccaaaattcaaaaattctaaacacctaagcatttcatataagggatacttaacctggatatgtaaacttagtgcagccattgtgttctctgttagtgtgttcaagtggactcttgcacatacattcactttatttttggacaaagccttcccacactctccttggtgtaggggagttgcctagagagtggctcactatttcacttacccattggttctgttttctgaacttctctaggttgccttcttatgcacaatgacaatgggcacaccattttctggcagctgacattcctctagactggtgcttctctaccctggctgcatgttagaaatatcttgggagcttctaaatagtgttgaagttctagctccacttcagactcattaaatcagagctccttgggggtaggatccaggtagggatatttttataagcttcccagatggttctgatatgcatctcagatacaccacaattctagggcatttcctaatcctagtccttttttcccgtcttccctgccccgttctgccacttgctagctaccctagcagtgcctgccttaaaactcagacacaagcctgttggtccaagctgagaaggcatcaggaagtgtttatgggaaggagttccaacggcaccctcttgagctggccgttgatactgacctccttatgtttgcacagatggaactactgttttaagagactttgttttatttggtttgccagtgtgctagtcagggtgagtggaaaccttgcaatgatgattatttctctattttcagtgaattttgagcaagaggcagttggtgacatataaggtgggcataggacagaatcaaaagacaaaacacagtgaaagctgcagcaaggcaaagctgagcacaagcaaggccatctgtgacagcccgtcgcctaaccgtttagcaatgtttcacccttcttgctttttgaaaagtcatgttggttgagcttggtagctcatgcctgtaatcctagcactttgggaggctgaggtgggtgggttgcatgagtccaggagttatagaccagcctgggcaatatggtaaaaccccgtttctaccaaaaatacaaaaattagcctggggtggtggtgtgcatctgtagtcctagacacttagggggctgaggcgggaggatcgcctgagcctgggaagttgaggctgcagtgagtccaagattgcgccgctgcactccagcctcctgggtgacaaagtgagaccctgtctccaaaaacaagaaaaagaaagaaaagtcatgtttacaattagtgcctgccctaggctacccaaccatgtgggttgggtggatgaggtcatgcatatttctgctttattgataaggaagagcagctctagggagctcaggattgacctgtggccactttgttggtttggggtagagccagaccagacagacgtcgggattctgtacttcctcacaaatgctttctcgtctgtatcctctttcccaaaacttttctttattttccctccttcccttccccttctgtcctttcctccctcctttcaattgcctcaggactggcggggaggggatggagttgttgagagaaaactgtgagtttctgtttttaaagttcagagtgttaggttccataaatgccaggccatgagagcattcctggagacgccttcagagaaaaaaagaaatcacatctgtttttgtctgcctttattcttcattcaacagcaggtttttttaattccaaggagaaggatgtctgccgtgtatttctgtttcatggtgaaagctcagaagtggtcaaaggagacctttgtcccggccgtgatcacccttggctctttggtggtggtccgagggctctgtaagaccatattagccaagtctttagcccccgcttgaagtctgtgggggcaaggaacccagaacccagcccagccagatgttctggcccttgttctctgtcccttgctagcccctgcctggcttggcccattatctgctctgtgctttgcaggaaggaggagacagttactgtctatcccgcagacgtggtgctctttgaagggatcctggccttctactcccaggaggtacgagacctgttccagatgaagctttttgtggatacagatgcggacacccggctctcacgcagaggtgcgttctaaaagcctcaggtggccctgttggtggccaccttgagggcgggggagctgggagcctgtgacaggaccccacccgcctgagtctgaagcccatgccttccctgaggcagctgtgtgtcgcatggtccagcccggctgcgtcagtccagccccaggatatcctgctgcccagacacttggtaacatttgagaagggattagtcacttactgtttgggataacgaaaggcttgtgaggtcacagagactaaataagacactgacatctggttttgcctggaaaagtttgattaaatgcttagttccttgcaatttgtttataagacatcaaaatgaagatgctctgatttggggaactaactgtaggacccccgaggataggatcccctgtgcctgaagtactgggcagctcatcctgttagcctgcttctctagccctttattttccagcaggctttatggaggcattatcactctttccagtcagctcaggagggaagtcagctgtgccctccgcaggccctactaagtgtgggcctgcctgtgctaagtccctgtgcttgtgtgctgaaggcacagcagtgccccttggtagaggagcccagcctgtgaactgagctctacagggtattcagcagagagttcgcttccaccaggagagattgggaggcttcatggaggaagaagggttgggacttggatgtggtggggtagggtgacgctataggcaacccatgaaggtgcacggcagagatgtacagacagtggcttgttccgagagtggcaggaacctggagtgtacagagggttgtacgaagagacactacaaagtaggttggggtctggttttagagactgagatctctagtctggttctcggtgggcaagggagagccactgtgaggttctgagcgaggcaagtgaagtggccactgttctgtgttggacactggttctgacaaaggaaatgtaagtgaagcctgtagctggagcagctctttggagactgctctgctgatctagacgagaggcagggctgtggtccttagatgggtgggagagggagcagagttgagatgagaagagtattagcagagttagaatcgaccaggacccagcaagggcagtgggtggaggcgactgaatagaggaatgaaaggtgagaaggtttgagtctccgttgtgtgacagaggcagggagacacaggaaatgacgaggttagctcctagtcacaggacacattattgacagtttcagatattataagctgtatcccagggccctctgacttcaaagtctgggtaattttctcttttcggttcatgaaacagatctgtagtttatcccatttagcaccgtaattgtaagaactattcatgagaccagtagaacctacagaaacaagtcctgagctttgcccttctaagtagtaatagatacatatgctattaagtcagtgggagctacatcttgctcccaggtggggtgagggacagttagttttgtgtgatggaaaaaagaatggaatgggaggagacttttagttctagcagagcccttcccagctagctttgtgactaggctcttgcgacaccccggcttgggtttctttatggataatacaggggagacaggcctgcttttagtgtcacgactctggctgggtaagagttgcatggtcattttggatagataattgaaccctgagcctgacaacccctcatgcttctgccccagggcctggcttgtcaccttaatccacaaactccggccctgctttggttgatctgctcagtgtccatgtcagcttgtcaaattagagaggcagtgtgatacacagggacagataaattttagagtccagcgaattgggctgagatcctggttttaccacttactagatgtgtggcaaattgtgcaaattggcaaattgtgttttaacttttttgtatctcattttcctattagaatgtggtcttatgattggtacttctgggatagttgtgaagatgagaggtagtgcaggtaaaatgcctggtggtgcattagtcaataaatatctatgtggcagatcagaaatctgcttctgctgaaggggtcggtgctgttcgttttctgaattttctgacaagactggttagatcctccaaggggatctgctccggtcatgtcctcaggagctagtgatgcccggactgatgccatcactagtccagcagtggtactcagtctcagggatgcagtgctgccgagggaggcctcgcagcagggagtgcaggaaccagcacaggagattagaaccaagttttgagcagcagcaagacgctggaaataaagtgcatcctagtgtctaattcaaacagatcatcacggtgtggtttcaacagaacattttcccttcctttcttgcatgggattcttatgtgaaataggagcaattcctacaatggtgctggccctctgggggtttcttagggccagctctgcctctccgccttctctgaacaggctgcctgggcagggctctgctttctcatttcagatctgctaacttcacatgtcacctactgccgagtcactttcctgatggattcatgggacttttctgcatgctatttctacaaattcattctctctccacgtaggacaaaaaacatgcttggcatgtgctttgtggagtgcgggggtgctggggtagggaggctggttagtcagaagcagctgttgagtgagcttgaacattcctggagacttgagttagctccatgattttacccatctgtcacaccctcctgggcatgtgacctccagattctgagttgaccctcatgtgggagagagatctgtgtttgagtgaagcagccctggaaactacctccttcctgatggaaacccttgatcttctcgggattggtttctagcctcatttgccttcatattccctctgtgctctttaccaccacccagctctgaatacggggacagggaggaggtggggcagggagattcaggatggctgacccctcatcttcctcatccatcattctctggttctcatagaattagggctgcactgggccttgggggattcagcccattcttttactatagagtagcacatttcctcatcagatttttaaagtgattgacttcaccattgaggaattatctttattttgggtccctctaagtttctttcttggcttttggctaaccagaaagagcaagtctgggtttggaagggctgacgtggaagcccagcagggaatgtgggcagacttgtagcttcctgccctgtaccctgtcctctgaaaaggcctgtcctggcccagcaaatgtgctggggtcagagcagtgatggaggggctggttttgagcccctggggtttccaggttgtgccaagaccttgtttggactcagtccttggcgcggccctgtttcctgactctgcctgaggagaagggcctttcagtgcagggaactggctggccctctgttgtccttggctcagggaggcacagtctgcctgaggtgatagttctatcggaggttcttggggagcagaggtgggcaaggccttatgatgttgcatgttcccagtgtctgggcaacattctgacccattccccatttgcttttccagcgtggaagctgtagtgggactattccctatcttccttgctttttttccttcctcacgtatgttgtcctatgtgcttgtgtcctgctctcccttcccgcgtggcaacctgcctttccagctgccctgcgggactcctttttccctttgctgcccccgctcagctgggtctgacctgcttacctgaattcgaggttcccgcgctcccacggtgttgagctgctctgtcagggaggcactgccctcccaacgcgtcctcaggttctgttgtggtcgtaatcatcatagaacacatgcttattgaacatgtgctaaggtgccagctatggtgctgaagagttttatgcacatctctgtattcctgaatagtaactgtatgaggaaggtaccattattgtccctgttttatagttaaggaacttaagattcaaagaggttaaagtcacttgtcgaagttcacagaggtaggagttattggggttaggattcaggtccagggcagttttccccccagagcccatagaggtagaacaagaagcagcttttgggctacagagcagcttcactgtgatttacctcctcctcctactttctgcacgaccagtttcctctctccagtgacaaaacagctgaagccaccagatctacagaaggaagggggctgaaggcccaggctgagggcagttaggaggactacgtgacagggtgtggacgtgcactgtgtgtgcgtgcgtgcgtttgtgtgcatgtgtgtttgtgtgtgtgcacgtgtgtgtgtgtgtgtgctgggagaaggacaaagcttcctccagtgctaaagccttcagcaattgtatgaaaagcatgtgttgcaaaacaatccagcatcaggcgtttgcagggctttaagtaaaagctgcccaagcacgggtgtgtttgttttttccctagctctgatacccttttgatctggtttccttttttctttgggctttatctggagacgtgtgaagaattggaggccgcgctggctgtgtgttttggcggtgctactctggttagccatgtgtgccggagctctggggacttctggggggtgagccacgtggcagctccttagggctccttcttagcgagtctcccagcagatctgccagagcagcaggtcggcagcaggagcccaggtccagcgttgcaggggtggggaaaaccatttcctggctggagaaggctgctgctgggctgggtgggcaagtcctgacacattagcgatcagccaactgttttattaccaggtctcccatggagaaaacacttcgtaaatcgaggagctgttacaaaagtcgaatggcagcatcattagtgcccagctttctggaaatgtggatttcctgacagttttctcaccttctcatcttatagatttcctgtcagcctggatcatagccatgacagcctccccgttccctggcctctctgtgcatgcacctgtgcatgtgtgtataaagacagaattatttagacaaatggctttcagaagttccgtcacagatataccccatgttcgtttacagtgagtttcacccaacatttgagtctatttactgagaaatggttgggaaggagctgaagagccactgcaaatgattgtagatggatgtggtaactttttggggtgaaagatttagcagctcagatgataaggttagattaagatagcatttaaaatgacatctgcaaagagaggcagttttaattaagagaatctacttccaaactccctactcatggggaaactaaggctcatgtacagcggcagaatgagggtgatcagtcttctttctatttattgacagaagactctatttaataaagagtgtatgggctgcctataattccagcactttgggaggccgaggcagaaggatcacttgagcccaagaattcaagactagcctgggcaacaaagcaagaccccgtgtctaccaaaaaaaaaaaaaaaaaaggctcacacctgtaattcccagcactttgggaggctgaggcgggtggatcaggaagtcaggagatcgagaccatcctggctaacacggtgaaacccccatctctactaaaaatacaaaaaattagccaggcgtggtggcaggtgcctgtagtctcagctactcgggaggctgaggcaggagaatcgcttgaaccccagaggcagaggttgtagtgagctgagatcgcgccactgcactccagcctgggtgacagagtgatgagactctgtctcaaaaacaaacaaacaaaaaattagtccattgaggtggtgtgtgcctgtagtcccagctacttgggaagttgaggtgggaggatcacttgctcaagcccaggaggttgaggctgtagtgagctatgactgtgctactgcactacaacctgtgtgacagagcaagacaccttgtattaaaagaaaaaaaaattttttaaagaaaaaaaaaaaagaatggtaaaagcccctggataaaactgaccgggggaagaaggtagaagacagaagatggtgagtttgttgtcaatttgggcttcatctcagccccagcccaccattctctaggccatggttttcttatctttcactgagtgatttttttttttttttttttttttttttggcaaacctctgtgcatgaggtaggtggaaatggttaaccatggctgggtcctcagcctggcctgggctccatgctgcagagggggcatgggtgggagctgggagcagtgagctgatgcctgatcagtgggtcgctggacttctgaacgcaggtaagtgcatgcaaggaggcagcgtgcagcccagccctctcggggcccagattgcttcttgttaacagtgagctctccaggagtgccctgcttttttaaaaaattcacactgaaattttgtttggagcaaatgttgcttgaaacaagaaggctgttggcctccatggacagccttttgtttcaaagagcattgtgtcattgccaagtttgaccattgtaagatgtcagaatgtaacttgtcttttccgaagccgctgctgatctgctcttggtcaagcctctcaggattccagcttgagaatcatctagagtaattgtggagcctgtgggagctaggtccaccccatgaagggcgggtgtgtgctggctcctacaccgttttttgattcttgttttcccttctcttacagtattaagggacatcagcgagagaggcagggatcttgagcagattttatctcagtacattacgttcgtcaagcctgcctttgaggaattctgcttgccagtgagttgtgttcttggtttgtttttgttgaatgtagaatttaaaatttgatgatataaacgaaggtgtgcaagtttgtggagctcccctgcctgaatctcactcctctctctgagtgatcctctgtcctgaagtcctaagagagggcagcccttggtccttgtgtcctctgtgttctccaggagccctgtcctgctgttctttctttgggtagccctgtagggtcctgccagtccttaggcaggtcatttaattcccagctagttctaggtttcttgcttggtggggtcatggtgtgagaccgtttactgagggtgtatcatatccaaggagagtcctcagccatttggatctctgaagggtctgcaatgggtgacgtatggatgcactgggtgctgtgccccgagatgttcccctctgagcctctcctgccatcaccactgagccctgctttgagcttgtctttagctcccatttggagactgtcatgccttactggaataagcttccttcccttcacccttgcagactcaccagtccttcctgtggcagctaggaattctctagtgaggtggctttcagagaaggaagaacacagagagttggccctcagcccaggaaagacaggaaggggcatgttgagggaaggctaccagagacaagaggtgtggtgtgctggggctgcagaaggagaagtatttaactcaggagaatcctactgagtcaatgagtcttctccagcttggccaaaccatggtctggctcctgaattatttatagttaagctctgagaccgggaggaagggaaggaagagcttgggacttaacctggtcttggttgagatacactgggaaggctggaatctctgaagacattgaagatttagagtaaggctgggtattggaatttccctatttattctaacaataaacttcattctttttcttctgggaaaatatctcaaactgtctttgtttctttaaggatgttactagcttttacagcaacccatacttgactttggtttaaatgcgggacaggtggactttttgagccaactgagtaacattgatgccctatccattgccctggagactattgagttacaagagtaggttactggaaagagaccagagggggctgaggagctgtgaacttctttccacccagttatctatctgaggacctctcctgttatttttgacttaataagaacacaaaatgaatttattattggatatcagtcatatttaactgtcagttttctacgtttaacttagttgtaacaaagctaaaaattctgcagacgttttctgggttatttctgcttgcttccactgtccagccactctttgctcagggaagatcagctcattcccctgtaagccaggaacttggacctgataaatgtctgctcagttcaagttgggtttggggctgacaccgttgcctttcagcaatcctagggcagaggctgcacagagtaagatgcccacatgcttgaggtgtggtttatgtgttcttatgctagacttagtttgtatgccaggatgcagttacttgtagaatggtctacaaaatctcagtaaatttggaccaacaaaaaagaaaaagaaaaaagaaatatgcctctttgtggcctgactttctttctttaaaaattgggtaataatagaacctatgaactggtcatcagtgaagaatactttttctggttttaccctgtgctaggagtgaacagtgtcatgtttcagactatgtgtaaaagtccaaggtgaaccagtcccctggaaagtttgggtttttctagttcatatttgtcctagtggaatagaggcaattaagtgtttggcttcaaagaccatgttctctgcataggtcataagctgaaacagtgttcagcgttagaaatgagaacttggttgggtgcagtggctcacgcctgtaatcctgggactttgggaggcccaggtgggtggatcgcttgagcccaggagtttgagaccagcctgggcaacatggcgataccccctctctataaaaaataacaaaaattagctgggtgtggtggcgggtgcctgtagtcccagctactcaggaggctgaggtgggatgatctccccaactcaggaagtcaaggctgcagtgagctgtgatgatgccgctgcactccagcctgggtgacagagtgagacgctgtcttaaaaaaaaaagagagagtgagagagaatttgaataaaagctaaattcttgtaatgtagataaagtggataaaaatccatggtagatagttatcaatcgaattatgaactggttttggattaaccactcagtctggaccattttccctcactgatgcatgaaagtcttcaatccttctttctcattttcctcattccctgcttatcttctttcattcacatttcagctaaacaaggcacttccttaggtttccccaaatttctattaatagatgcattcactgtgaagttgtaaacaatattatatttgaagccttaaaaggtgctcttctgggctcgctagtatgaatgctgccctttccccatattcccttggagagggtctcgggccagttgtctcttaactgtattaatgcatattaactgtctttctccacagacaaagaagtatgctgatgtgatcatccctagaggtgcagataatctgggtgagtccctgcagagtgtcatcctggagtataatgtctgccctttgtcagtcataatttggggcaggatgtggtgaccctacagggctctgcagacatggctgccctgcttgtctgtgattgtgagccagcagaacctttccacctacacgtctggcctcaggaacaggtccctgggtgtaggcacccatgtgttacggggacagacatgcacttgtgcttctctggcagaatagagggctgtagattaccttttactatcacttcccaatgatgacacttgggtactttgcttctgaggccaccttttagcaaaagcagattccctccttgatctaatttagaatgacctgccatcacggtagccctttctaaagggagctggttgctaccattattgtacttatttttcattttattttattttactttagagacgaggtcttgctctgtcaccaagatggaagtgcagtagcacagtcacagctcatttgcagcctccaattcctgggcccagcctcccggtagctgggactacaggcttgcaccaccacggtccactaattttaaaaaagtgtttttgtagagatggtttcattatgttgcctaagctggtctaaaactcctacctcaagcgacccttccatctcagcctcccaaagtgttaggattacaggcgtgagccatagcacctggccccattgttttatttatttttttggcctgtctaggaagtatgaatgtctctggactaggcgtagtgtggcagagttgatctgtaaaataggacctggtttcttcattctctttagaatttatttaattttccctccatttaaaaagattatttcttgagctgtttgggagtaagttatagcaataaatatttaaccctgtattttttaagaacaaaggcattcttattcatcagcagaatgcagtcattaaattcaagacatttaccattgatatgacctcttttaacctggagatgttccctatcttttgttttttaagacatttttgaggcgtacaggcccattgtttggtagaatggtcctcaatttgggtttgtcttttattttcttatgattggtttcatgagcttatacagtctgaaggaattatcccaggagagatgtggcgtggtcctctttgtgtatcacatcagaaagcatttgatgtgtattccatttttggtgatgttaaattgacctcttggttgaggtatataatttatttctaatgctaataaaagatagctctctgcattatattttttggagggaaagagggccttccatagggatgctctgtcttaggatggaaaactggaaggttccctggtggaaaggtctcatagctaattgacgtgtcagaaccatggctggttaccacgtctgcagactttggcccgagtgcttcatccagtggtgactgatcatctcctgataagaagcccattcattaagggcttactctgtggtaggcattgtctatcttactccttagagccctcctgtgaaggaggaggatcatattagctcaggcagagccactgggaagttggatgacttgcctgcaagtggcagagccacttccctggaagtctttctactgtggttcctgcatgcccttcccccagacagactcccacactcacccctgcacccatgcctgcacccgtaacgctctgctggtctctgccccacagtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatat

SEQ ID NO: 37330 - DNA, 49193 bp, Homo sapiens
gacgccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcgccggaccccagccgcggagggtcggggccgccggtggagtctcggcggccggggtaagtggggcgccggcgtcctggaaccgccgcccagcccgggggaggccgcccagccgggagcccccgccttccgcgtccaggcgcgcgcgccagactttggagggagaagggggcgaagcggacggtgggaggtggagttcccagctcggggaaaagcccaggcaggcacccacaacccgctgcaaccggatcacacctgccaggtacacacagctcatcgccactcataccccgcacacggcgcaggctgatctgcgcacacccacaccggccaggcacatgccacacaccgaaatgcacattcctgggagcgcgggggatttggcctctacagcaggcacgtcctcacacccctccgtcacatccacggcctttgtctgctgcccccgcagcccccaaggagagggagcccccaaagcgcagcgggcaggagagaggctgcctgggttttgaaaacttgtggccagaaccccgagaccaaggggagcagatgttgcagtcggttctcggagttctgcaggagcgaatttggtgtggaaactcggtgtctgggtgatgtgtgagtgtgcgaagcccttccggaggcgaggcccggagagaggagggagtgattcataaactcagagccggcgtgccagggtctgtgagcagcgtggaagaggctggcaggccgttgctgcgctagacagaagggtagtggccgtgacagtcttccagggaagcagggacccttccccccagcggatgtgcttcctccagggacttccaagggaaccgggtgagcagattccagtcctgggtgtggacggggtaaggggaggtggggggatttaagcctaaaaggttagggagaaaccaaggcaggcctgacgccttcattattttccttgcacctgaagttgtgtttggtttctgatgcgtggtgttgctgggccccaggatgtacgggggattgtcctgggcctagcatagtgcctggcacagtgggcactcagtcagtacttgcttgatgaataatgacaccggtaattatcattcattatggactcactgtgcggcaaggccagtgggcctctgctgggttgaaattgattttccagcagagaagggggcctgagtagctcctaggagccctgcctgatctgcttgggccagtggcccaggcactgtgtgttccactgtgtcccgtgggctggccttgggagactggagctcatcattggcctctgcccctctaagagggcagcaggaaaagcttcatttctgtatctggctaagatggggttgatgtgggttttggtagatggcaggctgtttggcagattctgtggggtctcaattgaagaataactttagatctgcagcagagagaggggttggttccatcaaccctcccatctcctggctgctggagaagaggggtgggtaagtggagaaagagatgggccgtgctgctgggcatgtgctgggggtaggaggaacatgggaacatgtagaatttgggggcagccgtttttcttcctggctcctgatggcctggctggagatgggtctcatgaagggtctaggagctgtgttctgcagcagtggcttggctctgtggtggcagcaggtagagcagtggtcacagtccctgtactgagtattgctgtgggttctcctgtgccagcttgcatgagtttcccagaggagcagaaacattcgtgttcctggaactggattgccagtagtcttgggattgagagtgcacaaagatgtgggggtggcctgggcatgtcatccaaaagaaatgtgtcattccccacccctgcccccttgtgaagagctctgactaggttcagtgtgcatttcaaacttctaaatgctgaaattagcaaggcatgtgggcggcaccaaggactggcctcagatgaaagaggaggtgatctgggcttgggcacccccaatttcaggtggaaccctgcagccagttccttccctatatcacctttccaccttcattatgccctctgtgaatcgagagttctgtatacattttctaattaaatcattatatccctatgaggttagcatttcatctccattttgcagattaggaaactgaggaccagaaaagttaagtaactttttcaatgtcacacaggtagtgagagacaaagccagtgtttgtgtatttggtttttttaaactttatgttaggttcagaggtacgtatacaggtttgttacataggtaaattgtatgccatgggggtttggtgtacagattatttcatcatccaggtagtaagcatagtacccaataggtagttgttgggtttgtttgagacagggtctctattgctcaggcaggagtgcagtggcacgatcactgccactcaccatagcctcgacctcctggactcaggtgatcctcctgccccagcctcccgagtagctggcaccaccatgcctgactaatttttttgtattttttgtagagacagggttttaccatgttgcccaggctggtctcaaactctggagctctagcgatctgcctgcctccacctcccaaagtgctgggattacaggtctgacacactgcacaggcccgagatgggtggtttttgatcctcaccctccccactgtctccaccctcaagtaggtcctggtgtctgttgttcccttctttgcgttcagatgtacccaatgtttagctcccacttctaagtgagagcatggggcacttgattttctgttcctgtgttagtttgcttaggataatagccgctaactccatccatgttgctgcaaaggacatgatctcattctcttttatggctacatagtatttcatggtatatatgtaccacatttctttatctggtctaccgttgatgggcatttaggttgatttcatgtttttgctattgtgactagtgctatgataaacatacgtgtgcatgtatctttatggtagaacaatttatattattttgggtatgtacccaataatgggattgcttggtagaatggtaatcctactttgagttctttgagaactctccaaactgctttccacaatggctgaactaatttacatacccatcagcagtgtataagcactctgttttttgttttttgtttttggtgggagtggtgggatggagtcttgctctgtcaccaggctggagtacagtggtgcgatcttggctcactgcaacttccacctcccaggttcaagcaattcccctgcctcagccccctgataggcgtgcaccaccatgcgtggctaatttttttttttttttgtattttagtagagacgaggtttcaccatgttggccagaatggtctcgatctcctgacctcgtgatctgctcacctcagccccgcaaaatgctgggattacaggcatgagccgcctcgcttggccagcactcccttttctccacaacctggccagcatctgttaatgtttgactttttaataatagctattctgactggtatgagatggtatctcattgtggttttgatttgcatttttctaatgattagtgatgttgaccgttttttcatatgtttgttggacacatgtatgtcttcttttgaaaagtatctgtttgtgtcctttgcccactttttaatggggttgttttttgcttgttaacttgttcaagttccttatagattctggatattagacttttgtcggatgcatagtttgcaaatattttctcctgttctgtaggttgtctgtttactctgttgatagtttcttttgctgtgcagaggctctttagtttaattaggtcccatttgtcaatttttgtttttgctgcaattgcaaagccagtatttgaacccagattgtctaactccagaacccaccctgtctccaccatgccaggctgtctgcaaggcccttattggttctccatggcaacagggaaacagccctgatgcttcttactaacgtggtcccagggcctctgcttgcattcttctttttccatacactctgccgagcctggatataccttaggctgtgggaatcaaaggctgggtggtaccaggctgctggagccttctgtgtggctctggagtcagaaaactgtggagattttgggggggcacacagggagatgttgcagtaattccagtgagacatgactcactgcttatctgagaagttgggacaaagctgcctcttgtgaccataccgtgaatagggaagaaattgccaggtagaccaaacatcctcaaatgggttactgtatttttttcccctttttggtcctctccagggtaatctattacctggggaaatcagccttcacctgacacctcctattgtcatttacctggtgaacataaggggccatgtcacagctgtccttcccacccctgccacgtgttctggagagctggactcctcagcagcacctggtccacaggagagaagaatggggcagagccggagcagccaggggaggtgataaccacacgctcatctggtccccagctcttgcttttacatccacgccccacagggagacagcaattatctgttggccccactttacagatgaggacatgaggctcagagaggtgcagtggatgcccaaggtcacgaagccaggcatctgcaaaggcctgggacagccacgttttcagtcggggtggtattttctatccccggccccaagggctgagagtggttatccctgctggggcagggtcctcactgctccacccaccctcatctctgccctgagagcccccagtacagatgtccatagaacgggaaaggctggcgcccttcaaaggacgcaaagagcattggatgagcactgcccagctgatccctgcccaccttccacaggaagcccacctgggtgagttcttagagccttcctagtgctgagctgcaaagaaactggagccctctccccctccactgcagaggggacacagtgaccaggacggaagttgggggactgggtgtggggagaagccaccccactgcaggggccggggctgtccatctttgtacccctggttccatcccagtgcctgaggcatgggaagttcttggaaatgtagtcagatgctgggtgaagccccaggaggggccgtgaatgcttctgctgggaactcctagagtggcggcacagagagggtctttgctgcgaaggaacactcagagagtctctggctttcgtgaggttatgcctcaggagaggagacacttctccttttcattcgttaaacagaaatgatatttgccaccttttcttctctaaggcctaaagagatgacagaatgctgctggtcctaccctgagcgcgtggactccacagcggggtgtggggtggcccctggcaggcctggacggtttgttctgtgcttgccggtggacacgcttcagccctctgtctctattgccccaaatctggcctgtggctgctgggccgccaccagcttggagggcagggtgggccccgggagcccctgaccaccagtgacttcttgtctccagctgccctccgtcctcttgatccccctcaccccccaccacctcctcacaaagatggctgtgtgctgagggactgtggcttccctgggccctaggaaatttatcactgaggtttcagaggactctatgaaaaggatttggagaaaaagtgtggaaaataaacaagccagttcccagttcagcctctcctgaatgccgcaagtaaacaaccacctcggaggccagcccgggatgttcttatttggcctctgtggttacacctgccccctccccgcccagtccctcctccttaactttaagagcctcaaaagtcagggaacacaccctccgctggccagtccttgtgctgcagggacgctggtggctgggcacaggaggaacatgtatatgggagagaagacggccgggggtcccagctcagccctgctccctctgagtcagtcccaagcctggaccctccccagcaggcagacggtgacgtcttggttggttggtgagtttaactttgatggtgcagaatgatgagacttttctccattttgtggcatctgagaagctttgcttcttaaacattgctttagggtggatagaccaaagctaattttcccgttatgtctctccaagacggggcctacctgtgagcaaaccctcatagattcatttactttgtaggctacctggacaaaaatgtcaggtttctttgctttgggctggagtcctatcagctcaggggtggtggtgtaaggtcacaccaatgatttccagaaactcaagcactattctgagtgactaagtctgtgggataggaagcacattttccatctcttaataacttcaatttacttagtgaccaactttaaaaccaggcacccggttagaagggggagagccagggcttggcagcggagggtcctcaccttgcatccagggagtggctgagggcccttctcgttctctgtggctgtgctgagctgagtcagcgagccctgaagcctctgggatttggggagtggggcactgctggaaggttctggttcctgctttgttctgctgctgccaggcttctggagagggtggttgtggggtgagtcctgcgctccgcacgtccacatgttcgtattctacatattgggcttctgaaaaaagttctggttcataagacggcttcacagcttagccgtctgcagaccagtctgcaggttgatcagctttctgtcatgtgtgtgctgttcctgttcacacatgctgcgccgatgcccgcctgtgcctgtgccagccccagcccacacagctacctgagatttagccctgggcatctcccctaccctttcccgcttccccctcctctcctcccttcctctccagctgcctcgccatctgcaagattctggaaagtgctaatgtgtctgagccaaacagtgctatctgaggaaatattttgaaaacacactgggccacccccgtccccgcactgtgactacactgattttcagcaaggaatttcactccagccacagggcagggccgcaggtgcctggctttcctctggagacttccaggggcttgttagagacacggagagaagctgagggcctgtcctgcaggtttgatgtgtctgaagaggccccgagaatagaaatctagaacctgccagtcacgaagcagtgtcacccaccagaggatgaagaactgactgtgacctcgcaggtcacccacttgctttctttttaccgagacatgctatttctctttcacttttcttccttctcttgcatctggtgtaggtgcctgggggtagcgtgcccaggaaacaataatagtaagagcagctggtgtgcctaatactgccctgagcacctacaaggcgtcctcaccgagttctcaccagaagctctagaggtggctccggttattcccaccattttacagatgggaagacagaggcagacagctggataagttgctgacatgccacagccggtgaggggcaaagccgggcctgagccccacagctgactccagagtctgtgctctcagtaccacctgtgcgtgcgtctgtcccgttgtggctgcaccgagaggagaaacagcacacaggcattcattttcaaaccgtggccagtgcatgtcattgcgttctgactgggaagctctggcaatgttggcgttgcatggcctattgtgggcactaccagtgagcctcggccttctccaggtctgactccagtacctgccggctgccctgggcagggcattttggatcctgcctcagggtcttttgcccgctctgctgatgccactcccctgtgccctgacctggtcacaggaagggtgcagatggcagcgagtgtggtctcagttagcaagggggagctggcagatccagggacttctgcctccctagtggccattccagcaagacaggaaccccaccccgagtgatgtctggccctgtgacctttcagcaaatatttcttccccagcctcacctggactcggtatcccatgttccaaattgtcctaatttcccagacacacacaccctgctctctgtagccttcccagctgccaagaacattccctccttcccccttttccccttggcttggatgccaccttctcctggaagcctgggtggtggccctccccatggctgcccacaggtccccctcactgccctttgcctgtggtattatgattgctggttcagtgatctgtggtctgcaccaggcaatgggatgtgcaagggcaggacagctgtctgccttgtccatccttgtagcccccgacttagcagtgaatgctgctacctgattatggaaggaatgagtgactgatgtggcacagagccctcagtggggcaggcccagtccaggatgcttctgtgagggagcgcttcgagtctggggagggtggcaggagtcgtggtgagcgggaggggtggctaacgtgggccaaggaagggacagacaggaagagtgggaccccggcacatggcctcttgaggtcattaccccatgggtattgggctgggatactgaggatgagcctgaaacccttccagaagcccctccagtcctgccacttgtctgcctgcctgccctggatgcccgtttttgggctggtggctggctgcactctgggcccactgctcaaccccaccagcaagtggagagccattcaacagccccagggtccagttcccatctgcaagtaacgaggcctgccgtggctgagtcgtttccctgagcagagagaaggaagccctactggccggctgcctccccaggggtgggtagaactgttctgtggccccacctccagccctcaagctgtctgtccttgcaaaagtagtggggcacagagtgctgggttcttgggcatcacctgtccaggtcctgcgcgcctatgctcatgctgacactgcaagatggtgggataacaggagggactttcaagctggaagagaggagagctgggtgccccagtaaccacctttgagtcccactgtgatgagcccacagaggtggacatgagggaagacttggggaagccttcctagaggaggcaggcattccagtgcatgagggaagctgggcaaaggcacgaggatgggaaagttccgattgaagacagggactggtgaggagtctggctggactgaactgaaatgtataggatacacgaggagagacaggcaggatggagttgtggttacgcacacaggctctagagccgggctgccttcacgggaaccccaactccccacttactggctgtgtggccgtggccaagttgcttaccttctctgagctcagttttctcactactggtaccccccacatggggaagacatgggaataaaatgtatttctatacaagtgttgagagcagtgcctggcacactgagcatcaggaagggtgagctattattatataggtatatgttttaatgcagctagaaaaggaaattgaggtcagatcatagaggcccttgaatgtcattctttccattcactaagcacctgccatgtgccagattcttcacagtcattctcaccaagccccctacaacccggcaaggttgttagcaatgtctccatttcacagatgaggaaactgaggctcagagaggttgagtaacctgcctaaagtcactcagtcagggagagtcagagccagtaataacacccaggtctgctgtcgcttgagtcttccctcaaagtgaagattggagagacatggcaggggcatcacagggatgagccctgggctggggccgcagccaggagcagagcaggaatgtggcaactgtgggtccctggggcagggtggagacggggagagatgccaggcgggcctggagggtagggaggactggaggctacagcatacagctcaccattcatagcccagggcaaaccattgagtcatttggggaaaacatgacatcactgagtctcactgtctgccgcccacctgctgtctgccctctatggttctcctgatgacctcagtgccccaagtcctgcaaggggacccgcacaccccatgtagcagggccaggtcagcactccagcttcctgcactgggttctcctccccagccactgtctcccaccttcccaccactcccttccctgcctgggtcccctgccccagccctactcatacacactgctgaggcagaagcttctggaagtggtgatgggcatgaagagcttccagaagggcttccatgccaagcccttgattggaattctgggtggggaggggacagctcagaagcctgtgtcgagcttttagagttgcttttccttgagaatggtgcctgctgtttgggtgggatcacttttaaaaagtaaagcctggtagagctatgtgaccagcactatgccatgacctagaggagattcagactgacgggcaggccctgccttcctgcagaatacagttgagtgtctgagagttctttctgtactaagcatctttgaactgagtgctttattttcgtccatctgattgcgcgaggtagtcttattttacagatgccatccccgaggcccagagaggttaggcaacttgtccaaggccacacagccaggattcacacccataactgtccaactccagatgtgctcttagccactctgccatccggccacaaataaagccaccagagaaccacagaaggtggaacatatccaacatttgcccgataaattgtatagtgcagacaggaagtacagggagttttcatctcaaagtgtaggtcactccccagagtggcttgaagtctgtagatccatttaggagaacatccagcttcactggctgtgcaaatcccacccatgcggctgtttggggtgagaagtttctttaaatgtctgttgactctcttctctggaaggagcacgggggctcagggggcgcctgtcctggcattggtggccacacctagaaacggactatgaatcaagccaggggcccagtgccagcttccttggcctgtctgtgggcgcagatgccagcctttgcagctgctgctgcaactcacagctctctcccggtgccgccctcagtcaggccagctggagtggaggggccagtggccgtgccctgtgcagaatgacatcctctcaccttcacaagggaagcgtgattatccttgctttccaggtgaggacactgaggcctagagaagttttctggctgtctgagctcccttggcctgagctcccgcggtagaaccgagactcaagtcttctttctgcaggcagatggccagtttcttcctggaggagggaggagccagcttgccctctgacactgggtagcacagccctgttcgattctctgttcggggcttgcacttctgattcattctgcagtcactggctctttgtggttcgggaaaatgaccctctagggtaggagaaaagctcttggagcacttttgaagccatagaggccctttccaggctttggaaaatgttccttctccacccagatgccaacaccaccctggtcctggcagtacttgtccctggaagggcctcactgcggtgactcattacccagcatgcagcacattgccattgctctcagtgggcaggtgctgtggggacacgggtctgcgggcctgctgtcttcaggggtcccccatgccttttaacgcgtgtatcagtgtaccccaagcctcagttctgtgtagtttgtacaactctggcccctaccccaaggatttctgggaagcccccaggaatgctgataagttcacagtctgccctccccagccccagtctcatcaggcttcaggggtggccattcctcccctccaggagagagagaactcaaaccagtaactacccctcctcaggctcaggcccaatggttgctgtaataatttctggggagctgtctttgctcttgcagagaaggcaggccttgaattcagactggaggggccatttttcttccagttgccctcaaattttcctttctgtgataggatttgtcctttgtctctgcttaaattcaaagacttgttaaaatgacttttctcaaacaagaggctaccctcaaaagaactttgcctctacggatagaaaactggaacctacttttattttggttttagttttattaaattgtataaaatcaataatacatgtccatggtgcaaagttgaaaaggcacaaaacagtctatgtgtggtctctttcccatgccggactcagacactcagcattgttagttttgtgtgtgtgtgtaagctgtgtttaaattgtccagctttaaaacaaaacccttccctgtttcacaattaggttgaccgaggcacaacctgaaaaataacctggaaatagcatcgggccccctgcagcgtccagctcttcccgaggactgttattatgataacgatcattgctaaggctgtcccttcccaaaaagtgttgctgcccacagtcccagcccccagacctgagcagtcacccacacagcatgaatggggccagccccagcctgcccgctcagcttccaagcctagcagtctcaggctctgggctaaccctggcctcccagctgccccttcaacattgtcccctcttgtcttgcagggcagtagccacagctggggctgtggggtcagggcatggcaagggtgatctgaccaaactatgctgcctcttagccagactgtatattcggagtcccctaagctcgatttttttttttttttttttgagacagggtctcactctgtcacccaggctggagtgcattggtacagccatagctcactgcagccttgacctcccaacctcaagtgatcctcccacctcagcctcccaagtaggtgggactacaggtgtgctccacctaatttttaaatttttttttagagaaggggtctttctatgttgcccaggctggagcttgattgtttgtttgtttgtttgtttgaagacagggtcttgctcagttgcccaggtttgagtgcagtggcgtgatctcagctcaccacaacctctgcctcccagattcaagtgattctcctgcctcagcctcctgagtagctgggattacaggtgtgcaccaccacacccagttaatttttgtgtttttagtagagacagggtttcatcatgttggccaggctgatttttttatttttttaaagaaggtctcccaccagctggatctgagccactggctgagaagtgaagtccatgaagcattcagcaatagtaacagcaccaccacctcctcatattgaacctgcctctgtgcttcttcctacgccttcctatgcctctatgctgacttctggagaagccagtcacttgcccggtcacactgtacaaagtggctcagggctggactcactggcttatgcctgtaatcccaacactttgggaggccaaggtgggtggatcacttgaggtcaggagtttgagaccagcctgaccaacaaggtgataccccatctctaattagctggacgtggtggcaggcggctgtaatccagctactcgggaggctgaggcaggagaatctcttgaaccagggagacggaggttgcggtgagccgagatcacaccattgcactccagcctaggcgatagaccgagcctccgtcttaaaaaaaaaaaaaaacaaagtggctcagctgggcttggatctccaacatgctgggccccagtcaccagattcctaaccccgtgctgccaggcttccccggacaatatcatgaactcaacaatccgctcccttcctctgcagggcaacctctcattccccagagctcatttaataacaagagtagtaatcatagttaaccttctttaccctttactatgtgcaaggcattgttctagaagcgcacacatcgatcatttagtcctcacagcgctcccatgtggtaggtgctgtccttatactctttttgcagataagcccaaggcacaggagcctgcctggtaagcagcccatgtctaaagggcagtgaagaaccggcctctagggaatgcagggctcctcttgtacccagaggggaggcgccctgcctcttctctgttgagcctttggaaatggcctccgaggggcccctgctcagcacagctctgtgggccaagagcaggagtgtttgaggcacagatagacgatgtctggacccctccccaggatgcctccccatgtctgaccttggggagtccagtgccaagggggaagttcaataacataccaggtttctccttggccctgggacaggttccttccctttccttccctcctccctgcatccttccttcctttcttccttctttccttacatatttattcagtgccatacagcgatagcgcacacgtgttacctctaatacaaggtgaaaagtgatatgaatggtgcaaggtagagagaggaatggtgctgggagaggaacgtgtggtaggaggccctcccttcacatcctggcctcaaacctccagccggtggccttgggcgggtcgctcagcgtgtctggacctctgtttctcatctggataatgaaggagagggtggaggtgaggacccaggttgcctgccaggctcttgtgagaattggaggtgtaaaagggctttcttttttgtttttttagacggagtctcgggaggggggttagatggcgggagaggggttagatggcaggagaggggttagactagtcccctgggggattggttatggctgtgggggaagtcggagggaggctctggggatgtgtagggtttgggctcggccttaagggatgggtggaatttggccaggcacagatgggggaggggtggtgctttgggcatcaccagccctaggctcatggttgccaccctcccttccggtaccgccttcccttttctgcatttccacccagagatggactctcagctttgaattctttttaggaagtgactttattgtttttattttttttctctatctaaggtagtcagaatattatttttgtgataatgctagatgcttagtatgtaaaattcaagtacaatgggtaaatacagagaagaatgcagcaaatcaccaccactcccaccacccagatggaactgtttagttatttggtccgtatgcgtatagacacctcagtaggcctacccggtgggtgggagtgggagcatgggggctggagggccagaaagttttataagcacagggaaaatgcacagtttaaatttaccttcaggccagagttggaaagattgtctcacctgaaacagtccttcccttctgtccgctgcctacatgactgtatcggatggggaaagagggaatggggaactttcaggccatggccttcaaaacctccccattcagacaaattacagaaaaggagccagtctcagtgagcatattccagctctagaacagtggctttccaacttttagactaaaacctcagacacagacacccacacataactgaaacaaaagccttatgaaacccatattttagctgggcacagtggctcatgtctgtaattccaaacactttgggaggccgaggtaggaagatcacttgagcccaggggatcaaggctgcagtgtttgcagcgttgtactccaacccgggcaacaaagtgaaaaaagaaactcatgcttatcaactcatgcttatcattatgatacagaggcattctgatattttctaatctacacaatgctgttgtgtttaaaaaagaaaaaaaaagcttatcttaacctaccaaattgttggcacagcctgcagtttgagaaatgtcactgttgaccagcgattttcaaacgttcgtgtgcatcagactcaactgcagagtgtgctaaaacaatctgctcccctctcctgaggttctgagtcattagttctggagtgggacctgaggattcgcatttccaccaagttcccaggaggggctgatactgccagtctggggaccccactttgagacccaccctcctggggtgtttttaaggcaacatgctcccttggcaaagaccatcaggggatttgctttattgaatggatgagaattgctgattgctaacatccgaacggtggatctctgagatacttgaggatgctggtcaggcattgtcgttgggatctttaacaccaccctcctaaaatccagctcacactattaatataaagtgttgcatgtagaaaaggcctgctaagcaaagggacatttatgcctagccctagttgaattccctgcctctcaaatcccagacctgcagaacataaaaccctcccagcctttctgaaaacactgttcttctaaaggcaatgaaaggcgctatttagcatgtgggtttcaactttctgttttttcaaagggaagaaggtaggtcaagcgtgactgccccatggggaaggctgtccccgctggctctggtaggggtctggtgggtttcactggcggtccccagtttcccagctttaaccggaaattttcctggcattgtatcacgcggcagcacctcggccttgcagcctgccagctttggagactggcctgtatcccaaactgcttctgctctccaaccagggactgtcagcccccacccctaagcctcctcctctgtagccttggggcctccatgggcccctccccagcctcgcagccctccagaagccagccctcagctgggagcagctttgcgagggaggggaatgttcagtgggcacagagcacttctgttccagtaacaatggcccgttgatgactagattctgcccaggtcagctccctcaactggactttgaggaggagaaaggactccagcccccccaggcagccatttctgggtgtgaggttgattcagaggcctgagcctctgtctgcccacagaacctcattcttcaggccctggtgcagcagggagaaacgcccatcccagggcagtgtaaggccccaggagtgattccgttctgtccaattcaacagtcagttattgaatagtcctggccactgaggtttggtgctaagtagctgtggggaataagaataactgctgacatgaattcaatgcttcttactgtcaaccccgcccctggctgcccagtagtctctagggaacttataaaaattcccaggcacagattcctcccacctcagaatcttcaggggtgaacccttggcactgatattttttaaaagctctcagagtgattctcatgcccagcagggatgcagcatcactggcctccagtctgtcagatgctgtgctaagcatttaacttggagtaccccatttaaggaagcaggtgcttatgggatgctgaaatgtggcccccacagatgtccacgtatgagccaccagcacctgtggatatgtgagcttgcatggtaaggactgtccagatgggattaagttaaggattttgagttgagagattatcctggattatccaggagagccctaaatataatcacaagtgtccttataagagggaggcagaagatttgactacagaagaggagtgtcagaataatgcatggtgaaaaaaactatcagccattgctggtttgcagatggaggaagggggcatgagccatggaaagcagatagcctccagaagctgggaaaggcaaggctgcagactctccagaaggaacccaggccttttggcaccttcatgttaagtcagtgaaactgacctcacacttctgacattcagaactgtacgataatcagtgtgttgttccagctgggcacggtggcttatgcctataattacagcactttgggaggctgcaacgggaggatctcttgaggccaggagtttgagaccagcctgggcaacctgatgaaacccctgtctctacaaaaataaaaaaattagctgagtgtggttgcacgcatctgccccggctattcagaagctgaggtgggagaatctcttgaacccgagagattgaggctgcagtgggccatgatcatgccactgcactcagcctgggcaacagagcatgaccctgtctcaaaaaaaaaggaaagaaagtaagtgttatttgaaggtactaagtttgtggcaatgtgttacaacagcagtaggaaacagatacggggctgtcattaaccctgctttacagatgaagtacgggggccaggcagtcacctgggctcacccagctagtgggctaccgagctggaagaaccaggttgtccgaccccttcttcactgcccaccacacctcaccacactgccccctcttggcagtcagacagacatgggttcaatctcagctctgtcatcttctgtctgtgtgtcctgtgctgctggtgaggcttgtttggccagggggaggccccaggaaggggaggggtggagaccagttggaaagatagggtgggccaggttgtccccaggtggaagagtttggacttgattttggaggaatggagcccacagggcactgtctggtctcctctgccatatttcttgatgatgcctcagacccgcaggcctgctcagtctttgagatctgacataatgcagcaacccagctcccattgagaacctcaggattgggaccagaatcatcattctactccttgtcacccacagccagtgacagccatttatctgggacggccagtgagctcctgtttcccaggaagccagcagtggccctggtgcctccaaaatgtttcttccaagattctcctagaaccatgcatttgggaccatgcctttttttttgaaaaggagtcttgttctgttgcccaggctagagtgcagtggctcaatcttggctcactgcaacctctgcctcccgggttcaaacagttctcttgcctcagcctcctgggtggctgggattataagcacatgccacgatgcctggctattttttgtattttcagtagagacggggtttcaccatgttgttcaggctggtctggaactcctgaactcaagtgattcacctgcctcggcctcccaaagtgctgggattacaggcgtgagccactgcgcctgcccaagaccatgcatattttttagagtaaaagtatgaaatacaaacaaatacagagagttttccagatgaggcaggaaaatagggtctagaggcagggaatgtaaggccaatcacacttcagctataacaggaaataccctctccatagctcgtgctctgtaaatgactttgtaactttacttcatcctctccatttacatagggcgtacccaaaataacaaatggaatcctctagagggtatttaaactccccaaaattctgtaacgggccttttgtttgtttgtttgttttgagacacagtctcactctgtcacccaggctggagcgcagtggcgcaatctcagctcactacagcctccgcctcccaggttcaagcaattctcctgcctcagcctctcgagtagctgggattacaggcatgcgccaccgcacccagctaattattgtatttttagtagagacggggtttcatcatgttgtccaggctgggttcgaactcctgacctcaagtgatctgcccgcctcagcctcccaaagtgctgagattacaggcgtgagccaccatgctcggctgacggccttttgagctcctgtgctcgggccgccccacgctgtggagcgcactttctcagtaaatcccttcatcccttccttgctttgtgcgttttgtctaactctgtgttcaagacaccaagaacctggacaccctccacctttaacacaaagccacaccacaagttggtgacaggtcctgaaagatcagttcctgactaggactctgatctgtccactgctgtacagctgctcccttctggctaaatcagcttgctcagacacagagcatagtggttgaatttgtggactgtggagccaggcttcctgtgttccgatcccagctctgcctttaactcagggtaagttttctcatccccttgcctttgatggggatggtgactattatccataagcattatccagggttcttccaaagattaagtacatttatgtacatgaagtacttggaacaattccttgttcactgtgttaacttctgttactattcagctcctctagggcaggggctgtgtcttttccttcctgttcctagtgcctggttccatgcttggcccagagcaagtcctcagcaaatgaatatacttgtttcatgtgagcttttgtcactcagagattctttaggtactttcccaaaagcttgcactcttacaaatttccatcttagttcttcaaatctttcttctcctccttcctgccgcagaattgccatagagcagcctgaagcttgctctgccccttgcaaagtccagtgagccgttcaaagataacccagatgtcccaagcctcccagccagagtgcctgtgctgcgcagctggcgtggttgccccagtctccttcgccccaaggccatgcttggccgaccccctgacccgctgaggttgcgcagagctttttgggccctgtagcagcactgcttgggcaccaagccttgcatggtctcatgggactcactgcctgcagccgctagtcccagctcccctccttaccagaacccacaccatgttgtccagctgatgggggatcacatatcatgctattccctccaggatcctgtcccctgtttttctccccctgccatgaggagtagcatcctcatttagcctttccctcagaaagtccccacgcttatcactacacatgaatagatcccaggaaggtcactttctcatggttctgcaaaaagccaaactccagttgaggtccagtttgaacccaactagttcactcctctgccctagaaaggccatttctgctcaatcttactgccccacctctacttccaacttgcaaagatctcttgaaaccctgcctcctgttgtgggagctagttttcttttcttttttttccttttcattacacagtttcattttgacataacagtagattcacacgcaattttaataaattgtacagagaggtctcatgaatctgttacccacttccccctatggtaacattctgtgaaagcctagcctaatgtcacaatcagaatgttgacttcatacagaatcccctgtggtgcccttttataactacactcacttccctcctgcccccaccccttccttgacccttggcaatactagtctgttctccattcttacagttttgtcatttcaggaatgttctataaatggaattatgcagtgtgtaaccttttgtgattggctgttttcactcagcacagttccctggaaattcatccaagttattgtatgtgtatcagtgttgtttttttttactaagtaggtaaaacaagggacacagacctgttctcctggcatccctccctggttagcaagagattcagcaggccgctgccactctggccttgctgatagctagtgtgtgtgcaggcagcagctcccgctgtctgtaagagcgccagggtagtgaagttgggtgctctaaaagtagtggctctccatctttgctgattctaggttagaatcacctaaggagctttaagtaatcttgatgcccaggccacaccaatgcaatctgaatctggaggtggcacccaggcctcagtgatttgtaaacttctctggatgattcttatgctgtcagagttgaaaaccagtcctctaaaacagccgcagcagattcacaatagctgtgccatcctccacccatgatagatgtcacagagcaatcgcagcactcgtattttcaaatacggcgctccaggcagccccttcccatctgtcagctttggcccggggtggaaattgacttgccctcttagctgagaaaccgtttggccatggccatgtccaggtgtgcccaggcccgaggcctgacatgttaggtgagtgtccctgtaagtaatgctggaaaggtgggcccttgaccgataggaatagttgcagcaggcagagatcgcctggggctggttctataagataaacccgaagtggatcagccagtgtccctcccctgcagcccagcatggggagagatgtacccaagaaataccaaccaacagtgccattggcatagacgggctctggctgacatttgttcagaccagcaataatgcccagcctgtgtgcaatcttcccaattttcggagctcacacagcttccttgatgctcacaacaaccctgtggggccagcctaagctcagagaagttaaattcctcacccaacgtcagcagagagtaagtgggagagctgggacccactccaagtctgtccgagttcagggccatctgtccaacgctcagagcagttagacaattgacctctgtttccactggcagaccgagtgtagatgggctcctctgtggccatagatcagtcagaggatagcagcagacacatgcggaccaagcctcctgctgcccaagacccctgtggcccctctctccctaaccgctgcttctcctacagatctagtgcagagatgttggacagaacacaagaggttgaagtcagggcgggagcaggaaaaaaaaaaagaataagaagaaaagaggctggagttcctcctttcatcacaggaataaaaccccttcctgctgtcaatgggaccattaagtgggagtttgaggaagctccagaggattcaaattctgttgccactgtatagaaacagaggagaccgacgcagtgactcacatctgtaatcccagcactttgggaggctgaggcgggcagatcacttgaggtcaggagttcaagaccagcctggtccgcatggtgaaaccctgtctgtactaaaaatacaaaaaaattagctgggcgtggtggtgcctaactgtaatcccaactactcgggaggctgaggcaggagaatggcttgaacccgggaggcggaggttgcgttgagccaagattgtgccactgcactccaccctgggtaacaagagtgagactgtctcaaaaaaaaaaaaaaaaaaagacagaggaaatagaagtagggttggaagaaaacagggagcagaagaaattctcctctctgtcctgtcccttacttgatcattctccaggatcagaaagcctccttagaaggtcaggaaggaggatagagcaagaattagggatcctagacttatgcatggagagtttttctctacccggttatctcagaaatcctgtaatggagccgtctttccagaggtgcagaacaaaatgggaagctgtggccattgtgtagccattgaaggctagcccatggtcccctcacagcttccatgggcttctcccgagcatgtgcacgtatgatgcacccattgcatgtatacgtacatgcacacatttctggtcaaaaggttgatgattgataaaactgacaaaagctccaaaccccacaaatgagcacagcgttttgtaataatgagcatgaccaaaatgggaaaaaatagggcacatgagggatgagggaagaaaaaggactccagggcccagaagattcctaggcttccttagccacctcctcctaaagtaggggtaataagtacatggcacatgtgccagcccttcccctgtgatatagttgggatatttgtccgcacccaaatctcatgttgaattgtaatccccaatgctggaagtggggcctggtgggaggtgtttgagtcatgggggtggatccctcatggcttggtgctgtcttcctcatagtgagttcttgccagatcaggtcatttaaaagtgtgtggcacctccccattctctatctctcattcctgcttttgccatttgaagtgcctgctcctgctttgctttccgccatgattgaaagctccctgaggcttcaccagaagccaagcagatgccagcaccatgcttcttgtacatcctgcagaaccaagagccaattaaactgcttttctttataaattacccagtctcaggtatttctttatagcagtgcaaaaacagcctaatacaccctatctatacacacagcagacatcactactcaactgccatgttctttcccacagaaaacaagcctgatctcaggattcttctcatcaaagtgctccaggctgccaattaccaacctattagcttttactcatgagatgaaaatgatttgccaggccgggtgtggtggctcacacctgtaatcccagcactttgggagtccgaggcaggtggatcacttgaggtcaggaattcgagaccagcctgaccaaaatggtgaaaccccatctctacaaaaatgtaaaaattagccgggcatgctggcactcacctgtaatcccatctactcaggaggctgaggcaggagaatctcttgaacttaggaggtggaggttgcagtgagctgagattgcgccactgcattccagcctgggcgacagagcaaggctctgtctgacagaaagaaagaaagaaaaagaaaggaaggaaggaaggagaaaataatttgccagcctcagcttgagcccaggagttcgagacaagcctggacaacagggaaagaccctgactctccaaaaagctttttttaaaaatagcgaggtgtggtggcacatgcctgtgatcccagctatttgggaggctgaagcaggaggatcacttgagtccaggaggttgaggctgcagtgagccatgatcacaccaccgtattccagcctaggcagtggagcaagacccgtcctcaaaaagaaaaaaaaaagttggaaacctgatacagtcaccatttttgtcaggatccctcttgcttgttctgggttaggttcatcacaaagctgcttagatggacttggttattcaagtaaatattaagcgctaactgtgtgtaggatgatggattgggacacaactccatatgctttttatttccattatttttataactttctcttatattgatattttagtaacatggtaacaaatttaaacaatagaagaaagtagaagttaaaagtcagtgacagttcccacccattccccagttccctcaaccactcttgtcaatctcttctttccatctccaaagatatccagcatttgcatggatccagtccagtttgtaggcagttggtagcatgccacgcatactcttgcccttgcttttatcactcatgtcttgaacagcattttatgtcagccctccagaacttcctctttctttttaatcattacagagtattgcactgataaatgtacctaacattgagctaacaagttgctgttttttgttttggttttggttttgcctattaacatgcattaatgtcatggttagccttttgtaattataatcgatttattgttgtatatgtccttgttgtatccatgcaaatatatcagcaagattagttcctagaagtggaattcctgggtcgaagagtgttatagcagtcctttggggctgctataacaaataccatacactgagaaacttacaagtagcagaaatttattgctcatggttctggaggctgggaagtccaaaatcaaggagccagcagatttgatttggggagggctgctctctgcttccaagatggcacctacctgtggcgtccttacctggtggaaggagcagacaagctcccttagggctctaataatttttctttttttttttgacacggagttttgctcttgttgcccaggctggagtgcaatggtgtgatcttggctcaccgcaacctccacctcccacgttcaagcaattctcctgcctcagcctcctgagtagctgagattacaggcatacgcctccatgcccagctaattttgtatttttattagagatggggtttgtccatattggtcaggctggtctcaaactcccgccctcaggtgatccacctgcctcggcctcccaaagtgctggaattacaggcatgagccaccatgcccagcctctaaaaagaacactaatcccattcatgagggctccacactggtgacctagtcacctcccaaaggccctacctgttaatgccagcacactgggattcgattacaacacaaaaattttagaggggcacaaacattcagcccatagctaagagtatgcatatttaaaacttgtgatggtttggccaaatcatccttcagaaaggacactcccatgaacattatgtattaggacgggacgggctatgctgtaggaacaattagtcccccaaatcttagtatttaacacagcaaaggcttgttttttctcttgcgtcacatctgatgcagatggggtggctctctaagcagcatcccagggatccaggctgcttccattgtgaactaagccagttggaacatgtggcctccactgttgccacagccaggggagagaggcctggatgaatgtgtgggaaaattttaagcaaagtggcttacatcactttcacccacatcctacctgtcagaaccagtcatatggcctcagcctgactgcaaaagagtctgggcaatgtggaggagcccctggccactcgatgagcctcacgtctctgccagtcggttccccagaaattcacccacacagtatattccagggcgttttgttcttcgctaattaaatatatgaaaaatggcgtcatgtagactgtcgttctgccctgcacgtctgtgctttctttgggcagttgccctccgcctttttctgctgaaatattcataggggattatgttcactccagacacactccagtggccttccccaaattttcccaaaaccccaaaaccttttgtggggaagccctaagacattctatattttggctgttacaggcatacctcagaggtattgcaggttcagttccagaccactgcaacaaaattaatatcacaataaagcaaatcacacaaatttttttgtttcccagtgcatataaaatttacatttacacggccgggtgcagtggctcgcacctgtaataccagcactttgggaggccaagtcaggcggatcacctgaggtcaggagttcgagaccaccctggccaacatggtgaaaccccgtcactactaaatatacaaaaaattagccaggcatggtggcaggcacctgtaatcccagctactcgggaggctgaggcaggagaatcgctggaacccgggcggcagaggttgcagtgagccgagatacatgccattgcactccagcctgggcaacaagagcaaaactctgtctgaaaaaaaaaaagttacttttatactatactgtagtctattaagtgtacagtagtatgtctaaaaaaagtacataacttaaaaatactttatttgctgaaaaaaatgctaacaatcatctgagactttagcaagcgacttgtagtctttttgctggagagggtcttgcctcaatgttgatggctgctgactaactgctgaagagtagggtggctatggcaatttctttctttctttttattttttttgtttttgttttttgtgttttgagacagggtcttgctctgttgcccaggctggagtgcaatgccacaatcatggcttgcagcagccctgatcaccttggcaatgccccgacctcagccttccgagtagttggaaccacaagtgcatgtcaccacacccagcctatgtttttattatttgcagagacacagtctcactatgtttcccaggctggtctcgaactcctgggctcaaggagttcctgggcccgcttgggcctcccaaagtgatgggattacaggtgtgagccactgcacccagccacaatttcttaaaataacacaacaataaagtttgctgcatcaattgactcttcttttcatgacggatttctctgtagcatgcaatgctgtttgattcacagtagcacttctttcaaaattagagtcaattctttctaactctgctgctgctttatcaactaagtttatggaatattctttttttttttttttttttgagatggagtttcacttttgttgcccaggctggagtgcagtggcacgatctcggctcactgcaacctccacctcccagattcaagcaattctactgcctcagcctccagagtaggtgggattacaggcgtccgccaccacgcttggctaattttttgtatttttagtagaggcagggtttcaccatgttggccaggctggtcttgaactcctgatctcaggtgatccacctgccccggccccccaaagtgtggggattacaggtgtgagccaccactcccagacaatttatagaatattctaaatcaagcttgtccaacccgcaggccacgtgcagctcaggacggctttgaatgtggcccaacacaaatttgtaaattttcttaaaatattatgagattttctttgcgttttttgtttgtttgttttctcatcacatatcgttagttgttagtgtattttatgtgtagaacaaggcaattcttcttccagtgtggcccaggaaagctaaaagactggacaccctgctccaaatcctttgttgtcattcacagcatcttcaccaggagtagcttccatctcaaaaaccactttcttgactcatacataagaagcaactcattcattcaagttttatcatgagattgcagcaattcgctcatatctgcaggcttcatgtctaattctagttttctcttattacttccaccacatctgcagttcatttctccactgaagtcttaaacccctcaaaatcatccacatggatccacttcctccatccacttcttagcatccacttcttctaaattagcatccacttcttccacattcctattcatgttgatattttcacctcctctcctgagtcacaaatgttcttactggcatctacaatggaaggttttcagtttactttgcccagatccaacagaggaatcactgtctattgcagctatagccttacaaaatgtatttcttaaataatgtaacttgagggtcagatatggtggttcacgtctgtaatctcagcactttgggaggccaagggaggaggattgtttgaggccaggagttcaagaccagcctgggcaacatagtgagacatctctacaaattaaaatttaaaaattagccaggaggccgggtgcagtggctcacatctgtaatcccaacactttgggaggctgaggtgggtggatcacctgaggtcaggagttcaagaccagcctggccaacatgatgaaaccctgtctctgctaaaaatacaaaaattagccaagcgtggtggcgggcacctgtaatcccagctacttgggaggctgaggcaggagaatcgcttgaactcgggaggcggaggttgcagtgagccgagatcacgccactatactccagcctgggtgacaaagcgagactccattcaaaaacaacaacgaaaattagccaggtgaaataccatgcacctgtagtcccagctacttgggaggctgagacaggaggatcacttgagcccaggagtttgaggctacagtaagccataatcatgctactgcattccagcctgggtgacagagtaagaaaaccctgtctcaaaaaaaaaaaaaattaattaattaaaaaacagacttgaaagtcaaaattactccttgatccatgggctgcagaattaatgttgtgttaacaggcatgaaaacattactctcctcttacctgtccatcagagctcttgggagaccaggtgcattgtcaatgagcagtagtattttaagcagtaggtgtcaacagtgggcttaaaatattgaataaatcatactgtaaacagatatgctgtcatccaggcctgttccatttacaagcacaggcagagtacatcttgcttaattgttaaggtccctaggagttttagaagggtcaacgagcattggcttcagcttaaagtcaccagctaccttagcccctaacaagagaatcagtctgtcctttgaagctttgaagccaagcattgacttctcctctctagctatggaagtcctagatggtatcttctttcaatagaaggctgtttggtctacatcgaaaacctgttgattattgtagccaccttcgtcagtgatcttagctagatccttgggataacttgctgccaattctccatcagcacttcctgctttaccttgcacttttatgttatggagatgtcttctttccttaaacctcatgaaccaaccaacgctagcagcttccaaattttctgcagcttccttgtctctctcagctttcctagaattgaagagagttagggacatgctctggtttaggttttggcttaagggaatgttgtggttggtttgattttctatccagaccactcaaactttctccatatcagcaacaagtctttttcacattattataatttgtgtgttcactagagtagcccttttcatttccttcaagaacttttccagccgggtgcggtgactcacgcctgtaatcccagcactttgggaggctgaggtgggcagatcacttaaggtcaggagttcgagaccagcctggccaacctgatgaaaccccctctctactaaaaatacaaaaattagcctggtgtggtggcaggcacccgtaatcccagttacttgggaggttgaggcacaagaatcacctgaacccaggaggtggaggttgcagtgagccgagatcacgccactgcgctccagcctgggcagagcgagagtctgtctcaaaaaaaaaaaaaaaaaaagaatttgtctttcgcactcacagcttggctaactgtttggtgcaagaggcctcacttttagcctttctggctttcagcattcctgcctcactaagctccatcatttctagcttttgattttaagcaacaaaagcgtgactctttctttcacttgaacacttagaggccatggcagggttattaattggcctaatttcaatattgttgcatttcaaggaacaaggagaggcctggagagagggaaagagaccagggaatggctggttggtggggcagtcagaacacagacatttatcgattaaatccattgtcttctatgggtgtggtttgtggcaccccaaaacacttacaatagtaacatcaacaatcactgatcacagatcaccataacagatataataataatgaaaaaatctgcactattgcgaaaattaccaaaatgtgacacagagacacacagagagctcatgcttttggagaaatggcactgataagacttgctcaagacagggttgccacaacctttgatttgtagaaaacacagtatctgtgaagcataataaagcaaagcacaataaagtctgtcctgtttgtattcacaaaaacatataaaggcatgtgagtaataatataaaattagctgggtcaagatcgttgccagctgtggtgtggaatggattggcagcagttctgtgccatttcccaggctctctgtgcctccacctcctccctcattcatgaaagacaagccaagcaagggacaaaggtatacaatagttgctgtaaatgtccctatttcacctatgagaaaactgtactcaaagaggtttaaattccttgcctaaggtcataggacctcaaagacaataagcaaaagcaaggaaactgaacgcactcatagctacacagagattcattgctaactttgtcagacgttgtgccaagactctctctctttctctccctctctctgtctctctaccaacccccccccaacgtatgtgtctctgcgtgtgtgtgtgtgtgtgtgtgtgcatatgcatgtatacacccacttttttttttataaaatagactgcaactggagatactggtgtgtcctattttttggtgcagcgtcataacataagcatctttctaggcaataaattaactttatgctggccttcttttttcagtggagtattaattaagcatcttgtatgtgcccaatattctgctggttctgggggaagaaggccagcctacaggaaacaacagctaactctttaaggcagtgcataagtccattcatttgcttcacaaacattcattgagccctgccacgtgccaggcactgtgggtatcgtggagaacaagactactgtccgaggcaagagctgggctcctcctagcttcctctgtccccctaacctcctctcacccacaggcattgctgggggtattttcctgggttggttggtttgttttgttttttgttttgttttgttttgtttttttgagacagggtctcactatgttgctcaggatggtctcaaactcctgggctcgagcaatctcctgcctcggcctcaccgtgcctggccgttgtttatttatttattgtggtcaaatgtacatagcataaaattgaccgttttaactattttcaagtgtacagttcagtggcactaagtacattcacactgttgggtaaccctccccactcttccactgcagaacccctttcatcttgcagaaccgaaactgtccccattaaacatcaaccccccggcccttcatcccagcccctggcagacacccttctgtctgcctctatgattttggcgctctgggtacctcatagataagtgagattgtatagtatttctcctttggtgaccagcttatctcaccaagcgtgatgtcctctgggagcatccgtgtggaagaggtgctagcatcattttgacttctcaaacatctcgtgggtgtcacctccccctctacctctctgccactgcctcgctcagccacctgctctctcctggacccttgcagaagggactgactgggctcctggcctccagtcctgccctcttctaatgtatttttcataccacttccaaagtgataatacattcctcttttgaaattttagatttggttactaaagcaatacaggtgtatggttaccaaaaattcaaacagtgtaaaagagaataccagcctgggcaatgtagagagaccctgtctccataaatttttttttttttttttttgagacggagtcttgcagtggtgggatctcggcgcactgcaacctccacctcccgggtcctcattcaagcatttctcctgccttagcctcctgagtagctgagattacaggcatgcgccaccatgcccagctaatttttgtatttttagtagagacggggtttcaccatgttggccaggctggtcttgaactcctgacctcgtgatccacccaccttagcctcccaaagtgctgggattacaagcataagccaccacgcccagtctccataaatgatttaagaaaaaatgtagccaggcgtagtggcacgtgcctgtgctcccagctccttgggaagctgaggtgggaggattgcctgagtgtgggatgtcgaggctgcagtgagccaagatcatgccactgtaccccagcctgggtgacagagtgcgaccctgtcccccccaaaaataaataaatcaaagggcataaggtgaaaagaatcgtaacattatgtttttgtagctctgcctctgtgatggtgccccctgcatggcttgctttcactgtgccaatgcaccacagttacccagcctgccggctctgataagatgctcgccatgcttctcccatgctggacttgggccacgtccttgggcatgaatcttggtctatgtccaggtcggttctgaatgagccagcagactcctcccggggctgcccggctacatggttgagggcatcctggacaccagcttcagccacagctcctgaccaggcaggtgcagtgaagccgggaggtgtaggtcagttcctacctctccaacctgaggtcctgcacttcctgcagctgttggaagggatcgtatccaatgggagcaagaaagtgtgctcccccacagccccactcaggcataaagggccgaggggcagccaggcctgtcctggctagggctggctcagagtctgtggcagccccacccctgccaggctggcccttagccccaagatccacctatggcactcgcccctttacagctacgtggacatccactgacactcaggtgacacacctttgcctgcttctactcagtcttggcagcagttggacaaaaggaaatcaaagatcggttctttcttgggagaggaagagcaagctggagccctggggtgctcagatgctcttgggagtaacatagccccatagccccggggctatactgggtgcaggggggtggaggtggtgggggagctgcagccaggcattcattcacttcccgttctttcattcctgctcttcttttgctcactgactcattcagcagcctctgggctgggcgtttactctcctgtcaggcaacacactcctgattgggtggccttggccttcccaagctgtctctggctgtccccaagtgaaacggaatctgggctggacaggccaccggatggacaagctcttctcatctaaaaccaaggcagttgacattgtgggctaaatgataagaacaaaattaaaaaataaaaaccaggcaggctggcataggagctccatttccctgccctactgtgccagtggcctgggggctcccctgccgcctctctccactctgcagattctgagaaaactcacaaaagagcccactccaaggtgtttggcaacaaggtgggggcagcctcccagcacccagcacacatggagctttcccgcagtgggtttcagcgctcccactctgcctcggagctactctgtcaccagctcttgccctcccttggctcctctttcccatgcagctcctcctccagctcgtgggaaaggccgagaggccgggccagcaacagctgagcatcccctcaacctctccctaccccaccccaccccactgtgctcttggccccaggcaggcgaggggagtggagttttgctgcctgatgcaatgtctggcagggccgtcccttatcacagccgacttgctgggacccccaccttccccggaggaggccggaacaggccgcagtccattttgggcctcagtggaagggcctggttggaggccatccaagtagaaaactcgttctctgggaggcaccttgccaagtcacgagggaggcctgagcagaaagacccctgggggagagaagggagggaagccgaagcctcacttgctggggcttgcctggcctcagctcgcagccccctttttccacagcgttctctccctcacatttgtctgcagatggcttaggctgttttctgccctcccccttgttaccccacagctgtgagaggctggatggaaacaagaattcaagagactaaagttatgtgcggtcccaagtgtgaagttttgcccacagttggtggccatggttcgcaccgtggtcccagcacacgccctcagcatgcacctgtggcccacacgctcatgctcacagccactcatgtatggagcaattgcctttttttcttcctcttcatatcttctgtcaacttagaacgattaagcatcttgcagtaggctcaatgctttgggaaggacattgattcgttcattcattcattcattcattcagcaagtatttatgaagcacccactctgtgccaggtacagttctgggcactggagatgcaagggtggagcagacagatgaagctctcctctcccggagtcaacgttctgggggatgagaggccatcagcaagtgcatttccatctatgaagggagtaaagcagggcgccaagagggaaagtgatgggggtggcccacattaggtcaggggtcagggaagtactccagagctgggggggcatttgagctgagtcctgattgcttagaaggagccagccagagcagatctggcccgggcagaggtaccagctgatgcagaagcccccaggtggggagtggcaggaagggccagggtgggggtgttgggagaagaggtgggaagggtgagcagggtctggatcttgaaggcccttacagggcttttattttaccaagtagtgcatagagtgtttgaagcagaagctgccttattgtctgtgcctccgagaagtttccatgtggctgagaagctgggtggcagcacagttataatcagtgctcaggtgttcccctgtctgggtggctgcccacatgtgatcccatagaagaggctgggcctgaggaagccagggaagcaggagggggtgtggggaggccagcaggggtgtgggcctcagcggggagggaggaggtgatgcagcatggaagatgagaagcccacaccagccacactaggcccccaggagattgtggacgccgtcgggagcattattcggtggaggggtgcggggcagaagccagatgagacagctgggaggtggcaggcaggtgagaatgtgagacagagggaggacagtgatttgagaactgtatcgtaggtgggataggagtccacatcccagccagcacctagaaggttgggctggctctgcccagggcctggcacgtggtgtgcactcaccagatggtcgccgccctgaaagaactcagcactgtgcctcttttcctgcctctggtgtttgctgtcaatatgcagagtgctggacaaaactgggccaagggagctgtcccactgcctgctgccctcaagcagagctgacctggcacatgcctctggcatacttcctgttggccctggcaccctgcaaagaggcccccagtgggcccaagcaggggataccacccgttccttgggctgttatgtagttgctggggcattgaggggatgaaaggtttttttgttttttgggttgtttttttttttgagacagagttttactctgggtgcctaggctggggtacaatggcatgatctcggctcactgcaacctccacctctcaggttcaagcaattctcctgcctccgcctcccaaatagctgggattacaggcgaccaccaccacacctggctacttcttgtatttttagtagagacagggtttcaccatgttggccaggctggtctcaaactccagacctcaggtccacctgccttggcctcccaaagtgctgggattacaggcgtgaaccatcgtgcctggccggatgaaaggtattgagtactaggggctaggagggaccaagagaaggaggaagagatttttcggttctacccatgaactaagcaagggaggcaggcctagcccttgcaccatggaagtgggagagaagtgatacaaaggtgtatctgatgtcacaggtgtcacaggcctgcttcttgtaaagggcctcctgcatggtgagttctgcgtggggctttgctgagtaacccccatccgggctctatccccttccctcatggccctgtgacttcctggcaccatgaccctctccccgcttctggctctgggaagctccaaacctctctcacctgcctgcccacctgcctgctaggtttccaaagctaaacagaggggcagctgtctgggcagggcaagggagccaacagcctgcctgggtttcctgtccaagtgtccagctttgcttcttcctcttagggcagcgtcaagaaggatcttaggaaagctgtgttgctctggggatgaggaggctggaacagcaacttaaaaaaagaaatagtccctggaagggagggaaggagaaggttcagaggcttgtcatttaggcaccccaacttctataccttaccaaggtgccaggcccagagggaagggggtagccagggcagctccccgacccgcacctgccttttcacccctctcctatttcacaagcatttaccatgcatcaacagatatgttcctcacagcacctttatcagcagggactgcccttttcatgctacaaacaggcccagagaggttgtcacttatacaaggttgcacagcatggtagagacacaggaaggactagagcccaggacttctaaccctagctccttctgcttccctcacatcatcagctccagacaacctgagattggagaggacagaaagtcaggatttcaacacctcgtactctgaaaactcagtggtggttctcaccctgtcagtggggcaggtggcctcacaccccaccacaggctaaacagggtgcatgggggacgtagccccactggccattctacacattcatgccaacagctaccaggcaccagcctcaccattgatttttggacagctggtctgtgccaagtgccattctagatgcgagtcccgactttggggtgcttgcattctgggaagggagatggtcagccagaaagccccaccataggagctaggttgggggtccccaaggtacaccaagaagctcaagtgacctggacctgggaggggtggccagaggcttctgctggaggaaccttaggtcagttacctaacctgtctcaacctcagtttcctcacctgtaaaatgggctagttgctgcctcacagggctttgctgaggatttgatgagtgcaagtgcttagcatggcacctggcacagagaaatatgcactcagtaaacttaagctgcccatatcattggttggccctcccaaccagagtgcaagccccgggagggcacagaccatacctgcttgttcaccgccatattttcagtgcctaggccagaagccagcacaaggtaaatgctcagaaaatattaacttaataagttcatgagaaaaggcccaggaaaattaggaagaggcaggactattccagttaggaatagactctcctatgccaggcacagtggctcacacctgtaatcccagcactttgggaggccgaggcaagcagatcacctgaggtcaggagttcgagaccaacttggccaacatggtgaaaccccatctctaccaaaaaatacaaaaattagctgggagtggtggcacacgcctgtaatcccagctactcaggaggctgaggcacgagaattacttgaacccaggaggcggagattgcagtgagctgagattgcaccactgcactccagcctgggttgcagagcaagactctgtctcaaaaaaaaaaaaaaaaagggaatagactcttctttctgcagctgtatttgctctagctgtaaacaactttgtagccaagtgcagtggcacacctatagtcccagctactccggaggctgaggagggaggattgcttgagcctaggagttggaggccagcctgggcaatatagcaagaccctgttagatattatctatttagataataataatgacctgtaatcccagtactttgggagaccaaggcaggtggatcatctgaggtcaggagttcaagaccagcctgggcaacatagtgaaaccccgtctctactaaaaatacaaaaattagctgggcgcagtgatgcatgcctataatcccagctactcgggaggctgaggcaggagaattgcttgaggcagaggttgcagtgagccaagattacgccattgcactccagcctggacgacagagcgagactccatctcaaaataataataataataatgatacatactatttcagtcgagggtcattttttcctttatccatctgttgttcaccaactgtgtatctcttgcctggcccaggattgagagataatgaggggcccagatgaactccctgtcctgcctgaagggatgttcagtattgaacaattgttgctttatggctttatgacaaagtcccaggtgctcatgataatctttgtacagtggtggggctgtagggagccctaacatagcctgggggaggctgcctagaaagtggagacctgaaggctgaggccatgttaaggatttaggtagaatttatgcgctatgatatttttttctttcgttaattttttataatttacgtatacacatggtaaaatgtgtaacaaggcacagtgttacatagcaaacataagcctcactccaccttctctctccacctacctgtccaccttctagatgcagccattgttaccaggccttgcgttttcctgcagccagagtccatttgtatcccgcatctatattttcttcccggcatttgtttctgaatgggagcttgctacatcggagtctctccaccttggatgatttgtcaccccccaccttcccaccccaggagacacttagcaatgtctggagatatttgatggttacagatgagcagtgggggccaggcgtggtggctcgtgcctataatcccagcactttgggaggccgaggcaggtggattgcttgcactcaggagttcaagaccaggctgggcaacatggcaagaccccatctctacaaaaaattttaaaaattagctgggtgtggtggtgtgcacttgtggtgactaagggggctgaggtgggaggatcaattgagcctgggaggttgaggctgcagtaaactatgatcgtgccactgcactccagcctgggcaacatagtgagaccctgtctcaaaaacaaacaaacaattattggcaattagtgggtagaggccaagactgctgtcaaacattctataattcacaggacagtccccacttacctggtggaaaatgtcaacagtgctgaggttgggaagccccgtcctgcataagcacagggtctgcacctttgtgtgtgtgtgtgtgtctgtgtgtgtgtgtgtgtgtgttctcatgtattttctggatcattcacatttatacatccacctcattattctttgtggccacataaaaatccattacctggatgctccaccattttcatttaggtgtttgcactctttttgctattataaacatttatgctacaaaggttattcttttccgtgcacaggcctttgatgtgtgaggtcaagggagaaactgatggaggtgggatggatgaacccgatggttcattagcattttaaatgacctattaaagagaccttcagtgtctctggggcacagtctgtctggagagtgggtctggggtcctggctgctaaccagggccgagatcctcaaaagtctggtggagagacatcctctgcattcctcgtgtacagacaagggtgttctgaccacctgtctctccgcaggacaagggtgtcccccacctgaagacggcaagctgggtcctgagtgatgcccctcagctgagtgtccaaggctggcccgaggagcccccacggccccacctttccccatggagaaaggactcactttgccccaggactgccgggactttgtgcacagcctgaagatgagaagcaaatacgcccttttcttggtttttgtggtgatagtttttgtcttcatcgaaaaggaaaataaaatcatatcaaggtgagggttgcaagcccaagtcttcatcttcctttcaaggtggggtgggtggggacagggaggtaactgcagggctctctgtggacctgcaaatgcattccttcaacgagccatccccaggccccttctatgtcccaggcagtggctcctgcacacgtcctcatgactgcacaggggtgagacttgggctctggactcaaacagcctgggttggagcccccccatgttggccctctacagctgtgaaaggttagacaagatacttaacatttctgagtcttcggttcctcttttgtaaaacatggctaataatgggaccagcattgttgtaaagattaaatgagaaaatgtaaaagcatttagcccactgcctggcacatagttggtgtccagtatttgctggctgtgactattactgttaatttacctcctggccttgcattagcagcacatcccctatagaagtcttgatgtcactgagcccatggaaaggcaaggtcctagtatggatactctgatgggcaaggctgccaatgtgcagctgccaagttgtgtactgctcaactccaggggcatgtccctcaaataggctaatctgggaacgcccctttacccctttgaattggcagcatacagctatgtgcagtgggcctgttagatgtagaaagatttcttagcctgttctcctcccaggcacaagccctgcaagaaagcattagctaagatgggtgggtcagggattgggcaatatagtggacaccgtcaatccccccccttgggtcactgagcaaggaccgttctagcttgtgcctattgggttctactgcaagcccctacagctctgcacctgagagctttctctccactggcacactggcaagccggaagtactagggagtaactgtcccccccagatccccatcagactaagcctccgatgcccacacctgctcctagcagcacatccatcatgcacctctttcctcccctgcctcacttccccatccagtacttcctgtgatcatgtcccaaataaacttacttaaacacaaatccttgcctcaacgtctgcttttggggaaacccaactgagacaggttttggtgatctgcttggaggactgcttagggttgcccaggagacggggtccccagtcagccactgaccctgatcttctttgtcctcacagggtctcagacaagctgaagcagattccccaagctctagcagatgccaacagcaccgacccagccctgatcttagctgagaacgcatctctcttgtccctgagcgagctcgattcagccttctcccagcttcagagccgtctccgcaacctcagcttgcagctgggcgtggagccagccatggaggccgcaggggaggaagaggaagagcagagaaaggaggaggagccgcccagaccggccgtggcggggccccggcgccacgtgctgctcatggccaccacgcgcaccggctcctcgttcgtgggcgagttcttcaaccagcagggcaacatcttctacctcttcgagccgctgtggcacatcgagcgcacagtgtccttcgagccggggggcgccaacgccgcgggctcggccctggtgtaccgcgacgtgctcaagcagctcttcctgtgcgacctgtacgtgctggagcacttcatcacgccgctgcccgaggaccacctgactcagttcatgttccgccggggctccagccgctccctgtgcgaggaccccgtctgtacgcccttcgtcaagaaggtcttcgagaagtaccactgcaagaaccgccgctgcggccccctcaacgtgacgctggccgcagaggcctgccgccgcaaggagcacatggccctcaaggcggtgcgcatccggcagctggagttcctgcagccgctggccgaggacccccgcctggacctgcgcgtcatccagctggtgcgcgacccccgggccgtgctggcctcgcgcatggtggccttcgccggcaagtataagacctggaagaagtggctggacgacgagggccaggacggcctgagggaagaggaggtgcagcggctgcggggcaactgcgagagcatccgcctgtccgcggagctggggctgcggcagcccgcctggctgcggggccgctacatgctggtgcgctacgaggacgtggcacgcgggccgctgcagaaggcccgcgagatgtaccgcttcgccggcatccccctgaccccgcaggtggaagactggatccaaaagaacacgcaggcggcccacgacggcagcggcatctactccacgcagaagaactcctcggagcagttcgagaagtggcgcttcagcatgcccttcaagctggcccaggtggtgcaggccgcctgcggccctgccatgcgcctcttcggctacaaactggcgcgggacgccgccgccctcaccaaccgctcagtcagcctgctggaggagaggggcaccttctgggtcacgtaggggggccggggccccgtatgcccctcctcgtgaaaggcctgccccgtctttctgccgcagccctcgcagagggcgggtgcacagcgccatgagcgggcagcgcctcctgtagcagtagggcccccagccagcgctccagccaaagcggcggccccagggttaattgcggagaacaggacagtgcccggtccccttgagggccatcacacccagacccaacgggttgcagcctcctgagcaggcctaggcaggcccgggcctgttggcaagcttcgatctcacacacacagaaacatacattcgtgcctggagaccctgcaggccagagtccaaatatttaacaatcagaaggggcaaggctctgaccagtgacagtcagacctcctgctttatttggtgttaaccgtttcttgtctggatggtgaagtctggaatctgggtgggtccttggaggaggggctaggacagccgtgggtgtcaaaggtggcatttgaggctcgtttgaggtgacagtggctgtttaccaactagtacagagcgattcagcgttttcatgaatgggttggctgtgctggttactgatgaatatgggccccttatagagctgcaaaacacacacatgcgtatagacatacatacatgtacaccatacatagacaagcatcataaaggcacaagtgcacacacatctatgcagacaagcttcctcgctgcttatgcccacagggtttttctgtatgacacacctcagaggagcctgtgcttaacatttgtaggattatttcgagggcagggcaggggaaagaaacgcgttaaagggccatgacatgacacagttccctggccgggtttggactgaacagtggattcagaactgcagcgttcaaagcccctgcccgccttagattctcatggctacctcctctgacccatccacatccttgcggctggcaggcaggatgttttgaaatggtgcagccaaaggccccgtctagcttggctggctcccgaacatgtccatatttgaaggctgcctcaggcctggcaggcagaagcagctgtggtccctggaggcaaaaggcagctcacggggccttccatttccagccaggcctcatctggggtagggccaagaggaaagtacagagtgcccgtgggggagaagtcccaccaggatgccccccctcccctgagaagcccgccttctccctcgtggacaggagtcagccagttggttgctgtggttacagccagtgcctggaattcctccttagggccctgggaagagtattgcttaacgcaggatgtgctgggtgttttgtttcgggcttttatttatggcttggtgtctttcttgtttcatggctgtgtttttgcttttgtttctgtaggagcgcctcttccaagcagtggaggcctgagggcttgagggaggctggggaaaaccagcagggagcacttggctcctggcagagggagaggacaggaggaggagccttccccaggaggaacgaggagaggtggccacgtggcaggccacagtgccctatgggcttttctgtttgaaccccatgtgggatgaatctcaaagccaccagcgttcttgcctagtgtccagagcagcagagatttgcagccctcgcccctccctgagaagaagctggatttgaaaatccctcacaggccctaacatgtttcctgggtgggcaggggcctcatgacaagcgacaagtgtacccagagtagaaggccttccccactcccacctcaaacccaggagcagaactcagtatccagagcttacaaggagctgcaagggtttgccgagggctgcccagctctgcttctggtttcctggacaatttctctgtcagatacggcccattgtaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcggaggggctgggactggggagggggcagccacctccatccaaggctcttcctaggggccctgctaatgtggacagtagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtcacaagcgcgtggatgtttcctggaagtgtattcccctggggctcagcgatgctctgggaacccttggggtttggggaaggacagtgtggtgtgactattggcttgaaacgttatggatatggttggagtcacccatgtggatatgattttcagcttggagctgggatggagaagatggaagcactggtggccgggcctctttttccagcgaggccagccctggcttctcctctgttccagcttgtctgccagaagccttcccctgcaaggtgcccacctgcccggagacagagggagcagctgaggcctctctccactggccgccagcctccctagcacaaggggaccattcagcaatgagtgtttactcatgttctttcttgttgatgagttctgcggcccagcatatagaaatggctcagaacgttccaggccttggtgagacacagcagcgtccaatgctcacaggctgtccccactctgcctgttcccatcttcccctcgggacctgtttataaattgaggaatggatgagggccctggagggtccttgggagtagttagtggagggcaggattctcaggtccccatagagagggaaagagaagaccagatgtgcatagaagccagtctctgtcacatacaccgcaggtggtcaccgagttattttccaaaagctgaggaacataaagcaaatttaggcttttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcagttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagtgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacttgtctcaagagctccaagatcctttggtctcgtgtcctttggcaccccgtaactggactggggacaaatttgttacgtgtttccaaggctacagacatggcgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacggcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagc

SEQ ID NO: 37331 - DNA, 8762 bp, Homo sapiens
ggggtagtgcaggcgccgggtttcccgcggtccgagctggcgcgggcggaggagaatcgctcttaaagggccagcgcacacgcgttcttttgttccggggccgcagggcggggcaggcccgactttcgccgtcttcttgtctactctccagaacggccatgatttcccaattcttcattctgtcctccaagggggacccgctcatctacaaagactgtatcctagacccttggggctgggaaggggcggaggggccgggcgggaggggcgcccagggccagcctgtgtcgcaggatccttcactgagtccttccacccgccagtccgcggggacagtggcggccgggatgtggccgagctcttctaccggaagctgacgggactgccaggagacgagtccccggttgtcatggtaaccagtggcgggaggcgggtgaggagcggggtcccgtcgggccgggtgggcgccagctccctcccaggactggttcattggtagattccacttggggggtgcattccgccaaataaagctaacgtgaggcccggcgcggtggctcacgcctgtaatcccagcactttgggagaccgaggcgggcggatcacctgaggtcaggagttcgaaatcagcctggccaacatggtgaaactccgcctctactaaaaatacaaaaaaaaaaaaaacatagctgggcgtggtggcgggcgcctgtaatcccatctactcgggaagctgaggcttgagaatcgcttgaatccaagaggcagaggttgcagtgagccgagatccggacaccgcactccagcctgggagacagagcgagactccctctcggggtaggtgggggtggggaaaaaaaaaaaaagagtcaatgggcgccagcaacacaccaggcccagctccctgcgtgactccatcctcagcaactcggggtagttagtgtaattaaccccctttccacattgggaagctgggcccaggcatatgtcatgtatctcccaaaggcactgctgttgtgactagtaagaggcatcgggatccgagctcaggtctcctgggttctgatcactccacctccctttttttaacgcctctcttctccctgcctgtgtctcagcatcaccatggccgtcatttcattcacatcagacacagcggcctctatttggtggtcacaacttcagaaaacgtttctcccttcagcctcctagaactgctctccaggtgaggagggttgggctgggcacctggtagctaggaggggtctgagaggaggagaaaatacacgctccaagtgtttcctcaggttggccacccttctgggcgattactgtggctccctgggcgaggggaccatctcccgcaatgtggctctggtatacgaactcctggatgaagtgctggtgagaatcaacaatccccttctgtggcccctacccaattcccctgaagatacatctgctcttctactgtgggatgccgtggttaggaggccaagtctacctttttttttttttttttttttgcttttagagacagggtcttgctctgttgcccaggctggactgcagtggtgcagttatagctcactgcagcctggaactcctgggctcaagccgtcctcctgccccagcctcccctgtgcctagctaattgtttattttttgtagagactagagtctcactgtgttgcccaggctggtcttgaactcatggcctcaagccattctcctacgtctcggccttccaaagcgctgagagtacaggagtgagtcaccatgcctggccccactccccctctttaccccttccctccactgatcactcagactgtccttcctttaccactaggactatggctatgtacagaccacatccacggagatgctgaggaatttcatccagacggaagctgtggtcagcaagcccttcagcctctttgacctcagcagcgttggcttggtcagtagagggaaagaggagggtgaggaaagagaagaggggttggctggggttgtcagacctgatgattgattgctttggatgctttacagtttggggctgagacacaacagagcaaagtggcccccagcagtgcagccagccgccccgtcctgtccagtcgctctgaccaggtgagggaaggatccatggggtcagacgctctggttttgctctgggatccgggagtccaagatcttaggtcgggcacagcggctcacgcctgtagtcccagcactttgggaggccgaggtgggcagatcacctgatgccaggagtttcagagcagcctggccaacatggtgaaaacctgtctctactaaaaatgcaaaaaaaaaaaaaaaaaaagaaaaagatcttggcacatctcccacccccccagatgtgggtggaggtgggagatgatcccttccatcacccatgtcctcaccctagagctgtagctttgactgtcctgttctttctccctgtctgtccatttcagaacataggctattctgcttccaaccacccaaattctctctctttctcagagccaaaagaatgaagtttttttggatgtggtcgagagattgtctgtactgatagcatctaatgtaagtttgagctcccaaacctggagctgaggacagatgggacttgggaaacatggtggggtggctaagactcccagcaacggccgggcacagtggctcatgcttgtaatcccagtgctttgggaggccgaggtgggagaattacttggggccaggagtttgaaaccagcctgggcaacatagccagaccccgtctctacaaaaaatacaaataaacaaattacccagacatggtagtgtacacctgctgtcccagctacttgggaggctgagccaggaggatcacttgagcccaggaggttaaggctgcagtaagccaagatcgagtcactgcacgctagcccggatgacagagcaagaccctgtctcttaaaaaaaataaataagtaaaaaaggctgggcacagtggctcatgcctgtaatcccagcactttgagaggccgaggtgggtggatcacttaaggtcaggagtttgagaccagcctggccaacacagtgaaactccatctctactaaaaatacaaaaattagctacttatggtggcaggcatctgtaaccctagctacttgtgaggctgaggcaggagaatgtcttgaacctgggaggtggaggttgcagtgagccgagatcacgccactgccagcctgggcgacagagcgagaccgtctcaaaaaaagaaagaaaaaaagactctaaccttgacgcccctgcctctcagggatccctgctgaaggtggatgtgcagggagagattcggctcaagagcttccttcctagcggctctggtgaggcatctgcaggcaggaccaagggttggggttagggcgggttccttggtgtcttaaaccatggcattgctgagctctcctgatggtctctcctccgacagagatgcgcattggcttgacggaagagttttgtgtggggaagtcagagctgagaggtgaggagaaagtgggtctttctccccttggagtaggtcattgccagagttcatggagagaagtcagacagagcctcccctctccttgctcctctcccaaaacaggagtcaggagagaagtctctctctctctctttccaggttatgggccaggaatccgggtcgatgaagtctcgtttcacagctctgtgaatctggacgaatttgagtctcatcgaatcctccgcttgcaaccacctcagggcgaggtcagggttggggtggcctcataaattccgtccaccatggggaagggggcagtggggtcgtgagaccaaactaaccttgttgctctctggtctctcagctgactgtgatgcggtaccaactctccgatgacctcccctcaccgctccccttccggctcttcccctctgtgcagtgggaccgaggctcaggccggtgagacaatttcctgggttctagaactaccttggaacccaagccaagacctgtatgttcccaagactcactgcagagtgggggtggtggtagtggtgatggagtgcaaattggaaaaaggcttgggttgcggccggtggctcacacctgtaatcctagcactttgggaggctgaggcgggaggatcacttgagcccaggagttccagaccagcctgggcaacatagtgagaccccatctctctgaaaaaaaaaaaaaggaaaaagctttggctaatggagttgggctgggcttcagcccttttccctcttgggagtacagcccacacccacacagccccacatggaggtccctggtggggaatggtgagatgccagtagaagatggcctgagtcgtggtgttttaccctctcatccaggctccaggtttatctaaagttgcgatgtgacctgctctcaaagaggtaagagtgaggctggcctggctgagttcagctctatgggacggaagacagggccagggcacctgctgcttctcccttcagatgcagctgccagcctcagaagccagttaaggtagaggctgtagaatttgggaaggtggggggcacctgtgctgaaatcctgttatgacattgaagaggaacaggacaagggactgtgccttcctggggctgactttgttcccgtctcctctgtagccaagccctcaatgtcaggctgcacctccccctgcctcgaggggtggtcaggtgagtgtgtgcacccaccacggggagattcctggggagagagtgagctcagcatgacgggtctgcctcaagaaggtgccaagcccagcaccttccctttccaaactccagcctgtctcaggagctgagcagcccagagcagaaggctgagctggcagagggagcccttcgctgggacctgcctcgggtgcaaggaggctctcaactctcaggccttttccaggtattcgctgtggacccccagcccctctcctcccacattcacttgcagcccccaccccaccctcccgaagcagctgctgcctggttcccccagcgtggtcagcttcttgccctccttcctctccctgcctctgcccctcacagatggacgtcccagggcccccaggacctcccagccatgggctctccacctcggcctctcctctggggctgggccctgccagtctctccttcgagcttccccggcacacgtgctctggcctccaggtccgattcctcaggctggccttcaggccatgcggcaatgccaacccccacaagtgggtgcgacacctaagccacagcgacgcctatgtcattcggatctgaggctccccaaacgaggacacgacggccaaggtggcagtttgtcccacgggaggacagtcgtttcttttccagcctcctggccttcggactctgaatctgggcaggaagagtcctcagtcccaagaccaggagggggcaatgggcccagcctttctgtggtatctgatgcaggaaggactgcagtggatcagaacttacaaaccaaacttttattctgagaaactggctgtacaatatctaaaaagaaagtgacatgaaggaagcaatctacaacttccttccgcttagcgagcatgcatgtgtgtacgtgcacgtgtgtacatgtctgcatgtgtgggaatccgggggctggcaggtggagcatcacggagcaggctgaggggagccggagttgggctgggagccattggcttttggagtccctggagctggagggggactgtccccagcctcctgcttccccccacaaagggcactgccgctgagtggggacggggacgatgccgggggaggaactggagaaggatgggaggtggggcctcctttgccctcccctgttgggggaagtgagaccacgatgtacttctggacactcccaggaccagagggagcagtgctggggggtgcggtggtggcggtggagaccaacttgacgatgggctgcacgctggggacggtggtggtgacgggcgaagtggtggtggaacctgagccgggggccgaggtgctgagggacaggacctggatagaaaggaaaggcaggccgcttgccctgtgccctccctgccccccagaggcctggcgaggacgcttcactcgctccctgcctgaacaagttgttcctgtagttcaccctgtagacagctatggctggagaccttgttcatgcagggcagctacagccctgcaggaccctggtgggcgcctcttccagctcttgacttggggcccagaggggactgtgctctactcctgggcctccccagggtgctctgaggtaacccaggccctccagatgctccctgtcccacagctctgcatacctgctgggtggatggggcgctggaggacgatgacattacaataaacttggttggaggaggggaaggctgtggtggggcagccgctcgtgcagacaccagtgtctggacaggaagtgcgatggagccaggaaccttcagcaagccaggggtgcgagggccaggctgtggggcctgcgagagggtcagcgtgggccggggctgcggggagaagaggaaagggggaagtggcaccatctactaagaagaggagtctgaagggagaggcctgggctcccctcgctcttcctcagtggctctcactagggctggggcatcctcactcagggcctggttgccctgagactactgactgagggcacatgtggctgtgtgcaagtgcctgtcccacacaggggttctcctctgcttcctcctattcctcctccccacccggccacggacctgcgtgatggtcagagtggtcctgttgacctgctgagcctgcagagcagcctgggcccgagccttgaccacctgggagcagaggaggggcccaagggacccgaattctgcccgataggcgtcctgattgtcaggcggtgggcgcagctttgccagaacaggagcacagtgtttctgcagaacagaaaaaaagccaggtagagggagggctggggaaaaaagccaggtagagggagggctggtgacactcttgagaagaaccttggggatggggtaaaaaaggacattccttatcatctcagtgcccctgttgaaggccaaattatgctgaactattagtgtgtgtacagaacactgtgggctttctcataagaaaagatgggcacggggccaggtgcagcatcttaggcctgtatcccagcacttgggaggctgaggtgggtggatcacttgaggtcaagagcctggccaaaatggagaaacctcatctccactaaaaatacaaaaactagccaggcatggtggcacgcacctgtagtcccagctactggggaggttgaggtactagaatgcttgaacccaggtggtggaggctgcagtgagcagaggttgcatcagtgcactcccgcttgggtgacagagtgagactgtctcagaaaaaaaaaaaaaagaatggctgggtgtggtggttcatgcctgtaatcccagcactttgggaggctgaggctggcagatcacctgaggtcaggagctcaagaccagcctggccaatatggtgaaaccccgtctctactaaaaatacaaaaaattagccaggcatggtggcgcgtgcctgtggtcccagctacttgggaggctgaggcatgagaattgcttgaacctgagaggcagaggttgcagtgagcctgagatcgcaccactgcactccagcctgggttacagagtgagactccatctcaaaaaaaaaaaaagaaaagaaaaagaaaacatgggcactaatgtgtgaatgaacttgctaaatactgtggcaggatggttaatcaagagcgcatttgccttgtacagagaagaccacagagtaacaggagcattggggaaggatggtccaaatgccacaggctgagcgtgttaaacccttcttttttggggggcggtggtctccctctgtaacccaggctggagtgcagtggcacgatcatagctctctgtagccttgaactcctgggttcaagcaatcctcccacctcggcctccctagtagctgggaccacagacacgtcaccactcccggctttttggtttttttttttgcaggtgggatctcgctacgttgtccaggctggcctcatactcctaggctcccagagtgctgggattacaggcagaagccatcatgcccagcccccttatttcttactcagtctaatctcagtctttccatctgtaaaatagtatcagactctgcaatgtcctctgaaaacatgaggcaaagatgggagtaagtgaataaaatatgccatatgcttgctaaacactgcctgtgtctcagtgggcaggtgtggggacaggggcttcagtcaccagcaggaggctctgcacatggtctgctccaatccggtcaatgttgctcagcacagggccgtccagcacactgcggatccgctccccttcctgctgcagccggggcagaatcagagtcttgataacctgttagaagggaaaaggacaagcaaaagccggagggtcaccagggtctcccagatgggggtacagtgccctctataacctcatgactgtgtcccctcccccatttcttcctcccagaggcctaacatcgtgtcccagctcagccaagcctgcgatggagccataacgagtcgtccagggcgtcttctcgtccacccagctctgtaaggggaaggaaataaactaagatgaaggggtctgaaagg

SEQ ID NO: 37332 - DNA, 2341 bp, Homo sapiens
cgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcaggtacctctattaccctgggtccccttgtctctgagcctggggttgtgggtcccaatggcatttccctgggaggaggaggagggagacttggagctggtgaggatgagcttggtgctcctcccttggttattaggactctgaaggaggtctgagtagctggagggcctggatggaggtcagtgtgaggggcctgagctgggtgctatctgaagcctgaaggccacctcacttctccaggaggccctgggaccagcctttcaacatgtctgagaggtttagatctctttgctgttgagtggggatcagggtgtccctacccagcacaattccaaactaattctacacaaaagctaaataactctcaattcggtgcgtggggagtgggtgtgggagatgggtaaaaaggtattggatgtactgtagagaatacaacctctcactttctattagatgagttttccaatttccaaagaaaaatttaggtttcctgcagccgtgacatatgtgtgtgcactgggatgggttaatgtgtgtgtgtgtgtgtgtatgcgcatgtattgggagtgggggcagaaacgtgtttccagaatttgcctgtagaatctaaaagagtggccaagagtctggaaatgcatgaagactggacgtatgtgatggtgggcaaaggcctgactgtgtgtggtgtgtgggtatgtttgcagattcgcgggtgtgagagcagtgatgggtgagggtggccttcaggagccaaggctgagcggtggtgagagaacaagccggaagccagggtgctgtcctggtatgctttggaggaacaggattgcacgtgcgcctgtagggtgacctgtgtgcacctgtgagatgacttagcttggggcttgcaaggcctgggtctgcatgggtgggtatctgaccatgccttttcctccctccctttcacgccgcgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaa

SEQ ID NO: 37333 - DNA, 895651 bp, Homo sapiens; identical to SEQ ID NO: 36080

SEQ ID NO: 37334 - DNA, 10353 bp, Homo sapiens; identical to SEQ ID NO: 35735

SEQ ID NO: 37335 - DNA, 99176 bp, Homo sapiens
tcccggtcctgggtttccttggcgctgcggccgccgctccctctgcgacctgtatgaggaggaggaggaggaggatgtgaagatggcggagctgcagatgctgctggaagaggaaatcccggggggccgccgggccctcttcgacagctacacaaatctggaacgggtggccgattactgcgagaacaactacatacaggtgcgaagcatccccagctgggccgcgtcggggacccccccgccgggggccgcgcgcctcggggcgtggggccgaggccgcctcggggacacggcccagcggagcccccgatgggggtggggagctgggtgagggctggggctggtgaatgggtgggaattctccggctggagaaactgcattttaaaaacctttaaaaaagcggtgaagcagttctcggcgtggtgcgtgtgtcgcgtcccgcctcctcgccgctcccgccctcggccgcccccgcactccgcgccggtcagcgttccggatggcggagggggcggagagtggcattttctgtttgacggaatcctgctccccaccttagggtaggggtgtcgcgggtgttgacgggttacctccatcccccaaattctggatgatttttaaggggttatcttgctgcagagtgaagtgcttcaggcttcagttttctgttcctgtgaatgcttcagaaaccctttcttaatattttatgttctaaaggggatacggtagaagagcagcagtttcttgttggaagttaatgccatttttttccctatggagaaggatgatgagctgattcccccctccctcctagttctgttagaataggcagttttcctgggggtgggaggaggacagactatgactgtttcttagagagaattgggaagatgaacctcctggtttaattttttttttttttttttttttttaccgtgatggatcgtttggctcaagggctgatagtggtaggggcgtgtgtatggaggcgggggataccggatggtatgagatccagctgctcctggatgaagcaaaatattctgtggattaaaaaaatccttctttaaaaattacttgaaaggatagcaggttaaaaggcacagtttgcaaaatctaaaatcttttgcttttttttttatggttattttgaattatgggttctgcctccattttttttctttcccgtttaaattctcttgggataaagatggaaatggaagcaatatgttaaactgtttcttcacagtctttttttttttccttttttcttgctcccacctccatctctccagggatccttcttttttcttttctttttgagacacaacctcgttctgtagtccaggttggagtgcagtggcgcgatctcggctcactgaaacctcggcctcctaggtttgagcaattctcatgcttcagcttcccgagtagctgggactacaggcgcccgccaccacagccggctaatttttgtatttttagtaaagatggggtttcaccatgttgaccagactggtctcgaactcctgacttcaagtcatccacccacctcggcctcccaaagtgctgggattataggcgtgaggcacctttcttaacattagctatataggaaagcattttcatgtcttagtgtaaattttaaaaaacaggtgttacaattttataggttcataaattttgtaatggccacattgttgatcgcggaagtgagattttgtttgattagacatactgttatcttgtagacaacatttgtatttgagaatgacccgaaccactgtataaacctgttccttcgaaagaggcagttgactatggctactaggaaaggaatgtaggcaagattaatacaaaaaaatacaaatgtccacttgtaatgtactttgctgatacaagtggggtagaaaagattcagaggttcaggcctgggcgataagagtgagactacatatcaaaaaaaaaaaaaaaaaaagattcacttgctcaatttttcgctaaaattgaaagtcttttatggcctagaactgtgtgaggggtggatggtacatacctagtaggagaggctgatcttggaggaaattaataccatgtagttaatttatactctgtagtgcactgctggtaccaaggaggactggaggaagcaatgctgttctgagggatttcacaatctctagtagaggcaaaacctaaaggaatgaagtggtaattccattgccttgtgcagcatattatggggaaagagttgcaggtcagaagagaaactgagggtggaaaagtggattgcaattattaccagtaagaaataaaaaataaacagatttctctctcttttgcaagatgatttcttattgtaatttgaaggtacaagttcctcttaagttataattgctatataaaggtaaaaggataaggattattaaagctgaaaggttaaaggcatcagcagttttctttttaaatattttatacatttccttcagttgaaaagagaaaaacgttactactatcaatctctgttttagcaatgggactcaaaatttagtgtggtgacattttaaaatttaaagcataaatattgattaatattaatttaatagaaatgaacttagattttaaaatagtttatttcttcagtttagcatctgaagtatattttacactttctcttttttgattatcatttattttaggatgccttaggtatataattggtacactctcaggatgatagctcttatatgatttgttgatttgttgggaaagttgataaatagaacgtggtgacagtggatttgtgctgatccagctgtacatttggttgaccagcaggggttttgatgctgcctggaccctgcagtagatgaaagttaattcacaggatcagtgatcaaatggtcaatttagccttttttttttttttttttttctgagacagagtctcactctgtcgcccaggctagagtgtagtggcgcgatctcgatctctgctcactgcaacctccgcctcctgggttcaagcgattcttctgcctcagccttccaagtagctgggactacaggtgtgtaccaccatgcctggctaatttttgtatttttagtagagacgggatttccccattttggccaggctggtctggaactcctggcctcagatgatcgacctgccttggcctccccaaagtgttgggattacaggcgtgagccaccgcacctggccaatttagccttattatagcatcatgtcttagccactagctcgagttaactaacccaacactcattttattgtgtggaaatgtaatttttgcctataaagtagaaaaaaatctgtttatcatgtgtaataagtgtttttgctcagtgttctttttttttttttttttttgacacagagtttcactctgtcgcccaggctggagtgcagtggcgcgatctcagctcactgcaaccttcgtcccccgggttcaagtgattgtcctgcctcagcctcccgagtagctgggattacaggcacgtgccaacacgcccagctaatttttgtatttttggtagagatggggttttgccatgttggccaggctagtctcaaactcctgaccccagatgacccacccacctcggcctcccaaagtgctaggattacaggcgtgagccaccgtgcctggccccctaagagtcatttttaataaaaatttagatagtttcattattctaacctctagaaaatgggatagtcaatattttttctaaaatatgataaacaggtataactacagtttgctgatatttatcagatcaattttatttcttgcctatacaaaggatttagtagttggtagagacttttttttgagatacatgtaagacctgcgtttttcttcatttattaatatacacacctaggccgggcacggtggcccacgcctgtaatcccagcactttgggaggccgaggcaggcacatcacgagatcaggagatccagaccatcctggccaacatggtgaaaccgcgtatctactaaaaatacaaaaattagctggctatggtggcgtgtgcctgtagtcccagctacttgggaggctgagatgggagaatcacttgaacctgggaagcggaggttgcagtgagccaagatcatgccattgcactccagcctgggcgacagagcaagactctgtctcaaaaaaacaaaaattacacatataatgcctaatatgtttgaaggtgtccaggaattaaaaatgttttggttaacttggaatctacgtttttacaaatagaagaatttttattacaatatagttgtcttaatgttttggtagatgaaataactccctatttgttacttccctgaaatctgaaaagccaacttgttgatatgtacgtttttctttttgttagataaaagttactgatttttgtgagtgacagttcacatagatgcatagtaaaatcttattgtttggattaagagtagaatcatcccataatatggatttattcaaaagagaagaaattaagaacttaccttaaatttttacctgaaatatttttgaacaataggagacatattagtagctttccttttcttctcttaatcaatgtggatactcccagagttcactaaaaacttcatgagaggtttacaagggaatattatcagtcagtttcatcaaaagtaattaccaaaatgatacaaagatttaaaatttttatttaataaaaatcattagaatacatgctcattgttgaaaaattattggagaatacaagtaggtattatgaaagaaatggaaaattgcccgatcatcttgaatatatatctggtactcatacttttaaatattttttgtatgcacaactatatatcaatatttttgtagaaatgggtttatgttctatattctgtacctttaaaagaaccttttaaggatgctgggcttgacttttttttaaatggatgtcatatactatattgggaggaggttggttatatttataggtcgagttctgtatgttcttgcaaatgggagaatcttagaatacctagaatgaaggagaaagaggtcagttgagagtaaggagactgagtagaatttgggagactgaattccccatagattaagatgactcaactcatttgaaattgatcaaggcttaccattcctcaagaaattagtccctaactctcagcagagacatttggtgaatagattttcagtgacaaatcagtcatcttcaagacctttgacaagattgcaaaaacaggctaatttatatttgagccccttgctcttttaaacattttgtcatttgtacacttcctacaccttcttgtccaaggaacttaagtgacctcataatttccgttattgatccaggaaatccagtctcacctcatttcacccttccttgaagagcttcctggttcaaaattgctctttaccaaaataattaattaataaactgttcatttattttttcttttcttttttctttctttttttttttttttgagatggagtctcactcctttgcccaggttagagtgcagtggcgtgatcttcgctcactacaacctccggctcctgggttcaagcaattctcctgcttcagcctcctgagtagttgggactacaggcatgtgtcagcatacccagctaatttttgtatttttagtaaagacagggtttctccatgttggccaggctggtctcgaattcctgacctcaagtgatccacccgccttggccttccacagtgctgggattacaggtgtgagccatcgtgcccagcctcatttactttttcttcttaccttggtatgggtaatgtgagaatgtatgataggtttactttatttagagtcatcttttctcacccagagaataatatataaaccaaattggtttacttatgtgtaaaatatgtagtagagatatttttgagcatgaggtgcttttggtgttactttttcttttaaaatgcagggaatttaatagtatgcagtttcagggtgtgtaaggtaatcttttggtggatgaaatatatttggtggatgaatatgctgtgatttgcttacacccaccccaaatccattttgcagcaccctactcactgtccagagattctgggaaaaaaacaatagagaagacaaagccagtctagacaccatttgactctaccttgtgaatattctgaaagttacattaggctagttgtagattttttttttttttgagacagagtctctgtcgcccaggctggagtacagtggtgcgatctcagcttactgcaacctctgcctcctgggttcaagcaattctcctgtctcagcttcctgagtagctgggattacaggtgcacgccaccacgcctggctaatttttgtatttttagtagagacggggtttcaccgtattggccaggctggtctcgagatcctgaccttaggtgatccgcccgcctcggcctcccaaagtgctgggattacagcgtaagccaccgtgcctggcctagttgtagacttttgatagcttatggttgaatttttatgggattggttaatagattggattcatgaggtagcatgtagggcaacacattctattttggatttttcatttactttgtgtttccttccagatacgaagctcctagaagatggagtcatttcttaaaaatttctatattttcccattagccgtaggatgttctccatatactagccactcattaaatagttgctgaatgtaagaaatacagacttgaatatgcaagagcctatgcactgaattatttttattttattactttattttattttattttttgagacagggtctcactctgtcactcaggctggagtgtagtagcacgattatgggtcactgcagcttgcactcccaagctcaaacagtcttcacacttcagctcccaaagtagctgggactacaggcttgtgccaccatgcccagctaattttttttgttgttgttgttagaaatgggatctcactatgttgctccggctggtcttggaacacctgggctcaagcaattctcctgccttggcttcccaaagtgctgggattacacctgtcagccgccatgcctggccttgaattattttataagtaggatataattacatgtaaatttaccttgcaagttttttcctatttgattttttggtgacatttatgttctgtaaagttttgcagtacttttcatatttgcataattcatgcaaggaacatagttttgcttttttcttcttaagtaatatactttgtagaaaatttggatgaggtaacagctttgttttgaatcatttacaacatgaattttttctcatttgatttttaaagtcaggtttattgagttttaatacatatatggtacaagtcaccctttttaggtgtaaaggtttatgaattacaataaacttacatagtcatgtaaccaccacaatgtaaaattttccttgtaccctctgtagtcagtcctgtccctccactactagcctttggtaaacactgatatattttctgtccctctagtttttgccttttccagaatgccatataaggggcattatgtagtatatagccttttgtgtttgacttcttggtactagaagtcctaatacatttgaaaatcatcagtgttattgtgttttgtcagtactttgttccttcttattactgagtaatattctagagtatgaaagaatcataatttgttcatccattcaccaactgatggatttctggattgtttctagttttaggcagtggtgaatatggctgtaaacatttgtatacaggtgttggtgcaacctaagtcttcactcttttgggtaaatttaagggaaaagatcaactgttgtaccctggtaacagtggatgtatccacataggctgcataggccagtgcttgaactgcatctgatctgaatcttggccgagcactttgtgatcctcttggaatataagattatggaagtttgcgaggaccttatgtgaagccctttctcaatctcttcatctgccgaggaggctgtacgtgataacagtgcctcatcacctcctagttcccatgagatgaggctctctattgtacccttttaggtagtagctgcaggctgtaagactttagttgcagcatggcattggctcctccgcaacagagtgtcatatctatgttgtagtcacctggctccttttgttttagtattgctttacacaagggctgtatcttttactactattccttctgccctccatgtaaatggtaggctttctgaacctaacaagcagttgggcaggtctatcacattgccttctctttgccttgacaataaatatctaatagtgggattattaccgtatggtaaatgtgtgtttagttttatacaaattgccaaactcttttccaaaaacgatggtaccgttttgcgttcccaccagcaaagatccagttgttcttcatctttgtcagcatttggttttgtcaggttttaaaattttagctattctcttgttagtgatgtctcaaaggccatatatgacaagcctacaactaacatcatactcaaccatgaaaagttgaaaccttttcctctaagatcaggaataagacagtggtgcccagtgtcactagttctatttaatcaagtactgcaaagtactagaagtcctagccagccagttaggaaagaaaaataaacaaaaggcatcaaaattggaagaagttaaattgtctctgtttgcaaatgacatgattccttatgtatacaaaaccctaaagactccaccaaaagactgttagaattaattaacgaatttagtaaagttgtaggagacaagatcaacatacaaaaatctgttgtgtttctacatattaactacaaacgatctgaaaaattaagaaaacatttccatttataacagcagaaagaatagaatacttaggaataaatgtaatcaaggaggtgaaaggtctgtacactaaaaactataagacatttatgaaagtaattgaagaacatgcaaataaatgggaagatatcccgtgctcatgaattggtagatttgatattgttaacatgtccatactacacaaagccatctacagatttaatgcaatctctatcaatattccaatggtatttttcacaaaaatagaaaaaccctaaaattcataggaaaccacaaaatactttgaatagccaaagcagttttgaataagaacaaagttggaggtatcatacttcctgatttcaaactatattacaaagctataggcctggcatggtggttcatgcttgttatcccagcagtttgggaggcctaggtagccagatcacctgaggtcaggagttcaagaccagcctggccagcgtggagaaacctcatctctactaaaaatacaaaaattatagggcatgctggcacacgcctgtagtcccagctactcaggaggctgagttgggagaatcgcttgaacccaggaagtggaggttgcagtgagctgagatcatgccactgcactccatcctgggcaacagagcgagactctgtctcaaaaaaagctatagtaatcaaaacagtgtgttactggcataaaagacatgtagactaatggaacagaatggagcccggaaatgtagccacatctgtgcagtcaactaagctttgataaaggcaccaggtacacaatggggaaaggataattcagtaaatggtattgggaaaactatatccacatgcaaaagaatgaaatttgattgttatatcacacatacaaattagctagaaatggattaaagacttaaatgtaagatctgaaattataaaactctttggtatgggtcagatgtttgttcccttcaaatctcttgttgaaatgtgattcccagtgttggaggtgggtcttggtgggagataattggattatgggggcagatccctcatgaatgatgtagcaccatccctttagtgataagtgagttcttgcttggttcacgtgagaactggttgtttaaaattagtctgggagcccccccaccatgtgacatgctggctccacttctgccatgattacacctcaccagaagtacgtgccagcactgtgctttgtgtaaagcctgcagaaccaagagccgattaaacctcttttctttataaattacccagcctcaggtattccttcatacgatcataagaatggactgatacactcctagaagaaaacataggggaaaaagctccttgattctggtcttgacaatggtttttataaatatgacaccaaaagcacaggcaacaaaagcaagaaaagatgagagtgactacatcaaactaaaaggcttctgcacagcaaaggacacaaaatgaaaaggcaatttatggaatgggagaaaatgtgcaaaccatacatctatctgataaggggtttatatctgtgtgtgtgtgtgtgtgtgtatatgtatatatatatatatatatatatatataaatatatatatatatatataaatatatatatatatatatatatataaaggattcatacaacttaatagcaaaaaaccaaataaccagattttaaaaagacctaagtagacattttttcaaagaagacacacaggcgtccaacaggtatgtgaaaatgtgctcaacatcactaatcattagggaaatgcaagtcaaaacaaaaaggagctgtcacctcacacttgttagggtggctatcaaaagagagataagtgttggcaagcaggtggagaaaagagaatccttgtgtgcagtgagaatgtaaattggaacagccattatgaaaaactggttccggccgggtgtggtggctcatgcctgtaatcccagcactttgggaggccgaggcaggcagattacctgaggtcaggagttgaagaccagcctggccaatatggtgaaaccctgtttctcctaaaaataaaaaaattagctgggtgtggttggcgggtgtctgcagtcctagctactccagaggctgaagcaggagaattgcttgaacccgggaggcagaggttgcagtgagccgagattgcgccactgcactccagcctgggcaacagagcaagactccgtctcaaaaaaaaaaaaaaaaagaaaaagaaaaaaagaaaacccagttctccctaaaattaaaaataggacaaacatacaatcccacttctgggtatatatccctagggaatgaaatcattatctcaaagagacatctgcacacccatgttcatttcagcattattcatggtaactaagatatggaaacaacctaagtgtcagtggatgaatggatgaagaaaatgtgtactgcatgcacagttctccttcagtctacatggggcattggttctaggacccccaagtatacccaaatctgcatatactcaaatcctgcagtcacccttgtggaacgcgtgtatatgaaaagtcatctgtcccatctgtatatgtggatgaatactgtatttgtttgaaaataatctgtatattggacccacacagttaaagggtcaactgcatatgtaatagaatattattcagccataaaaagaaggaaaccctgctatttgtgacaacatggatgaacctggagaacattaggtaagtgaaataagccaggcacagaaagacaaataccgtatgatttcacttatatgaggaatctaaaaagatgaacccatagaatgaagcagataatagaatctgcttctattatcggccaagggccgttgggaggtggggagaaatggggagatgttagtcacagggcacaaacttgtagttataggatgaatgtgttttgggggtctaatgtactgtgtagtaactatagttaataatattgtatacttgaaatttactaagtcagtagatttttttttttttgagacagcgtcttgttctgttacccaggctggagtacagtggcatgatcacggctcactgcagcctcacctccccaggctcaagtgatgctcccaccttagccttccgaatagctgggactacatgtgtgtaccaccacacatggctaatttttgtagtgacggggtttcgccctgttgcccaggctggtctcgaactcctgggctctacccatccacccaccttggcctcccaaagtgctgggattacaggtgtgagctaccatttgcctggctgagagtagattttaagtgttgcccactccccgctcccaccaaagataatcaagaaatgattatcttgattgtgataaccattttacagtttatgtgtgtatcatgtcatcatgttgtacactttaaatatatacagtttttgtcagttatacctcagcaaagctgaaaaaaaaaacccaaagcaaactgaaccaaaacaatattgcctgcaagccacaaacaatcagcatctagccttgacatcatctcctgttacactcctttacccttctttgttcactcaacttcagccactttggcatccttttcttgaacataccaggcatacttctgcctcagggcctttttgctttgtatttgttatgccctctgccaggagtactctactccaagatagttgcatgattggttcttttacttccttcaagcttttgctgatacatcacgttcttgatgaccccttcctggctactctgtgtaaaattataacatactcctgccccttgctcactctccctttgcttatacttatccttccatgctttttttacgcctacatattttctcttaacatacagtgtttcttatttatttgtgtgttttccctccctggtatgtgagggcagagatttttgtctcttactcatttccagtacctggaacagtgcctggcacaaaataggcactccgtaaatattcgctaaatgagcgaattagatcttttctagtaagcattagaaaatgtcggagggcagtgaaataaattagttttgggccaggctcagtggctcactcctataatcctagcactttgggaggctgaggcaggcagacttcctgagctcaggagtttgagaccaccttggccaagatggcgaaaccccatctctactaaaaacaaaaaaatttctccgggcttgttggtgtgcaccagtagtgcctcgggaggctgaggcacgagagttgcttgaacccgggtggcagaggttacagtgagcctagattgcaccactgcactccagcctgggcaacagagcgagactccatctcaaaaaaaaacaaaagaaattagttttgcaaatttgaagagttgatagatttatgctctggaaaatgaaagttggcaaatactttttatttgtccagaatatttaatgtagatatggccaacagaattgacactaatattccacatgtggttggtgctttagggttaagcagtttatttacagttacttagtgcaggacttactcaatagtggaagctcatcaaatgtctgaactgatctacagcttcctgggaggtataagcaagggagatattcctattataacatattagatgagacaactcaagtttacctctgactctgctaaactaaaattctgtgaagagaggaattatgttcattttttttttgcctgttatgtcctcatttcttagtgttcagtaaatttttgttgagtaaaatgaacttatgactcacaccatttattttattatatgtttttttccttcctggtcgttcaaaaatagttattgagcatctttccattctgtgaggtcagtggtaagtaactcatggaccaagtccagttctgttaccattttgatttctatgaagaatcttcgttgtaaattttgaattaatggagttgaactgcatataatatgggactgtttttttgtttttcttgatgttatgtggccttacccacttatgtgttgaaggcttttcataaaggcaaggagataggttgttaggaacctacgaaacaaagttgaataggggaagccaacaagggatgccagcatctttcaatatgtagtaccacaagttttctgccagcagatagtgcttaaatagtgattccatgtctccctcaaaaccttttatttatttatttatttatttatttatttatttatttatttttgagacaaggtctcactctgtcatccaggctggagtgcagtggcgtgatctcagctcactgcagcctctgcctcctggtctcaggcactccttctgcctcagcctccttagtactactgctgggattacaggtgctcgccaccatgcctggctaatcgccctcaaaaccttttattctgaatctagaagagcaggctaggttgacaaaaatatttaaattgcctggcttgatataatgtctatacacacacacatctcattgtttttgagagaaaaggaagtttaaatttatggacatgaaatttatattatttctagttttttaatcattcatgcatttgtttataatgcattaacatgcataattatgaattttattcatgtgtaaataatacagtctataccgttaacaaaagaccatgagatctgtggaagaagaaaaaggagaactttatttcctatagaggattacagcctgcagattgggaagtggagcctccagccaaaactaaaagcaagcacctggggaggctgaggcaggtggatcacgtgaggtcaggagtttgagaccagcctggccaacatggtgaaaccttgtctctactaaaaatacaaaaattagcgggatgtggtggcacgcatctgtagtcccagctactcgggaggttgaagcaggagaatcgcatgaactcgggaagcggaggttgcagttagctgagattgcggcactgcactctagcctggacgacagcgagactatgtctcaaaaaacataaaaaaatttaatgttagcaggttagtttgtggtacaaacatgttatgtgcatgtaatgacaaggcattatattccaggtttttttttccttcttttgaaatgagtgattaaagatagaatttctaggactatttatttatttttgaaatagagatggggttgctcagggtgatctccaactcctgacctcaaagacatcctcctgcttgggcctcccaaagtgttgagattacaagtgtgagccactatgcccagcacttcagagttattaatgaggtttaaaaacatgtttttagaagtagatttaaagctctctgattgagattggtttaatactatttgatgttatttgcatataggctcttctgacaaaaatatgttaattaaatcatgtcctctttggccactaatcaggtcccctttctccctttccaaaagtaacagtttttgtccaagttagttaaaacactattttttggtgtatgtggtggctcacacctctaatctcagcactttgggaggctgaggtgggaggattgcttgagcccaggagtttgagactagccttggcaaaaagacgagagagaccccgtctctacaaaaattacagaaattagctggatatagaggtgtgtgatggtgtcccagctagttgggaggctgaggtgggaggattgcttgagctcagggttggaggctgcagtgacccttgatagtgcttgaaatgtcaaatgttactattcatttatatatttccatttggttcttactccatagtaaagcttagcgcttcaactgtttagagacagtcttattgagcagcataagttgtaccatcttacaattataagaaaagactataggccattaataatattcatagaaaggaaacaatctttaataataaaaccccaacaatgccagtaattgctttaaagtactaatgatgtatttcctgatgaaaaaatcaagaacaatataatttttaaatttttttttcctttttttttgagacagggtctcttgctctattgcccaggttggagtgcaggggcgtgatcatgtctcactgcagtctctgcctcctgggttcaagcgattcttctgccttagcctcctgagtagctgtgattacaggcaactgccgccacacccggctaatttttgctttgttgttgttgttgttgttgtttttgttttttttttttgagtcggaggtttgctcttattgcccaggctgtagtacaatggcatgatctttagaggtgaagccagctgggcttctgggtccggtggggacttggagaatttttctgtcttgctaaaggattgtaaacacaccaaacagtgctctgtgtctagctaaaggtttgtaagcgcaccaatcagcactctgtaaaaacggaccaatcaggactctgtgtctagctaaaggtttgcaagcgcaccaatctgcactttgtaaaaacgcaccagtcagcgctctgtgtcttgctaaaggtttgtaaatgcaccaataagcactctgtaaaaacgaaccaatcagcgctctgtaaaatggaccaaccagtgctctgtaaaatggaccaaccagtgctctgtaaaatggaccaatcagtaggacgtgggcatcacaaaataagggaataaaagctggctgccggagcccgcagtggcaacccgccggggtcctcttccatgctgtggaagctttcttcttaggctcttccccagtaaatcttgctgctgctcactctttgggtccgcactacctttatgagttgtaacactcacattgaaggtctgcagcttcactcctgaagccagcgagaccacaaacttatcgggaggaacaaataactccagacacgccattttgagagctgtaacgctcactgcgaaggtctgtggcttcaccctgaagtcaagcgaaaccaggaacccactggaaggaagaaactccggacagatctgaacatctgaaggaacaaactccggacacaccatctttaagaactgtaacattcacggcgagggtccacgggttcattcttgaagtcagccagaccaagaacccaccggaaggaaccaattccggacacaatcttagctcactgcaatctccacctcctgggttcaagcgattctcctgcctcagcctcctgagtagctgggacaacaggtgcccgccaccatgccagctaatttggtatttttagtagagatggggtttcaccgtcttggccagtctggtctcgaactcctgacttcaggtgatccacccacctcggcctcccagagagctgggattacaggcctgagccaccacgcccagccctaatttttgtatttttagtagagacggggtttcaccacattggccaggctggtttcaaactcctgacctcaagtgatccactggcctcggcctcccagagtgctggggttacaggcgtgaggcactgtgcccagcaatattttcttttttaatcagatgagttttgcttttgacaaaaatttgcttctggccgggcacggtggctcacgcctgtaatcccagcactttaggaggccgaggcgggcaaatcacctgagatcaggagtttaagactagccaggacaacatggtgaaaccctgtctctactaaaaatacacacgcgcacacacacacacaaactgaggcaggagaatcgcttgaactggggaggtggtggttgcagtgaatggagatcatgccattcactccagtctgggtgacaagagtgaaactccatctcaaaaaaaaaaaaattgcttgtaattctatgttgattccaaataagatttcagaatagtaagctatttcccaactatttaaatctttgaggagtttattgttgcagatgtgcaaaccagatagatctaccggatgctactttggtatttggtatctttttcaggtttttgctaacaaccacaaaagactatgtttgtttgtttgtttgtatattagaggaaaatatttctgcagcttgggaatatatgggactaataggcatgtgtatcaccagtgtgtatgataccatattactgcctgaatgaacacatcagctgtaagaaggaaggtgagaatttgagaaatactggtctgtgttttgggtttatccattactggagttgcacgttttcccttgtcataattcctgtagcttttagctcttcctcattgtctgttgagttgaattaactctttctcccccaccacatttaactctagggagtgtaaacttgtgctgttctctttctcattccatgtttctgttgtcttttagttaacatcttgtctttgaggggaatgaattaacttctttaagggaagtgaattaactactttgagagaaataggagaaagagcagggacaaaataataacctgtggccaaaaggaggggatgtgatgtatgatgaaatgtcattcctttatcttatcttatattcttgcagtgctagctgttaaaatggatccagtagaccttaaacctaggcccttgtttgtgctgcccgacttcatgtgctatagtgcattttaaaatttattcagccattcatttcttatcttataaacttgaatttgttttaattttgtatagtttttcttatttaggaaggactttgtgttcttacatgagtttcatataatagagtttgaaactaagctattaaattatgatgattgccctaacatgtgcatcaggtacttttttgttttgtagttggttttattggagccattgcatgtcctaacagggtaaggagtgatcatatagaaagcaaggaagtgatgggtttggtctctggtcaaaccatagaagtgagttgagtaattcatttttgctctatttttccatctgaaaatgggaaggatgatatcctgactcccagtttatgcaagttttgttcatagataaaggtgcactggttttcactcatcttttgtgtgaaatttctggtggcataggaatttagaaagaaatcaataaacttgtgattcttgttctgaagatacttctagccttgtaatcccataatggacataagaccattacacgaagaaccgtagcatgtagtaaatggcatgatgacattaccacccaaggaaaatgtgcagtggaaactcatggttcaatttgacaaggcgtttatcaatctccaccatgtgccaagcctttctgggcagctgagagaagagataacaaaatagtttctgttttagagaacagggaatagaaatgatataaggattgagatgatatttttataatactttaggtttattctgcacaggcaaactgtgtattatacgacacataacttatgacacttaggtttctaactgggaaattgtaggtgcttgtttagttattgggtgttgttaatggctttttggtttggcagtttgtctaaggcctagcagttgtttgaggaacatttacatataggattaaccttttgtaatgttttcagaatcctgcagtttcgatgctttctagatatttaggatttgatcattaaccaggtgataatataagcatgaaaaaaatgatttgggctgggcgcaggtggctcatgcctataatcccagcactttgggagggtgaggtgggtggatcacttgaggtcaggagttcgagaccatcttggccaacgtggtgaaccctcgtgtctcctaaaaatacaaaagttagctgggcatgatggcgggtgtctgtaatcccagctacttgggaggctcaggcaggagaatcgcttgaacccgggtggcgaaggttgcagtgagcagagatcgcgccactgcactgtagcctgggggacagagcgaaactttgtctcaaaataataatattttatgtgaaaataaatgtaataaaggttaagcttagtattttaaagtttgtttattcctagggagtaatagttcccacattaaacatgaagagtttttcaaaactcagtgatcattctaattggtatgaagcatgcaggaggtaattagcttaagatgcaatggtggaaaacatgcataatttatatacaagccttgttacatgtgcagctatgaaagagttctttttcatatggtcagttatatgttatatgtcgacaagataattaaaagtagatttataagccaaaatttaatgatggttaagttaatggaaattttccctcaattaaaaacattcaacaataatgtaatatcacctcacctgggtgaaatgagtttattttatcttattatttttttaataggctttactttttagagcagttttaggtttacactgtgaaattgagaagaaggtacagagatttctcatgtattttcttcctcccatcacgtatgtacagccgcctccattattaatatctgtctccagagtggtacatcattataattgatgaatctacacatcattatcacccaaaatttcttttatttttaattaaaaatttttttaaaaaatagtacaaagccccctgaaccttgctgaaggtgtttttttttgttttttgtttgtttgtttgtttgtttgtttttgagacagggtttcacttccattgtctaggctggagtgcaatggtgtgatctcggctcactgcagcctctacctcgtgggttcaagtgattctcctgcctcagcctcctgagtagctgggattagaggcatgtgccactgcacccgagtaatttttttttttgtatttttttttttagaggtgggcttttgccttgttgcgcaagctggtctccaactcctgaactcaaacagtctgcctgccttggcttcccaaagtgctggggttacaggcattagcctctgaacccagctggtgccctataactcttgaacactttagtgtgttttttccacaaacaagaatgttttcctgattaatcacaaaatagtcataacaatcaggaaataatattgatatatttccactgtctaatcctgaagtctccattaacattttgccatgttttccagtgatatcctttcttcttttttgaggcggagttttgctcttgttgcccaggctggagtgcaatggtaggatctttgctcactgcaacctctgcctcccacgttcaagcgattctccttcctcagcctcccaagtagctggaattacaggcacatgccaccatgcctggctaatttttgtatttttagtaaagacagggtttcaccacgttggtcaggctggtctcgaactcctgacctcaggtgatccgcctgccttggcctcccaaagtggtgggattacaggtgtgagccactgtgcccggctgtgttcatttttttttttttttacggctgaataatattctagtacatggataataccacattttgtttacccatttgtcagttgattgacattctgatttttccaccttttgccaattatgagtaatttcataacatataacgttataaatattcatgtacaagtttttgtgtgggcatatgtgctcgtttctttggggtatatacctaagagtagaattgctggatcatatggtaactgtatatttaaccatttgaggaactgccagcctgttttcccaggtagttgcactattttccatttccaccatcagtgtgtgagcgttccagtttctccacattgttgtcagcatttgtggactgtctctttatttaaattcaattaaattttttgagacagaatctcactgtcacctaggcgggagtgcagtggtgctatcttggctcactgtaacctctgtctcccggattcaagccattctcatgcctcaaccttttgagtagctgggattatgggtgtgcattactatgcccggctaattctcgtatttttagtagagacgaggtttcaccgtgttggcctggctggcctcgaactcttgacctcaggtgatcctcccgcctcgtgaccaaccacgcctggccaacggtctctgtttttaagagacagggtcagtctctgtcgcccaggctggagtacagcggcatgatcataagctcactgtaatctggaactcatgggctcaagcaagcctccagccttagtctccctagtagctaggactagaggtagacactaccacatgtggttactattttttctttttctttcttttcttttttttttttttttaaagttgaagtcttaatctgtcgcccaggctagagtgtagtggcgtgatctcggctcactgcaatctctgcctcccgggttcaagtgattctcctgtctcagcctcccaagtagcagggattacgggtgcccgccactgtgcgcagctaatttttatatttttattagagatggggtttcaccatcttggccaggctggtctcgaactcctgacctcatgatccacccgcctcggcctcccaaagtgctgggattataggcatgagccactgttcccggccttttctttgtttttgttgtgtgttttgtgtgtgtgtgtgtgtgtgtgtgtgtgtgcgcgcgcgcatacttttaggtgttatatataagaaactattgcctaatccagagtctttgaagattttctcctaggagttttatagttttagctcttacatttagatctttgatccattttgagttaatttttgcatatgttgtaaagtaggggttcatatttactcttttgcatgtcactatccagttgacccaacaccatttgtttaaaagccttttctttccctcgttaaattgttttggcatcttcgtcaaaaattacccataaatgtgcagttttatttctggactctgaattccattgatctatatgtctatctgtatgccagtacttcagtgtttttattactgtacttttatagttttaaaattgtgacgtatcttctacctttgttcttccgtttcaggattattttggctattctatagcccctgaatttccatataaattttaggatcatttgttaatttctgccacaaaggcagctgggattttgacagtaattatattgaatctgtagataaacttggggagccatcttaatgatagtaacttttctgatccatgaacatggatgtcttttcatttacatcatcttaaaatttctttcaatgatgttttgtagttttcagtgtttagtttttttttttttttcctttagagatggggtcttggtatgtcatgcaggctggaatgcagtggtgtgatcatagctcactgcagccttgaactcctgtgctcaagtgatcatcctgcctcagtctctcagtagtctgggactacaggtgcgtgctactgtgcccggctgattttcgtattttttgtagagccagcatctcacttcattgctcaggctggtcccaaactcctggcctcaagcagtcctcccactgtggcctccccaagtgctggtattacaggagtgaactaccgcacccagccggttttcagtgtttcagtctcgtacagtcatgcgcagcataatgatgttctggtcaatgatggacagcatatatgatggtggtcccataagattataacagctgaaaaattcctaacacctagtgacatggtagccgtcctaatgttgtagcacaatgcattactcttgtgtttgtggtgattctggtgtaaacaaacctacttcgctactagtcgttatagaagagcaaaggcagaagacacacacatcacaattttaaaactatgaaagtacaataataaagacactgtggtactggcatacagatacacatatagatgtagcagctggttgtccaggctgggtggggtgctgcccccatgcctataatcccagctttttgggagcccgagatggaaggacggcttgagttcagaagttcaaggttacagtgataataataaagattattactggtatatgtatttatgatattgtactttttattttagagtttactcctacttattaaaaaaaagttaactgtaaaggagtctcaggcagtccttcaggaggattccagatgaaggcattgttatcagaggagatgacagttccataagtgttattgcctgtgatgaccttccagtggaacaagatgtggaggtggaagacagtgatattgatgatcctgaccctgtgtagggttaggctaatacgtctgtgtctcggtttttaacaaaaaaagttaaagaaaaaaaaaatagagaaaagagaaaatgatataaagaaaaaaatgttgtacaactgcataatgtatttttattacaacagtcaaaagtttatgaggtaaaaattacagtaaaggttaatttattattggagagagaaaatttaagaaataaatttagcgtagcataaatctacagtgtttttaaagtctacagtactgtacagtaatgtcctaggccctcctattacccagacatgttctagtcctgtaagctgcgttgatggtaagtgccctatgcaggtataccattttttatcttttatgctgtgttgttactgtaccttctctatgtttaggtattcaaatgcttaccattatgttaaaactctctatagtattccatatggtaacatactgtacaggtttgtcgtgtaggagcagtaggctataccatatagcctagtgtgtagtatgctctttcatctagatttgcgaagtttactctgtgatgtttgcacagtgacagaattgtctaatgacgcatttctcagaatgtatccctgttaagtgatgcatgactgtacttctgtttctaaatttattcctaaatattttattctttttctgttgtgaatggaatttgtaattttttttcagattacaattatcatataaaaatacagttgattttgtatattgatctttcatggttacttaaacttgaattaaaattacatttaaaattacattttgcatttccactagctaccattcaagcgcttcatagctacatgtggctagtgactaccatatttagtagcacagatttgattattttcaacgttgcagttttattagataccaaataaaaacaaaaaaatgagtaccccttttacctctaatttccctctgtccagaggtgcttcatttatgtatttatttattttttgagacagaatctcgctctgtcgcccagactggagtgcagtggcatggtcttctctcacagcaacctctgcctcccgggctcaagtgattctcctgcctcagcctcctgagtagctaggactacaggcatgtgccaccacgcctggctggtggctcattcctgtaatgtttttatatttttagtagagatggggttttaccatgttggccaggctggtctcgaactttttacctcaagtggtctgtccaccttggcgttccaaagtgttgggattacaggcgtgagccaccatgccaggcccagaggtactttaaactcttatctgtttcttctggtacttgtctccatatgtccatgtgatatgcccatattgctattttttgagattcagacatttttactatgagatatggtaacttagctttcttatatttcttcctatcttcttaacatgtagatttagcaacttttagatttattcattgtatccattatatctatataagtaatcacagctgaagcatagagtggattgtgattagattttatttatttatttatttttgagacaaggtttgactctgtcgcccaggttggagtgcggtggcgcaatctcagttcactgcaacctccacctcccgggctcaagccaacctcccaccttggcctccaagtagctgggactacaggcacgcttcaccacgccctgctaatttttgtattttttatagagacagggtttcgccatgttgcccaggctggtctcaaactcctgagctcaagtgatcttctcgcctcagcctcccaaagtgctgggattacaggtgtgagccactgcacccagccaattagacttcttaaattttttcttttccttggccctaataattcatttttttgacttgcttagttacctgtgaatctatctttaattcatctctaaactctcctctggatgtatgaatcttatatgaacatactgaaacatatcagtaaactaccaattgtcaagaccttcgaagggactgaatttttaccctgtctggaagttaacaggttagccagggagttttgtagatgctgtggcaaaagatgtgagacttctgggtcaaaggcgtaggactttattacagcaacaataatagccagcatattagcattttcttgcactatactggttcccaaggccccagttcacatattgtgataagaagaggcccaggtgatacttgtatatgcaagggttgtattacagggaagaacctgaatttaggtaacctaaatcttttatattggtctgtaaacatgcctgccctttgctccagagggatatgctatcttagtatcttctaagactgttttcgatataaacatttctggaaaagatggtgtggaataaaggtagtcagtacctctgctcacatgagtgcagagacctatggaaaattgtcttctaatatcagtttcatccatcctccccacaagaagacataagtgtgtcccctttgccattctccaatctggattgtctggattgttaacgttttagtcctgcttctcagctgcatctcagaagtttcctttgctgtcaaccttggatttcccttttcctctttgatgtagatcctattttctggatcccatgcttctttctaggctttccgttttgacagtgcatatcctctggtgcttcctgacaaagaatacatggaaagttaaaaaaagaagactgggtacggtggctcattcctgtaatcctagcactttgggaggtcatggtaagaggattgctggagctcaggtgggaagactagcctgagcaacatggtgagttgtttctactaaaaataaaataaaaaaaaaaattagccaggcgtggtggtgcgtgcttctagtccagactacttgggaggctgaggctagaggattgcttgagcctgagagtttgaagctgcagtgagctgtcattgcaccactgcactctagcctgggcgacagagcaggaccctgtctcaacaaaagaaaacaacaaaaaacaaaaaacccaagaggccaggcgcagtggctcatgcctgtaatcccagcactttgggaggctgaggtgggcggatcacctgaggtctggagttccagaccagcctgatcaacatggagaaaccccgtctttactaaaaaaatacagaattaggcaggcatggtggcgcacgcctgtaatcccagctactcgggaggctgaggcaggagaatcgcttgaatctgggaggcagaggttgctgtgagccgagattacgccattgcactccagcctgggcaacaagagcaaaactgtctcaaaaaaaaaaaaaaaaaaaaaacaccccaccaagaaacccctggtgtgctgaaaatcttcaactttcactagatggtttgactagatgtagaattatagattggaaataattttttccccagattgtaaaggcattcttttagtttattgtctcctagcttttgttgttgcctttgaaaagtcaagtagtgttttgattctcagttctttgtatatagttttttttctctctctctgaaagcttatggaatcatttattcctcatgatgatgatccttcctacgggtctttttcattaattgtactgcacacttaatgagtgcagttagtggagacatacttttcaggtctgaaaaaattaacttgtgttttttttgagacaaggtcttgctctgtcacccaggctggagggcagtgttgcaatcatggctcactacgagctcagactcctgggatctcatgtcttagcctcccaagtagctgggatcacaggcctgtgccatcacaccaggctaattttttaatttaatgaaattttattttattttatttattttgagacagagtctcgctctgttgcccaggctggagtgcattggcgtgatcttggctcactgcaacctcttcctctcaggtttgagcaattctcctgcctcagcctcccgagtagctgggactacaggcgcgtgctgccacgcccggctaattttttgtattttagtagagacgggaatctcaccatgttacccaggctggtctcgaactcctgagctcaggcgatccacccaccttggcctccgaaagtgctatgattgcaggcgttagccaccattccagtccaaatttttaaattttttgtggagatgatgtctcaccatgttgcccagtctcgaactcctgggctcaagcaatcttcctgcctcgacctcccagagtgttgggattataggcatgaactaccacactcggcagcatattttaaaatgcagttatttctgaaagtttttggttttacacaatttttttttttttaggtaataagatgtattgtaaggattatgcttacgtatggtacagagtatacttcacattgttcctgtcttttttgtgggggagggaatgaccgaaagcattgggaatgttaaaggcaaatgagtaaaaagaaaactaaaaaacgattacttcttcaaataatgaggaaagcgtttttaaaatttttgtctgtttttaaaaagcaagtttcatgttagatttcttaccacactcaattttttcctaatataaaatagatataaaatttgtgatttgttactttttatgtaagcatatatagtccagtctaaaatgaccaacttccaaatgtgttccagaaaagaatcatgacattttatagctgaaaaggacctaaaaatccagtccttttaatataacatatggtaactgactccttgggagtataaattaattatttaagagcaagtaagatagtagcagagctagaacaataactcagatgcccttatccattctaatatccacagcatttctagaaacctcacttaaggcattaatgtgataggttttactcaaaatagtcaaccacaaatgtagcaaatacctaggtgactttatgttctgaatctcacgaagattaacctctgatcatttgttttatttctaaataacctcctttttctaaagtgctcctctgacactttggtgtgtaggtgaatatcaagttaacctgcctcagttatttccagtttgtctatacatatgttgtctaggcagatgatataacatattttaaaagtgtcatgttattgagaactgaagccagtatatgttaaatgattaaaaggaacaatttaaagaattttaggattctttggtctcaagtgacagaaactgaatttggtttttggggttttttgtttgtttgtttgtttgtttgtttgagacagagtctcactctgttacccaggctggagtgcagtggcgcagtcttggctcactgcagcctccgcctcctggcttcaaacgattctcctgcctcagcctcccaagtagctgggactacaggtgtggaccaccacacctggctaatttttgtatttttagtagagatgaggtttcaccatattgaccaggctgtctcgaactcctgacctcctgtgatccatccgcctcagcctcctgaagtgctgggattacagccatgagccactgtgcctggcctgtttgtgtgtgtgtgtgtgtgtgtgtgtgtgtgtgtgtgtgtgtgtttgtttgtttgtttgtttttgagacagggccttgctctgttgaccaggctggagcgcagtggtagttagtcatagctcgctatatcttcactgcagctttgaactcctgggctcaagtgatcctcccttctctgcctcccaagtagctgggactacaggtgtatgccaccatgcctggcaagtttttaaattttatttttattttttattttttgtagagacaaggtctttctctgttgcccaggctgatcttgaactcctggcctcaagtgattcttctgccttgtcttcccaaagtgccaggattacaggtgtgagccaccacagccagccagaaatgtagtttgaacaaacttaaacaacaaaacgtaaatttattagttattaattaaaccatgtgaaggaacaggaatcactggaatcaggaactcaaacacttttagaattctgtgtctcgtttctgcttctttatgcatgttggcttcatcctttcagatgggcatactccattttctgtgagatatcctttcatgtgttttaggccttgtatattaatagttctgacatcagaagacaaaagcattctctcttttagaatcagtttgaaaaatccagccaggcatggtgattcacacctgtaattccagcactttgggaggctgaggtgggcagatcacttaaatccatgagtttgagaccagcctgactaacatggcgaaacccaatctctactaaaacaaaccacaaattagctgggtgtaatgatgcacgtctgtaatcttagctgctccggagactgaggcacaagaactgcttgagcctgggaggcagaggttgcagtgagccaatatcgtgccactgcacttcagcctgggtgacagagtgagactctgtctcaaaaaaacaaaaaacaaaagaaaaatccatggagggatctatgtcatggtcctgttgcttgaacaaaatcactgtgggcctaaaatgggcaaatgtattggaatttccttagtgtaggtcagactgtggggtgtgggatggagagaaggcattttgttttcctttttaatcaagatgcttctgagacaaatgtgatctgctatgacagattaaggtttttttaaataacataaccagtctttttatatatgcctttatattttccttcattttcatatgaactgaagacttctaattcccaagttgatagaattttcactgattacattttcacttgagttcttatgagtgatgtcttaatttagagtattcagcctgtagtttctctcatttgtagaatgtacaaagatcccaaatctgtactttgcttaatgtgaaaaaatcaatatttttaaaatctgttgtagttagacaatatacaggttatattcaaatatgtgcaagtatataaatgtatgtgtcttagttcattggtccttctaaaacaaaatatcttaggctggggtaacttagcagagatttattgcttgcagttctagaggctgggaagtccaagatcaagacgtcagcagatttggtgtctgttgatgacctgttcctcataaatggtgccttctgtgtgtcctcatttggcagaagggacaaacaagctcccttggacctcttttataagggcactaatcccattcatgaaggctctgcctaatcacctcctaaaggctccacctcttaataccatcaacatcagtgttaggttccaacatgtacatttttgggggggggacacaaaaattcagactatagcaatgaatatttagaaattaagcagttttggccaggtatggtggttcatgcctgtaatcccagcagtttgggaggctgaggcgggtggatcatgaggtcaagagattgagaccatcctggccaacatggtaaaaccccgtgcctgctaaaagtacagaaattagctgggcgtggtggtgcatgcctgtagtcccagctactcaggaggctgaggcaggagaatcgcctgaacctgggaggtggaggttgcagggagctaagattgcaccactgcactctagtctgggtgacagaacgagactccatctcaaaaaaaaaaaaaaaaaaaaaaagaagcagttgtaccctaaaggccttttaagttagttaatgtggtctattttattttaggatttaaaaaaacactttaaaataatttaaaaacaatttgtgttgtcatgtgaggtcggttatcaatgataaaggttcttattggtaagaggatgaggaatgctttaaacaaaaggcgaagtgttgggtggagcagattatttggcttagatttttgagaagctggaaaggagaaatgggatatgatgaagggaaacaaatttggtggtttgggatagaacagttgaggcactgtaaacatgaggtaagaagaattaaagcagtgtaagtagtggaggacagagatggtaagaatagagagagatgaacaggctaaagaagcagtttagcaaaatggagaatttagataccaggaatgacctgattcaggctagtaagtgacgtttgcctagagatcagtctaactggggctcaagatatggcctagctgtgaaacaacagatgatgagtgagaagcccagcatgcagaaaagaagtttgcttggcaaaccagagattctaccaatatttagggacatggctttccaagatcaggaaacttctgagtttagaacattgactcaacacaaggttaaatgggactcttgtttagtctcctttgactcttatgctgttgctaatatcatttatgaaatcagcaaggaccaaaattagggtaacaactaattgttaccctttcaaggatgacgtatgctctgtttattcaagagtaatacattactgaggagaagcgtggcctcagcatgagcactagctccacaggtgtggctgatggctgtcagtgctttgtaaagcatgttctcttgaaaggagatctgaatatatgtgtctggctgccacagcaatccttgcttgaaataaaattttccattactgttagaaaagtcccagagaagtctcctgttggcctgtcttgagtcagtgccttagcctgtcagtggccaacaggttggtgtgcttttggcaggcttgggtcatgtgtcccttcctgaggggatgggagtcaattctcgggcttaaatcaccatatgaaagtgaaattctgttactagagaacagtaatggatgctgaacaagaaaatgtttggcttggtgtggtagtgtgtgcctctagtcccagctgcttgggaggcagaggcaggaggatcacttgagcccaggagttggagtctaacctgggcaacgtagtaagaccctgtctcagaaaagaaaaaagttctctataatggtggtttgctgcactgaattttttcttggcaggggacagtttgctgcactgaattttctctttttgtaggagacagtatagaagttgacagaatgctaaggaaaacagaatgaaaactaaaaaaaaggagaaaggcagagcctgttgtgttgcatggcaataaaaccagatgaagaatgacctgttttcaaccagacagttccttatttctacttaaaacatgactgttctatgcaaatacaggaaaatttaaaagggccattaacatagacattctccatccttttgcctagattgaatgatgtcctgtgtcttatagtgtcatttattgagcgaggtaccctttctcaaagctgtgtctgtgctaagtttgcaggaatcgaaattttgagtgattgtactatattagtgaggaaggctagtgaaaaataattacttcccttgtgatccttcatgaatccttaggagatttagctaaaaataattttttgttagaggaaacatttctaatgagttctgctgttgacagatcagtttggaaagaaaagagctctgcagttgatcagcatagtaatatatttctagtttatttgtatgctggaccctggatgacatagttcctgtgatctcagttattctggcagtagctcagctagttcatatccacagttgtggcaaaaacttttgtactgaaacaagtgaagtacagataatgtgacatccagaatgtgctattgtggtctgtttttcatctaagcatgaaataatgatattgaaaaattgtttttaattataagaggaatatataatgttagataaaataacctgtactttcactgtgaatatttattttcttttaataacttctaatatagcagtataaggtcatgttgtttggacgttctgggggtagttgctttatattcacattcatgtaattgggagtgtattacctttgggtcccactacattttaaatattgagttttactatattttattttgttttttctactggtattttatttattttattttatttatttattttgagactgagtctcactctgttgcccaggctgaagtgcagtggtgcttcacttggctcactgcaacctctgtctcctgggttcaagctattctcctgcctcagccttccaagtagctgggatgacaggtgtgggccaccgtgcctggctaatttttatatgtttagtagagatggggtttctccatgtcgggcaggccggtcttgaactcctgacctcaggtgatccacctggcttggcctccgaaagtgctaggattacaggtgtgagccaccacacctagcctatattttaaatacttttttgttttgagatggtctcactctgttgcccagactggagtgcagtgacctgatctcagctcactgcagcctcacctcctgagttcaagtgattctcctgcctcagcctcctgaggagctgggactacaggcatacaccaccacgcccggctatttttcgtatttttagtagagacagggttttaccatattggccaggctggtcttgaactcctggcctcaagtgatccgcctgcctcggccttgcaaacttttgggattacaggtgtggcccagtgcacctggcagtattttaaatacttttacattaaaaaaaaatttttcgtgagtatataggagtaggtgtatatatttatgggttacctgagatattttgatacaggcatacaatgtgtaataatcacattagggtaaatgggatgtccatcacctcaaacatttaccctttgtattataaacaatccaactatactctcagttattttaaaatgtacaattaaattattttttatgaaatcaccctgttgtgctagcaaatactaggtcttactcattcttttctatttttcgtatccattaaccattctcacttacccctacctccaccattctcactttccccctactccccactcccctacctccctatctttccctctacctcctcctgtcctacctccccactttccccctacccttcccatcctctggtaaccatccttctactctctatttctgtgagttcaattgttttaatttttaactcccacaaataagtgagaacatgcgatctttctgtgcctggcttgtttcacttaatataatgacctccagttccatctatgttgttgcaaatgactgaatctcattattttttatggccgaatagtactccattgggcatatgtaccatattttcttttcttttctttttttttgagacagagttttgcttttgttacccaggctggagtgcaatggtgcgatctcggctcactgcaacctctgcctcctgggttcaagcaattctcctgcctcagactcccaagtagctgggattacaggcatgtgccaccatgcctggctaattttgtatttttagtagagacggggttttaccatgttggtcaggctggtctcaaatgcctgacctcaggtgatctgcccaccttggcctcccaaagtgctggaattataggcgtgagccatggtacctggcctgtaccatattttctttgtccattcatcttttttttttttttaagttttattttgagacagagtttcttgtccaggttggggtgtagtggcatgatcttggctcactgcaacccccgcctcctgggttcaagtgattctcctgcctcaggctcctgagtagctgggattacaggcatctgtcaccacacccagctaatttttgtatttttagtagagacggggtttcaccatgttggtcaggctactcttgaattcctgacctcaaatgatctgcccgcctcagcctcccaaagtgttgggattacaggcgtgagccactgtggctggcagggaaagatacttgtacatgggtcaggaattgaacccgggtctcctgtgtgaaaggcgagaattctaccactgaaccaccattgcgctgacttatccgtagagcagataaacgaacagcaaccttggtcctttaaacttcatcttgaacttagaaataacaagaaaagacccttgagccccaaataactttttgacgagcatgcaaatgtaaaatacacttcagaaaggtttaaaaatcttttggacctcttatgctttataattattccttatagttgactaggatagaatacttaaagtttctattcttttatattaatgcacatacatatttttttaatttttttttttttttcaagagacagggtcttgctttgttacccaggccagagtgcagtgatatgatcatggctcactgcatctttggcttctgggctcaagtcatcctcccacctcaacctctctagtagataggactacaggggtccaccatcatgcctggctgattttctaaacttttgtggagttgaggtctcacaatgttgcccaggctggtcttgaactcctgtctttaagcaatgctcccgcctcagcctcctaacgttgtggaattacagacatgaactgccacgcctggccagcgttatgctttactccttttgataatggaagtaatacatgcccaagttaaaaaaaaattaagccatactgaaaacattttaaaaatacaaatcaactttatttccaacattcagagaaaacttaggttatcattttggagcttactttttggacttttttttgtgcttgtatttacacacaggcacatacagaattatgatgattatgttcaagatgctttgtaaccagctttttttcacttagttatatcgtagatatctttacatagcagtaatgcatagtaataccattttaaattactgcattaatgtactatatgaatgtattgtttagtcagcctcatgctttttctctttcatcattaaatgagttcatgaacatgaatattcttgtctgtacctttttcttatttcattattgtataatttaaagctacaaatgtagcagaacttgtaaaacttcagagtgaaatattgaagcccttgaggtgttggtattttttttattttattttttgttactctgggatcaagattaggaaaaatatttctctctctcaggctacgtgttttctggggctgttatctttttttttttttttttttttttttgagacggagtctcactctgttgcccaggctagagtacagtgccatgatcttggctcactgccttctctgcctcccgggttcacactgttctcctacctcagcctcctgagtagctgggactacaggcgcccgccaccatgcctggctaattttttgtatttttagtagagacggggtttcaccgtgttagccaggatggtctcaatctcctgacctcatgatctgcccgcctcagcctcacaaagagctgggattacaggcgtgagccaccgtgcccggccggggctgttatcttaatgcttacaggactttatttgtatttttatctttgtttatttttgttttttaaatttttttactttttgtgtttttttccatattggttttttcatgttcatatgtaaactgtcatagtatttcttagacatcattaatggatagaaatcttaattttaaaatggaaaagaagaatgagtctaactgcatgtgtcaacttaatttattttaaaaattacttaatgtttagctgggcctggtggctcatgcctgtaatcccggcacttcaggaggctgaggcaggccaatgaatcacttgagtctaggagttcgagaccagcttgggcaacatggcaatttacatcttttagggttataacacttacaatgtttgggaaggaaggatccttttattacttttagtttatcatgattattattaccattttatttatcatattatttataatttttttcttaaaatttttttttcctggatgctcttatagggttaaacattattatcactttaatcagacattatgttatggccacatttcacatattagagtgaaaggaaaagaggaattcagaaaagcagaagaaagtgagtcaaaatttatacgttcaaatcagtgctacctttccaagcaatatatactttgctgccactgctcaaattgtccattggatctcattttctagataatggctttagggttttatttgcatctgtgcaaagatgtgtctattcaacatgaaaacattagtgagttcagtcaatagtttggtttggggtttatgtgataccagtagttttcaattctggtggattagtttttttactttctggtggactcagcagaatcgttgtgatgagttttttggtaggttagtttgctagaaatgggttatttttgaattaatgatcactggtttgttttttttcccagtcagcagataagcagagagccctagaagaaaccaaagcctacaccacccaatccttagcaagtgttgcctatctgataaacaccttggccaacaatgtcctgcagatgctggatatccaggcatcccagctacgaaggatggaatcttcaatcaatcatatttcacaagtgagaccacaatattttcctatttgcctatgaggaacccttaataataaacacaggctatctgtaatgctggcagcttttattatgtaagttaactcacatgtacgatttggaaaatagcaacttaatattaggttgtttttagattctgtctttttgtgggatggttatcttctctgtgattttgataggaaagtaaatcgtaatgaattttattaaaactcagttgtcatggtaacataatcagccctataatgaaacttcatccattcccccgcctttttttttttttaaaacaaatttcatacttctttatcaatttaaaaagataaacttgatagattggtggcttgttcaaaaatttttttttcttttggtaggatttatgtttactgggatggtaccatacctgcaataatggaaagactagcaaaccttatgaaattatttttattatatataatttaaaaaaaagtgtattacttcatgggcttgtaaaagttttttaaaaaatgttaatctgtcttcattataaaagccatactcatgaaaacccagaaaaagaagagaaaaagtagaaaaataaaccattttaccacttcccaagcttttctctgttaatattttggtatatctccttgtaatcctttttcctgtaagtagttttttttaaatgtaactgtgggctgggcacacatctgtaatcccagcactttgggaggctgaggtgggaggatcgcttcagcccaggagttccagaccagcctgggcagcatagcaaaaccctgttctctaccaaaaatacaaaaattagccaggtttggtggtgcacgcctgttgtcccagctacttgggaggctaaggtgggaggatcatctgagcatgcggaggtctagactatattgagctgtgattatgacatgcccttcagcctgggagacagagtgaaaccctgtctccaaaaaaaaataaaaaaaagtagccaggattataatagagtcagttatagaataggtataaaattttgggttctgcttttttaacttagcgttaaggcaaacataatctcttgatgttgtaagttcttcataaacattctcagtggctgcataatgttgcgtgtatatgttgtacctttcataatcattcccatattttggggccatttaaaataatactgcagtgaaaaaccaattaagttgtaaaatgcaatttaaaaaatataaaaatgataaaggttttggtctgcctccctttttttgaatagatctttgaaatgttctattttagcactcttgtcatttgaatgattattattcaacactctttttagacctaaatgattagaactattttggaatgaaaataatttttaaatgtgcatattattattatttttaatgtcttgagagttcagggctcttttcaaatgaactaaccatctttgagagtctaaagtttagcaaatttgtataactagaccaaatatagtccagataataaaatcagatatggtatttttgaaaatttgtcagaccaatttagagagatttcttatttaatattacttaatctgaaatctgaatttgccattataagggtttcttcacattttatacaaacttctgcagacatatcatttattgcttgttatattgtgtatcttaagttaaaaaaaaattggtgcgttttaatgagtgtaaggtaaatttcagttgggaaaggcctcctgaaggaaataatcaatgggattttaaatgacgaaatagatgaattttttttttttttaagagacaaagtcttgccctgtttcccaggctggagtatagttgtacaatcatggctcactgcaacctcgaactcctgggctcaagggatcctcctgcctcagcctctcaagtagctggctgggactacaggcacgtgccatgcttggctgattttttttttttttttttttttttttttttttgtagagacagtgtcttgccatcatgctggggctggtcctgaaatcctgggctcaagcagtctcccaccttagtctcccaaggtgttgggattacaggtgtgagccagtactcctggcctgaacttggttttctgtagaaggagggaggttgacaaattgctaatgtgatatagaatttcaagatctattcttgagaatcctaaaatttttccatgtttgaagcattagcaaaggatgttaaaaagaaacgttaaaaaaaagaacaaatatagaagagaaactagtatatttgagttcctaaaaaggaggaacaagttttactaggcattaggggagagtaggagagattatgtgggtaaatgatgacaacaagcaaatagcaatgaaggataataatttattttctgtttagaattttgtagtactttggtagaaaagtgttagcaagctcaaggaggaaggtgaatactcagccaccctagattttgagtatatgtattaattcagttattcagaacattttctttaggagtatcatataaattggcgtttaattaatgtggtcaattaatgctgtcttttaaagctatcttaatggattaagtaaaaaacagaagaatggatagagattaataaactggaaattacagaggcctcagtcaaagctgtcaggaatacgtcgaaccttcttttttcagagttgagtgtctagagggcaatagttggaggggtaatagatctgcaattctcagtggctgttaagtttatacagaatataaattattatgttggataaaggatcaagtctgagaaataggctgatagaggctatatttaagaaataagagtaattttaaaaatttatgtattttctagcatttgcctcaaggattgaaattttttttttttacttgtgtttacaggtagaattctttatttaaaaagtcagttgaatatcaaaactatttgatattcttcagactggaatattattctctagtgtagaagaaaacattttctgcttacaaaacaaatagtaaatactctaaaataggggttggcaaacttttcttaaataaaaggccagatggtaactattttaggttttgtgggccatgtgttgataactattttaggttttgtgggctacgtatggtgtcattctcctattctctctctctctctctctctctctctctctctctctctctttctgtgtgtatgtgtgtgtgtgtacttttttttttttggttgggggatggggtctcatgatgttgcccagggtggtcttgaactcctggtctcaagtgatcctcccacctcagcctcccaaagtgctgggattacaggcatgagccaccatgcccagcaaagagagatgacattgcatgtaaggatagagatgtggacagatttgagagacagtttaattacgttttcttttcttttttgtgtgtgtatttttaaacaatgatttaaaaatgttaaaactattcttagcttctgggccatataaaagcaggcagcgggccacattctggcatggagccttagtttgccagcccctgctctaaaatactttttccaaatgtttgagtgttaaattttattatgatgcttgtattattatttaaaatattgtgtgtttctagagggaaccagggggttcttgagaccagatttttgtgcaacttgggcaaaaatactagattccgagagtttgtagagaagattgagttgaaggaatggagggttcagtcaggtcaaagacaagatcacacatttattggaatggcaataagcctcaagagttgtaagggtagagttgtttaggactagtagatactagttatctagggtattgagtttcttttcccattagtattcttttctctattgcctgggtaagaactttaccacctttcagcctcctagccctttcatctattttaacgaaaaagaacgctgagttggcctgaaaaagatcagggcatctaggctttaccctgactcttctgctgacttgtgtgacatttgacttctttgaacttaggttttttcatctgtaaggtaggactgtttagataatttcttaaatgttttccatcttgaattccttatttttgcgattctcacaaatgagcttgattttatttgcttccattctgttctgttggttctgctctttacctcaatctgtgtccactggtctcaaccctctattactttaatgtaactgaactgtttcccaaattactctgaattgtaatccgaggatgggaattccattgactgtactctgtatcggggagaaatacttcaacaaaacaaagtaataacccactctttctaaatgtcaaatgttttcaaaaacaagatattaattgattaggaatatatagtatcagacacttttttgtattaaaaggacaatatagtattaagtagtatactaatttttactacattcatcatatctataaggcagtattagggttggttcttaacatggattatgttatgtattttagggctggtaaattttaaagaaatttcatctctagctttgttgctgttatcctattcattctttggaaggatattattaaaacaaatgaaaatttttatcttcaaactgatagtggagttaaattaacattaaatatttcccctaaatatatacttatcagagcaaacatgtaattttactgaatacttgtacaggtacacatacctttaagtcagtatagtgtaacattattataaggatgaatgttgcttactgtgcccattattttgtgtccttttctggtaagttttttttaataaaaagtttgcaaaacacttttcaaactaaaactcttatcagtttgtaaactaaaatttttcttttttctttttatttttattttatttatttatttatttttaattgatcattcttgggtgtttctcgcagagggggagttggcagggtcataggataatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggggctaaggtcaccgatcaacaggatcccaaggcagaagaatttttcttggtacagaacaaaatgaaaagtctcccatgtctacttctttctacacagacacggcaaccatccgatttcccaatcttttccccacctttcccccctttctattccacaaaaccgccattgtcatcccggcccgttctcaatgagctgttgggtacacctcccagacggggtggtggccgggcagaggggctcctcacatcccagtaggggcggccgggcagaggcgcccctcatctcccagacggggcggctggccgggcggggggctgacccccccacctccctcccggacggggcgggtggctgggcgggggactgactcccccacctccctcccagacggggcagctggccgggcagaggggctcctcacttcccagacggggtggctgccgggcgtaggggctcctcacttctcagacggggcggctgccgggcggaggggctcctcacttctcagacggggcggttgccaggcggagggtctcctcacttctcagatggggcggccgggcagagacgctcctcacctcccagacggggtcgcggctgggcgccctcatatcccagacggggcggcggggcagaggcgctccccacatctcaggcgatgggcggctgggcagagacgctcctcacttcctagacgggatggcggccaggaagaggcgctcctcactttccagactgggcagccaggcagaggggctcctcacgtcccagacgatgggcagccacgcagagacgctcctcacttcccagatggggtggcggccgggcagaggctgcaatctcggcactttgggaggccaaggcaggcggctgggaggtggaggttgtagcgagccgagatcacgccactgcactccagcctgggcaccattgagcactgagtgaaccagactctgtctgcaatcccggcacctcgggaggccgaggctggcggatcactcgcggttaggagctggagaccagcccggccaacacagcgaaaccccgtctccaccaaaaaagtacgaaaaccagtcaggcgtggcggcgcgcgcctgtaatcgcaggcactcggcaggctgaggcaggagaatcaggcagggaggttgcagtgagccaagatggcagcagtacagtccagcttctgctcggcatcagagggagaccgtggaaagagagggagagggagaccatgggccgtggggagagggagagggagagggagcgggagagggagagggagactaaactaaaatttttctaagcgaggcccatcttttttctttgctagtaaaattagtcagtacttatccatgttcaagtttgtcatggcttagaaaaaaagattaagcaaggtcaaaaggcaacataaagaacttaagaaagtagtgctcttcccaccttcccaagggctgagtaggacttactgggccaggtgttaaattagttagcaggtaacaattaaaggagctggaaaataattatcataaaataatataaaattggaagtaattcttctcaagagctaggtattgaaaggcagtggccttaagaactcaacaagtagggtagcttttactgtctaaaaactttaggctgggtgtggtggctcatgcctgtagtcccagcactttgggaggctgaggcaggcggatcccttgaggtcaggagtttgagaccagcctagccaacatggcaaaattccatctctccaaaaaatgcaaaaattagccaggtgtggtggtgcacacttgtagtcccagctactcaggaggctgaggcgggagtatcacttgagcccaggtggtcgaggctgcagtgagccatgttcatgccactggattcaagcatgggcaacagagtgagacactgtctcaacaacccaaaacacaaaaactttatatagatagccttgcttaagaatttctaattttggccaggctccgtggctcacgcctgtaatcccagcactttgagaggctaagggtggccggatcacctgaggtcaggagtttgagaccagcctggccaacatagtgaaaccctgtcgctactaaaaatacaaaaattagctgggtgtggtagtgggcacctgtaatcccagctactctggaggctgaggtaggagaattgcttgaacctgggagcggaggttgcagtgagctgagatcgtgccactgcattccagcctgggtggcaaagcgagactctgtctcaaaaaaaaaaaaaaaaaaaaaggaatttccaattttaattaaggagatacactgaaggttatcaatacgtaattatgcatagaaagtagactttttatacttcccaattaatttcctatgtagtttttatatcactttatataaaaaaactgaaaattactctgttagtaactaatttgttttatgaatgatacataatttgaagcataattgtaatttaaatgtttatttgaaacattagcttactaataaaaaaaattgagacatatttaaaaacacccaatttagttgggttaatccactgtaactgtttgattgcagatgttttcccacactgatgggcagctaactgaggtagtgctatccagtacagtcaactttcaattatctgtggtaatgggaaatgacaatgcatggataatcctaaaacaaaatattttatacagtaccttcctgtcatctgctgtggcctgagcatgtgcttgggttcatgagggagatgtgggagtggggctcaggcttgcaaaggagctgggagtcagtatgattatctcaaggccataagaggtatccttaaggaacctgggtttggcactgtgtggctgaagtgtcatggggaaagcctgcagcatgcaagatcagcttggcaatatcagtgagaaggatggggaagctaattaataaggaactgtgggagaatagttgtttattaagtcctatacaattgcagtgatatatcttggtgtgttttttggttaatgggatctgtagcaaacaataattatattaattgtgtatttgaattagttttggtcatctttgattgctagcagaacacattttttacttgccacaggtgagtgctgttattgaggtctcttctaaataagtaggtttattgtcatataactagtaacttaaaaaacccagaataaatttgaaatacttttcttacttttaaaattcatcctaaatatcagtgttgaacttgtacttccaaaatttaacttaatgaaatttaacattgtaatgtcaaagaatatcatgagggcaaatgccataattactgatactgtgaatttgatgtaggaaaaatatagtagccatattttatttaagaatatgttacaggagctttcctaaatttcttttacaactgacaattgtctacgaatttatgaatgttaaagctgcatgatagatgtgaggagggagtgtttattattctatctaatttgaatatgcttattttctacaagtgaaagctataaaaaaattgaagcagatgattgctgaaaaccttagaatcttctggaccaacctgagaatcttctgcttgtttatgaaatagatttagtgctctctgtcaaattattcaaactccaaatagaaccgtagccattttctaaaggcatgttttcttctgcccacaggcaatactgcagttcaaccccgtgtggtagtatgatggcaagaatgcaaattataccgttgttagattacctttattattatagatgttttttaaaagttatttacttaaaatatctatacttaggcaaattagaggcgttgatcttgagtcgacttttgtgaccaaatttggaaacaattgcagtttgagattgaatgaggtaagggaccagctaattagtccttcctctatagatctttggttctcaaccagggaagttttgcccccaaggggacatttggcaatgttagacatttttggttgtcacatctcatggtgggggagtgctacagttatctacctggatgcttttctatattctgcaatcctcaagacagcagccttcacccctgcccacaacaaagaattatcaagcccaaaatgtcaatagtgccactgttgagttaccctgcccctagtgtttctaagatgtaggcattctttgaagtagacaattaaaaacatcatatagccaaactaaattattttgactttctgtatacttatgctgtttaaaaaacatgccttcagtttttactgagatttgatataaaaagcaacaacaaatatatttttaaagaatttaatcctgggaaacatttcactttcctgatgaattgatatatttcctcgtaactcattatgtttctattttgccttctctccctggaggcttagtgccaatttttttgctctattataacaatgaccctttattttaggcttattgttatctttctatttactgtattggtcttccctttttttttttttttttttactgttatggtctatgggtttgggctaagtgtgtgtttgtgtgtatatgaagagaacatgtgggtaatatgtaaatgtccccaatccctagaccaagtcacatctctataagatcaaatgaacagatttctaatttatattttaatgcttttttaaagtctcaatttttcaaacaagaaatatgtgcttgttataaaatattactgtgtgttagtgtaaataataagtggaagattacttctccctgttcattctctggagatttattaatatttctagtatgtgccaggcatagtggctcatgcctataatcccagcactttgggagactgaggcaggagcattgtttgaggtcaggagttcaagaccatcctgggcaacacagtgacatcccatctctacaaaaaataaaattagctgggcatggtggtacatgcctgtagtcctagctactcaggaggctgaggtaagaggatgcttgagcctaggagttcaagactacagtatgctatgattgtcccattgcactccagcctctgtgacagagtgagaacctgttgcaaaaaaatgtatatttatagtatgcagatgtgaaatagaagctataagcttgtaattctgttatggctgctcaggtttacactcttatagtttcatttctgaataagttaagtacatttctaaaaactgaggagaataaaaacaatgtcttgaggattgtgttatctgatgaaccttttattgatctgacgaagacccattttataaaaaaagtgtcatattttattttttgaagcatacttgatggtatgaaatggtatttctagcccatacttttaatgatttagaatgactcactaaactttattcaaggccagtacattggcttactcctgtaatcccagcactttgggaggccaaggtgggtggatcacttgagcttaggagttcaagacctgcctgggcaacatggaaaaaccccaactctacagacagtagagaaattaggccagcatggtggaacacgcctgtagtcccagctccttaggaagctcaggcgggagaatcatttcagcctgagaggtcgaggatgcagtgagccatgatcgggccagtccactccagcctgggcgacagagtgagatactgtctcataaaaataaaatttaatccaaatgtgattaatttccatttctctaaagttaaaaattaagtgaattccaatatcatcactaatatgcaagcttaacttttctgttacagttttcccaagcagttgaagaggaaagctattctcataattagcctaacatgcgtagaaaagtttagagattattttttttctttttctttttcttttcttttcttttttttttttaagatggagtctcgctctgttgcccaggctggagtgcagtggcacaatctcggctcattgcaagctctgcctcctgggttcacgccattctcctgcctcagccccccaagtagctgggactacaggcacccgccaccatgcccggctaatttttgtatttttagtagagacggggtttcaccgtgttagccaggatggtctcgatctccggactttgtgatccgcccaccttggcctcccaaagtgctgggattataggcgtgagccaccatgcctggctgagattgtttttttcttgaatacttaaaattgtaagattactaccatggttagttttttatttgatgttccatttatacattcgttagctctggaacatatagatcctgttgtttttaaggtctcttggttgtagagaaataagaggctttgaatttgtttcaggcttacctcatacttgaggcagtttagaaggataaatgatcagtgttcagatttcttaaagcagtattttataatgtcatgatgattatcttttcactgttactaccaggttcttttagaaaggggaaattgaagtaggacattgaagtgggactggggaggagttagcaaaaaatgtgtctgttgattgctgcttgagccaggaattggtggtaagagatgtgaaccattttagtgaagtgatttttcaaactcttttgactgcgacacacaggaaaaaattttttttacgttgtattcagcacataattcatgtatatatttatatatataataaacagacttttcaagaaacagtattttaccttactatgtgtacatgcagtctgatgtttctgttctatttgatttgaaataattgctgcttacataccactaaattgcagcttgcagtttaaaaaattttgctttagtgtactaattacctgtgtatgtggagaaattcaccctctgttagcaaatagaagattgtaattacaatacattcttactcgtatgtcttatgtgagcatttaataaatataaataaattaatgaaatattttacaggcattttgtcatgataaaatataagcagctttgcccaagcaacttggtcttttggggtcaaaaaatggcttttttgttttttgacacagggtcttgctctgtcacccaggctagagtgcagtggtgcattcatggctcactgcagctttgacctcctggactcaagcagttctcttatttcagcctctcagttagctgggattacaggcatgtgctgtcatacccagctactttttgtagagacggggtttcgccatgttgcccaggctggtcatgaactcctgggatcaagcaatctgcccaccttggcctcccaaagtgcttggattacgggcctgagccactgtgcctggctttatttttaacattatatttcagccctctttctttttaaataaaaagatgtttaaacatgaatagaaattatactaataggtcattagaaatgtaactagattaatttcgggggctttcttaatcactatattagtctaaatcttaatggagagggaaaaattagcatgctttaacccaggggttggcaaaccttttctgtaaaggagccagctaatatatacttcagtttttgtgggccataccatctctgttgtggctcatctctgccattacagtgtaaagcctagacagataagcaagtgagcggcatggctgtattccaataaaactttacttatggaaaagcaaatttgaattttatataattttcacgtgaaggttttttttggttgttcttttctccaaacattaaaaaatgtaaacaccactcttagcttgtgggctgtaaaaatcagatgatgggccagatttggcctgtgggccatggtttaccagcccttgctttaacctaaaaatggagaaaatcagtagtccagaagaataaaaatttagcaagcatagtttagaatatgagtagcaatattaaatctctaggcatatatattttgatttttgtggatattagaactatacatttttgtgttgttttttacattatattttgcagacagttgatattcataaagagaaagttgcaagaagagaaattggtattttgactaccaataaaaacacttcaaggacacataagattattgctccagccaaccttgaacgaccagttcgttatattagaaaacctattgactatacaattctagatgatattggacatggagtaaaggtaggtataatttttttcaagcttttaaaagtagtaacccataatgaaaccaactcttgagaaaattaagctttttatctgtctttctttcctagaggacaaagtcttggcccagttgtggttgtgaagattccttgctactataactgttttaccctttttgctttttcttagtgatgtattctcaagttttaaacagtcatctttgaatgaattatatttgcttggttatgataatacctcctatggtttgagtaaataagtgtcgtgtaatctttccaattttaatttaatatgactgattaaaaaatcattcatcatgttattatgaaagtgtttaccttatctcaagtatttatcagcagacttttggcattagttttcaaaaacaagatatattaatagacatgtactttgaatttttctaaaataattttatcccaacattttgggcaagaatagtgttaggtaaaagtgataggtgaattaatattgccactgcttttgagtgtgtagctattacatattttggctgtcttttaagatgtatttgggtgcctagaacatgcaaatttcatttaaattggtgtttgaacttaatgattcagagctttagctgagtattaatttatgtctgatcagtagtttgaaagacagtgacttatcagatgtgactaaataaatatacatgcttataatgatactgtacagttcatgtagttgattttttttctaatataaacatacttaaaaaacactgttatggatggaaatcagttaaatctaaatttaatggagatctaggtaaaaagaaaatatacactgtaaatttatttttaaaatctctttgtcttcagggttttgatgcaagcactattatctggaatatgatatttaatttaacttttttgagacagggtctcactctgtcacctaggctggagtgcagtggcacaatcatagctcgctccaaccttgtactcctgggctcaggtgatcttcccttgtcagcttccctgggactacaggcacgtgccaccatgctgagctaaattttttgtttgtagtgacagggcctgtctgtgttgcccagggtggtcatgaactcctgtacttaagtgatcttcccaccttggtctcccaaaatattgggattacaggtgtaagccatcgtgcctgcccaatatttaattttatagccaatacctacatgcatttagattactaataagagcatgttaaaataagatgtgtaattggatggttagttaataactgaaatttcttctaacttgggaaaatttattcaaggctaacaactgctaatggaatattttagaatacctctagaatctaatgccaaaaagacacttagaatataaaagatgacatttgtgtttgcccaattacataagaaaaaagtaatcccatttttttaaaatatataattcataggtttacatcccccattcttataatcctcaaagtaaaatgtttttctttcaggattctagccccttcattttttgactttcagtgtttaagggtcattaatttgaagaaatctttaatacagttaaattgtggaataaaacagtatcttaaattcatcagagaaacttctgttcatgacacattctgctttaaccactctttctatgatctactgaaacattattttgttaatgctgaatgcttaacttgttttttctttttttcctttctcttcacatcctgaagtttcaactaacctttcaatgctttttttccttacctcttttatttgctccatttatgcattaagtggttgcttagatttaaggtaagagattccagggctggatttccattctttgttcttatgtagaatattacatatggggagttaaagagattgttaactcttggccttttaaaacccaataaataattcctcctttttgttttattttttgtcatgcaactttgtggtgtgtcttcatgttccttgagggcagatatttttgtctgttttgttcactgctctatccttgtgcctagaacagtacctgacacacattaggtgcttagtaaatatttgttgaatgaatggttattttgtaatgttaatatattttgtgaaactgaaatgtaagctaccctatcataaaaatgttatgaaatataattagctggatttttataaatatagagactttgttatgaattggagggccaattaatgtactttatttaaccctccccctgtgtaatagcctttttattctataaatggtatgctttctgatataccttatggacaatatgtcattatcttttaatcagtataaagaaattgagaagcagaaaatattcagtgacacgggttttttttttaagttgcagtatcatattttgtagaaaaattattcttttttccaaatagctgtataaagaatatatttcaatataaactgtaagagcttttaaaggtgaatataattatatgcaaaacatcaaaagctcatgataatgtttaacagaatatcagttaagaattagagatatttcctgttagaattcgtttcaataatgttttggtatcgtggaggattcgtgataaaagaaattcaactatattcaagaagcctgcctaaaatacaaggttactacaattatatacaaaacttagcatgcatttcttctttgatttttttttgtaggtgagttttatagtttattttcaaatatatattcctcccatctaatacccattatttgccatatctttagtgtagaaagtgatgacaagatgactgagctctgaatcattaactagtactaactaaggccacacaactttcccctgcccgtggtaggtagatttgattggaagagcccaggcatatggacacctgtattattgattggattgttggttccaaatcctcagtcatggtgagtaagatgtggaattgtgaagaaatccttttgcttgaaataggtgggttgcagtgaactagaccaaaagcagactgtggctgctttggcccttttaccctaaagtctgtattcaaattttgaccattgatgtgttaacctccaaagtgatagaaatacacggaaagtttaattgaagaaaaaatacagaaacacacagattctttacccttaaagtttagactagcttgcccaagctactatctcatgcttgttttctctaagccccagtatgattccttcttgatgttcctgcgtcaggatctgtttccattgtgagagacaggccaaacagagtctcctagaaagatctaatgaagaatcacacttagataagatccctgagctttttggagacctgtggattctagcaagtgtcttagaagtctcctgatgagcaatagcattatggattccttatcctcattttaatcagggtagctgattaaatgttcaaaatttaaaacctatttaagacctagtcgtttttctttctacttctctttttctctttctcagcactttttgagctctgtctttgctgctcccattgctgtcatactttttatacttttcagacagtctccagagaaagtcatcatactttaggaccagacatgtgggatttgactcagaagagacctccttgtttaaaagtttaacttttactattttatacagcatgtttgatgcttaattgttcttgacatctgaaatttggattaactgtttttcttcagtcaagttacaaatttaagagttcataagatttttaaaaacactatggtaatagttttatagcaaaggacgtacaaggtcagtggatagaatgccatattggaggtgttttcatatatacctaaggccatataaaagtggaatgtaccttgaactggttcctgttccatactcttgtttttgtttttgttttttttttttttttttttttttttttttttttgagacagggtctcactctgtcacccaggctggagtgcactggtgtgatcatgactcactgcagctttgactgccctgactcaagtggttctcctgcctcagcttcctgagtagttggtactacatgtgtgcaccaccatgcctggctattttttaacaaattttttgtagagatggggtctcactgtgttggcctggctggtctcgaactcctgtgctcaagccatcctctcacctcggcctcccaaaatgttgggattacagttgtgagccaccgtgcctggccagtactcttttagtagtaaaaagaattttaagaccctgttactgaggtcagtatgatgtgtttgtaatgaatttttctgttgaatgcattaaaattgtcactaatgaagctaaacttaagtatttttaaaataagcatattagtttaatcaaaagtaataaaaacttctgacttttaatgtattatttcagttgaacatcgcccaagcagattcttttttttttttctttttttcttttttttgagaccgagtcttgctccgtcacccaggctggagtgcagtggcacgatcttggctcactgcaacctccgcctcccgggttcaggcgattctccagcctcagcctccctagtagctgggattgcaggtgcctgccaccacgcctggctaatttgtgtacttttagtagagacagggtttcgccatgttggccaggttggtctcaaactcctgaccttgtgatccacccgcctcggcctcccaaagtgttgggattacaggtgtgagccaccgcacccggctcagattctttttttttttttgagacagtcttgccgttgcccaggctggagtgcagtggtgccatcttggctcactgcaggctccacctcccaggtttcacgccattctcctgcctcaacctcctgagtagctgggactacaggcgcccgccacctcgcccagctaattttttgtatttttagtagagacggggtttcaccgtgttagccaggatggtctcgatctcctgatctcgtgatctgcccgcctcggcctcccaaagtgctgggattacaggcgtgagccaccgtgcccggccagattcttaataattaatgagcagggcttaagagttttacagccagcaaattaagaatataatacttttaaaaattttgcttaagatcttgaagatccatcatttagccccatgtttaaaaaatggactgttttcacttgagtactatttttagcaagtatttgtcattccttacagaaatatgataaattccccttatatttctagctttcaggtacagttgaaggtacactcttaaaaatttatccgacacagcacctggaggaaaacctttgtagtaacatcaacctttgagagacccatctgtttttgcctataagttccaaccttaagccatcaattctgttttgacaaaagccagttgttagaatctgttttcaaaatcaagcaggagtttgtccatctttatttctcttgttttcttctgctttctttacctgtttctctttcctcttactcctaatcttatgttcccttattctctgtgttttattgttggactcttgactcgataggcttttttgtcttttaaccctttttctaaaaatcttaacctctgtcctgaatttatactctaattcctggtttcagctttgattttcctcagaggatcttttggtccttttcctggtgtcccttaggaattgaagtaggaacatacatcctctgaagagagggatagaggtctctagaaagccaaataattatgtactagatgggactataatggggaacaaaactggacagagaatgaaggcccaaaggtgactgacctcacttttttcccatcctcactatttcacatacagacacaacctacacacacttcccctcttctatttgtgtgtttaaattctcttttcttttttttaaagagatggggtcttgctctgttgctcaggccagagttcagtggcatgatagctcactgtatccttgggctcaaatgatcctcctgcctcggcctctcaagtagcgggactacagccactcctggctgttttttttttttttttttttttttttggagagacgtggtcttgctgtgttgcccagtctggaatcctgttcttttaaaacttaacaagtttaagaaattattagggaagtttcatagagaaaaaccagctcaggtttttctctatgaaacattccgtaaccttcccacattgatatttctttttttttctatagaatctgtagacattgctttttttttttttttttccacgtggagtctcactctgtcacccaaggtggagtgcagtggcgctatggctcactgcaacccccgcctcctgggttcaagtgattctcccttcctcagacttccaagcagctgggattacaggcatctgccaccatgcccggctaatttttgtatttttagtagagacagggttttgccatgttggccaggctggtctctgaactcctggcctcaggcgatctgcccaccctggcctcccagagtgctgggattacaggcatgagccaccatgcccagccagacattgctttttattttaggcatgtgagtcttatttatttcagaatacctttaaagcagagaaatcattctatagaccgttttgtctccttttttttccccgcaggctcccttccttttttttttttttttttttccccacatgcctttactcttgtacctagagggtctagtaggagattaatatataaggtgtataccacacataacattttaggatgtgtctgccactgttctgtggtagtaggtcatctgttaatgggagatttcatagcagaggtgatgtcttctatgaattagagatacttggctgtccaggcatgatatttgtaatgaatattatatcagtattcaaggaagtattgaatgtaccaaagaaggtagagcaggataggtaggagcattgtagaaaaagtattaagtcacaataattggcttaatgtgtggtgccagttgtagtgatctccaaagcctggtcataaaggaactgcttctacctccggtggtatttgcattccttcatcatagcctattgggaaagtgtttgagctgtggccatgcattaaccttcatcacctaaatgaaatatttcttctgttttggaggtttctgtctggtagggaaaaagtggggacttttccaacttttctttcttgtacctaatacctgcttcacttagctcttgaggtcttttcattttatggaataaaaaaatacataacaaaattatgattggtatcggccaccagagtattgttctaatttcctaaactgctgtgtgtgcctgatgatagttctgctatgtttgtaactttaaaaagtatttcaagtgaaattactattatgaagtggctgcagtattgctttgttttccttgtcttgagtttatggtatatgttctgtctctctctctgtcgctgtcgttaagttcctctccatcagcacatagagatctcatgttttgctacttgtcaggaaatgttttctctcttaaatacttccctcaaaatagtttttttaggatcaatcatgatggctgtctagtaaatatatttttatatttaccagattattttagttctgaaatatagtttaactttaattataatatagattttacctattataaaaattgttttgtttggcatttatttctgttcttccttttcttcaaatttgatggcagtatttatattctgcatagcatatttattgttttacttagcgtagaaacatttttcacacgggaaaagctgccttgaggaaatattgaaaaactcttttaatagaaaggtaatgaaatattaggtataaaattagattgtttggacattctacagagactcttgtttcttaagtgacttatgttagtcatccaatcccattaaccaaacaaatatacagtcatttgatgattctacagatcataaaatgtaccaagttatattcatagaaatgttggccaggcatggtggctcatgcctgtaatcccagcgctttgggaggccaaggtgggtggatcacctgaggtcaggagttcgagactagcctggccaacatgacgaaaccccatctctactaaaaatacaaaaagtagctgggcgtggtggtgcgcctgtaatcccagctactcgggaggctgagtcaggagaattgcttgaacccaggaggtggaggttgtagtgagccgagatcaggccattgcactccagcctgggtgacagagcgagactctgtcttaaaaaataataataataataataaatgtccaccagattttaatatatagattgtttattttatgctattttttttggtggggggcgggtaggtccaaagacttacagaagatactgcaatttaaacaaaaacaccttgcataccaaaacttaaaacaaatataagctggaaagctcttttcaaatattttagctatcccatgtatagaataaaattctctcttaaattcctgctccttttccttcctgtttctcagcaaattgatgtagttttagtgtttggttcacttctccctcatcacttaaagtaactttgggttttatgttgtttaaggttgagcttaaaggactttggttaccactttaaaaaaatcttctggtttcagaaattaagatatgcagttttaaaagctattcattatttgtcatattactcctaaaattttccccaaatgtggattgatttttttaaaaaaactttttctggcattttcattttaagatacaagtagtataccctccgcttattaatgagagggagagcaaggataagttaatctttactcttacttgataatgtttgtttttattgtttaaaagcaacaacaaaaggattacagataaatgcttcactttaaaatattgacatttcaaaggtatcatttgtcattaaagattgttttaacatcacacacaacttgttcactgggctattcatttgaagaatttgtttcttgagatagtatttcttgcctattcaaataacaggtagtattttaggattttaaaaaattccacttaagccagggttggttttgatagcctcacttctctgtatacaattatgatttgctttcttaaaatttatattctgaagttacagttataaatgtattctgatttcaatggtatgatgtcttgcaattttatttagaaagtataatttgactactctagccatattatttttagaaaagttgaggtcctttttcaaaatatgttttgaagatggaaattcaaaatattagggtcttaaaatagaatcacatatgaacctgtgtggtgaacattaacccattggtagtctcaacttgagactgcatttgaactacacttgtgagtgatttttcttagctttttgagatagccagggctttctgtataagtgctaacatactcctttggtgacctccattattcccagattatgcatctttcctacacttgcattttcagttggggatagaatagtgagtggagttacggtccagctctgacttaggactatgttacatctttctcatgcctgaattcaccttcagtttgggcccaagtgggtccaattcccattggaactaggacattgcctgtggcccttgtgctgctcccagttgaatgggatacctcagccctaactttctggttcagatgtttaggaacatggcttgaacttctagcagttttcaggtaggtggttccctcataagaagatactaactaaatctgacttataaggctggcccacaatttaaaaaactaaaattttctgtatatattacatgatttatctttatattctctagttacagtggatcatatgcatagttgcatatttttatttgggaaatgtattttgcttatgatatgcttactatctaaagaaagttactggccgggtgcagtggctcacgcctgtaatcctagcactttgggaggccgaggctggtggattgcctaagctcaggagtttgagatcagcctgggcaacacggtgaaaccctgtctctactaaaatacaaaaaattagctggtcgtggtggcatgcacctgtagtaccagctacttgggaggctgaggcaggagaattgcttgaacctgggaggcagaggttgcagtgtgccaagatcgtgcccctgcactccagcctgggtaacaaagcgagactctgtctcagaaaaaaaaaaagaaagttatctctaaaaataaggaattgcttaaaagcattattgtttttgattgagttactctttattaaaactaaaattttgtagttattctatttaattttaattgaatgtaatatcaaataatctaaccagtgatctgttggtgtgatggcctaatggcaaataaagtctttgcatacaagtttataatgatttgaaaatctcatgttaggaagagtcctttgagtacaactgtagagtaatagtagagtagagattgcatatgaaatgcatggcctctaatttttttccctttatttaaaccttcccctcctttgttatgtagtgtagcatattatttcccaaaagtgccactttatttcactgcatacaagttgagttttccttaaaattttttaggtgagtacccagaacatgaagatgggtgggctgccgcgtacaacacctccaactcagaagccccctagtccccctatgtcagggaaagggacacttgggtgagtatataagtagtaattgaaaaccatttcatgtagtattgtttaaaaatgaagcacaacatatttaaattattttttgaatatttgaagagagaacattttctttgtaggattgttgtttgtgtgtataacttcctcttctcttgggaaacacatttttatacttcagaaagatttgtttagaaattgtttttctagtgaattttaaatttgaggtaaaatcctagcccaagttcatagtttattgtaaattgcagtctaattttaattccttttctttcagaaaatgtatatagtcttttatattacagtttaactccaactatcctttttaagctgtgtagattataaaattctataaaacttataagaatattgagcttcaggccaggtgtgttggctcatgcctgtaattcccaaagtggggattttgagagaccaaagcgggcagatcacttgagcccaggagtttaagaccagcctgggcaacatggtgaaaccctgtctctacgaaaaatacaaaaataagctgggtgtggtggcatgcacctgtagtcccagctacttgcgaggctgagacaggaggatcacctgagcccaggaggttgaggctgcagtgagccgtgatcatgccactgtgctgcagcctcagtggcagagtgagcccctgtctcaaaaaaaaaaaaaaaaaagaagaatatggagctttattttggtcctagagttgggctctagatttgacttttggcaaaaatggccaattaatggaaaagcttgacttttttcttctagagcatcgtattataaacttgacttactgtgattgagatttacgattaggttggcattagtatagcccagaagccaggtgattaaaattctgtttcagctgtgctgttactttataattcctacatagtcagctgccaagaattcagttttttcatctgtaaaaggggggtaatatttgtcctctataaatttttcaaggtcactgtaccacaaattggatttttaaaaatgtgtaagacaaagacaaaatgttttgacaaccattggctttatgatatatgctaaacaagtttttaattgacagtcttgtttttggcttcctcagcaccaccaccatcaccaccaccaccaccaccaccaccaccaccaccaccaccaacaacaacaacaacaacaacaacaacaaaacaaccacaaaccttcaaaaaaccgaaacccaatcaagcactgaatcaggataggaccaaatgatttgagatgtagtggaggatagtgctggaagagagataataggacagtaggagaccaaagaataaaaataaattccaaccaggaataggatgactttattaggagtggacaaaataattctgcttagagagagagaaaatctagtggatcaaacaagatttaaacttcaaggtagaatgtagatggcatagtagtgtataatggtgccaggggtcggggtagagagatgaagaggaactctgtttttattttcctatgtaaacatttacatttatatcatgtgtagtgccttatggattttgttgggttttaagtcaagattgttagtaagataagctacttagtccccagaaagtccctagaagaatgaaactttgtgttgttttcaagttttgaagatttgctcatataccaatgtttgttttccttgtatattagcaatggttctgcaagatccttggggaccagagttgctgaggcccactctgctagttgatggctataacctgtttttccacatagtctttgcctagtcaccacattttgttcctttgctccttttttttttaaaaaaaatcttatttgtgtcattgccttcactctgtagttctcaattatcaaataatttttacttggatgcaacagaacttatttttttgagacagagtctcactggagtgcggttgtacaatattggctcactgcaacctctgccttctgtgcccaggcaattctcttgcctccaggcgattctcctgcttcagcctcctgagtagctgggattacaggtgtgcgccaccattcccagctaatttttgtatttttagtagagatggggttttgccatgttggccaggctggtctcaaactcctgagctcaagtgctctgcctgccccggcctcccgaagtgctgggattacaggcatgagccactgcacccggctgcaacaaaacatttttattgcctgggaaaaattgtctgaaaattagatgttggagaaattaatgtttcccattttattgtttaatatttgcattataatttaagagatgctggaacttccttttagtattttaaatccaaagtcctgacattactttttcctcttttgacccaagatttcatccagtgtcccttattttatttttaattaccaatgtatgtatttatgtaaggagactttgaagggtagtagagtaaattgcaaagtgatctcatgcaaaatcagtgatccataacttgagtgccccaggaaagcaatagttaaaggaactctgggatccatacataagtcagtagagcaacatcatttcaggaaaagaaaggtttttaattttcacatcttgatcagttcttattcttttagtgaccaagatctcatctacaatatgtcaattgactgtttatcattgtcataaagaatttggaaacctaagtagaaatgagaactaatttaataaacactaatttccccatgtgcatcctgttccctgtcatatttcctttcttcctcttttcatcctctttacgaggaaattttgggaaaaggcgggaaatatgtgttaataaaatccagtctggtttgtattttacagttcaaagtaaataatatagaaaggctgttgtggtggtcattcccttccccccacctttgtaaatgttgaactctgaggaaggaaagagaaaagagatcaaggtgaaagttgagggagaaagtgagaacggaagatgagattaaagtgtgtatttttgtatatagatatactttaatttctgtatatttggtatatagaaagggaaatgagttgttatggctagtattgatcatcagtgtgggggttatagatcctaaatctagatttgtagttcctgtctttgaatatctttggttagggagagaagggagaggagaataattagtgcattcatgaagtacagttgggagactttaatatgatactaaaagaattccaactcttctaagaagaggtagggtctgggaaacattggcttaaatggtagagaacctttgtgctctttgagaataaatgaacaaaattgcattagcacagggaaatgaggttggagactgaaaaataacaatattcaccaaaaccctaatggtggagaagtgatacattagtaaagactgaaattggtagctgggttatgttaaaacacatttcctatctctgattacaaattgtatctcaactgctggcaactctttgaatttattgtgccgaaacttgcttaatcatacaatacatacgctcttctttttgtaggcggcactccccctatcgcacactggagccagtgcgtcctccagtggtaccaaatgattacgtacctagcccaacccgtaatatggctccctcgcagcagagccctgtgaggacagcttctgtgaatcaaagaaatcgaacttacaggtattttctctacctcagtgcaaaatgtgatggtcatagtaccataatctgttcagattacttcaggtaaatctctcattttccaagcactaagttcttttcctcactctattctcccaaacctcatctgatttcacctctctctcctcatgttctgattcaactttgagcagtcaggaagttgataaagaacagacatctcaaagtgcagacttctctccaagttttaagagttcagttgatctggaaaaaaaattatggaccaaatgtgggaaatgtcaggttgttttttggtggaactttacagatgaaaaactatacataataaaacattaatatgggatagtacatcagagtatgattattaattaaaattactcaaatctgtttaggaaaatgtttttgttttattataaaagaagtttcttcagataggcattaaactggaatataaaaaggcaatatttattgttttaatgtgttaaacctcaacatttatcacttgtatttatggataattttttcaaaatgtggtcaaaacaagcttattgaactcagttttcccctcaactttattaataagtaaatatatatatatatatacacacacacacacacacacacacacacacacacacatttttttttaacctgtcactgacttggagctcaaggaaattttattttgaagtggtacgcttttgaattacctttattgtagctacattcatctcagaaaatgtcgggaagtgctgatgatctcttactgtttataaatactcatgttttggtggctcttatttctttagcagcagtgggagtagtggagggagccacccaagtagtcggagcagcagtcgagagaacagtggaagtggtagtgtgggggttcctattgctgttcctactccatctcctcccagtgtctttccaggtaaaacattcatggtgcctcgtcttcacttttcctttctgaatttgattcaatttgtgatttaattatggtgggctttcttcgtaatcaggattttttttctttaggaatcataaatattgggaagtctatatatttgttatttgtaagcaagtgatttgtaagtgtttgctcactttgcacttctctttatgcctttggtgatgtggctcagttgctgctttgaggtttcagatcacactttgttatgagtacaagtttaattccagctagtgttatgacagtgcagtctttggacacagtgggaactcagtgtgagaaccatattagtaacaaaggattgggcagatataaaaagtagttttgacagttaaatttagtggctgtattggaatttagtagtctctgaaaatactaccctcttttctctgaaacagaaaaatctgcttatttgattcgaggagatacacacttaaaacttagttttgaaaacgtgacacaaaatacattaatagaatgttacatacttaatttacttatagtaacaagtagataatgccttttaaaaatcataaagatttgtgttttaaaaaaaatttttaatctgataatatggaatatgtctattttctgatttgtgtaattcaaaatggaaaactgttgttttttagtgtattatgttagttttgtatactatatacagaatgttatgctaaaaataacaatacgaagggaacacttttcttctggagtagtgctttcaattgaaaaggaatgtttgtttttaatgaattgaaaaaatctgcacattaccctgagcatcttgaattatttgctgcttatatagtaatcctttagcataagttttattctttttttcaactctgttcttttggttagtgttaagcactgaatatctaacattaaatactctaataccttttctaatcctgcctcatgtgattgcctcattaatgctgcctcttactcctctttcccctcagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtaagtatttgcttattcattggcaggcagatgcagtcatctggctattctcttacttgcacctctgatttttgtttgtttttggttttgttgtacttcgtattaaaaaaaaataagaataatgtactaaccagaaagtatgtgaccaaagattagcatttcctgagaaaattgaggtaaagtttctcatacatttttccaatagggtagcataaatttgtgtttttttattgcttgaatttcatttattagagatttttaagtttaatatggagctaccttctatacagtttttggaaattatcattagaaatattttcattataggttaagtgattaacaaaagtctattacaataattctaaggtatattttataggaaatatttgatacaacaaatggaaagcctctgtaagtctatttttaacagaatctgttgcttattatagcagcattggaaactcatagacaatggacttttaaagaatttcaggtttatttaagttggctggtgttttaaaattgcaatctaaaatctgttttgattggggaggagatagactcaattgctacgaaatatatttgtagagttaatgatgctggctagtaacaggttcttgtctgctataaaatgtatgtgtttggacatatatcactgtattagtctgttctcacattgctataaatacctgagactgggtaatttatgcagaaaagaggtttaattggctaacggttcttcaggctgtacaggaagcatgatagtggcatctgcttggcttctggggaggcctcaggaaacttacactcatggcctaaggcagaggggaagcacactggtcacgtggccagagtaggagcaagaggacaaggcgggaggtgctacacacttttaaacaaccagatctcattattgcaagaacagctccaagggggatggtgttaaaccatgagaaaccgcccttgtgatccagtcacctccccctaggccccacctccaacattggggattacaattcaacatgagatttgggcagggacacagattcaaagcatatcaatcaccgtagtgttccacttgccagtgaagaacttcatggcatttatattcagctttgctgttatacatgttaaacatatataagatctttacatgttttaaaagacacttttagccaaaatggattttgggtgatgtcttgtgggattccttctatatgacttttaaagaaaagctttctgcagtagataaatgtaaacatggggtgttttttgatccagatacaactgttaggccaaactaactagttaaatataggaatctcgttatgctcctgctttgataaagaatgcatcagaaaggacaaatcacccccaactgagagtctatgttttagtaattaaatattaattgaataacaggtgcctggctcagtgttcactaaataaacatttgttatgtgaggggataattaactgtggtttttaaaacaaaaagcaaggtaaatgtcttattaataatttatatcaggatagtctgttttatacagtacctgagttaccaagcaattgtttttctttttaccaaggtataacttatgtacagtaaaattcaccctttataccatatatgtttgtgagttttggcaaaggtgtactgacatgtaattgccaccacaatcaagttacagaacagtcctatcatcgcaaaaatttcctccatgccccctttatagtcagtccttcccttccactcccagctcctggtaagcccttgatgtgttttttttctctaaagttgtgcctttttaagtataacataaatgaaagcatatagtatgtagcttttttgatctgttttttttggccagatgcatttgagaattacccatgttgttgcatgtttaagtatttcattacattttattgcttagtagtgttgtattgtatggggatgtaccacaatttgtttatccctttctcagaggacatttagatttttctagttttgagtgcttatgaataaagttgctataaacatgtacatacagggttttttttgtgcacatgggtttttatatcaggtaaatacctagggaatagaattgctgggttatattgtaagtaaatttttaacgtcataagaaactgccaagttgttttccaaaatggctgtataattttacactcccagcagcaatgtgtgagtttccagttgcatccttgtcagcccttggtgttgccttttttagctttagccattccaatacatgtgtaatggtttctcattacatgtgtggtttggatttgcattttcttaatgactaatgatattgaacatttttttcatgtgcttatttgccatgtgtatatcctctttggtgaagtatctgttcaaatgttttgttccttctcacctttttaatagggtttttttccttatcattgagttcttttatattctaaatatatgtcctttatagattatgagttacaaatattttcttccattttgtgattcgtttgcttattttctatttttttggcggggggaggaggggcgggcggacagagtttcactcttggtgtccaggctggagtgcaatggcaggatctcagctcactgcaatctccgcctcgcgggttcaagcgattctcctgcccagcctcccaaatagctgggattacaggcacccaccaccatgcccagctaatttttgtatttttagtagagacggggtttcaccacgttggccaggttggtcttgaactcctgacctcaggtgatccgcccgcctcagcctcccaaagtgctgggattacaggcgtgagccactgggtccagcctgttcatttatttttttgatgttgtatttcaaatagcagaaattcttcatttttattaagtgttatttttcaaaatttttttaaatgaatcgtgctttgatggcatatctaagaactctttacctgaagtcataaagattttgttctgtgttttcttctagaagtttttagtttcaggttttatcgctaggtttatgataattaggtatatatatttttaaaaccccaaatggtaaatcgactcattaatagtgtgaatagtgtcttttttttttttttttttttttttttttgagacagagtctcactctgtcacccaggctggaatacagtggcaatctcggcccactgcaatctccgctgcctggattcaagtgattctcctgccgtagcctcctgaggagctgggattacaagtgtgagccaccacacccagctaattttttgtatttttaatggagacaaagtttcaccgtgttggtcaggctggtcttgaactcctgatctgaaatgatccacccgcctccacctcccatagtactgtgattaaaggcctgagccaccatgcccagcccatgtgaggttttagactagatctaactatataaaattcataatgatgttaatccagatgtttttaacttgatcgtaggtttgtattagtttgctatagattaattactgaaatgctaattgtattcagtggttcaaataactaaatatgccttttaaatcatagtttatatgttttcatttttatcatggttacagaggcttctcagttgatagtggattatgtttaagcttgagtgcttaagtttttgatacacatgtaagatgtttaaatgttataacaagccttgagtgctcttataatccttatatgactccatatgaatctaagcttggtaaactttcagctcctgtagaacaattttagtcatataaaaccattttataatcatagacaagatgaaaaattgtcaaagtgttgttttcctctaatacttttaattaaaattaccaagaagatagtctcatattaaggtagaataaagatggtaagactcagctgagaaatatgaagcctggaagaggatatgactgcagtgtttgatcatgaagatttcaacaaatcaagcattcatcaaattccatattacataagtcttatctcactgtgtttcaagtagtttattttagaatttaaaaaatttcaggataaccttaggcacaaatggatagatgagtgtgccaggtatcatctgttcctccagtcccccctcctctactctcccctcttctccagtaggctgacctccatgaaatgtttcagtggattcttttgccctctggcttcctgttgggtttagcaaaagtgttttttttttccttttcacttatctcctccttttctccctttctctttctcctttcctttcccctctgctatcctcttgccctcctccaccttcatctcctcctcctctaccttcctgtcccctttccgctttcttctccacctgcttatttctccgcctcctcttctctcttgccctccccttctcccttgtctgctattgtgctctctcatgggtgctgtggtgctctgtctgtaagaaaaagttctcagcttaatgtaggtgggagtgcagtcaaggtaaagtttagggagtggattatattattaggaaactgatggattatggaatcatgtctccagttgacattagctgtggaagaactctcaagagagcaaaatacagtgaaattgatgataactatatatggacttagggatgatattaaaaataagatatattttgaccctctttttatatcttaatttttttcatgattgtaaattttttagattttaattttaagacaaagtaatgtagctttcgtggtagatttttttgattaaaagaaagaaatgtttgatttggaattacgtcatttaaccttttgttgaaatacttcattttcctttaaccatacttttttgctaccttacgtttattattatttattattttggaataagactgtgtgtcaaacattttttctcttgctttcccaaacatcattcttgtcgattttagttttcagtgttcagtggctgtattttgggggtggagtagataaattttaattaattgtgatgattttgaaaccccatcagatttttaatttagtgaaataatagtgttaagtagcaaactatttatttattttgagacagagtctcactctgtcacccaggctggagtgcagtggtgcaatcttggctcactacaacctctgcctcctgagttcaagtgattcttacgcctcagcctcccgagtagctggaattacaggcgcacgccaccatacctggctaatttttgtgtttttagttgaaacggggtttcaccacgttggccaggctggtctgaaactcctgacctcaagtgatctgcctgccttggcctcccaaagtgctgggattacaggcatgagtcactgcacccggccctaattagtaaactatttagacataactttccaaacttaatcatatttttgtttgcttttctgcttttgtactctgatataatatcagcgaacaataactcaccttgcattgtatatttcagataccagttaaactagctgttatttttaattcttaagatttaggcattgtacataaagtatttaatgatctgagataattttcttttaatgacatatgtatgttctatctctttttcaggtcatcctgtacagttctacagcatgaataggcctgcctctcgccatactcccccaacaatagggggctcgttgccctatagacgccctccttccattacttcacaaacaagccttcagaatcagatgaatggaggacctttttatagccagaatccaggttagtttttttgtttttttgcattctatagaatgtatttaattaaaaaccttcaactacaaaaaacccttaattacaaatagtgcatggtaggtggttagcaccatttgttgaatgaatgggagaatgaatgaattgtaggttgttaatactgtatctttcaattctttaaaaaaaaatcagtatgtgatttccacgtaaagtcatacaacttagtttttctgagcagaatttttttgaatattttagtggttatttgctttttaaaataacattgtggtgaatggtatttcctttttatttaatcagacatccttacttttaaataacaaataatgaaagttgtgtgcacatgaacagaatttagaagtggcaaaggaaaagagaacatttttgaagctactttgtgctagggaattatactagcttatacaattctcataccaaacccatggtggaaaaactaggaattgggtaaattgaatcagatataataattacactaaataatcggttgtatcatgcatgcagaataactaatctggaacatatttaataattattattttgtttactccccagagagggcaagaacaaatattagacaccatggctattgtggacatggtatgtcaacttactgcttttttctgtatttttgccaggaagccagtaagcctatgtgtgaacacctctcatactgggttcaactcattccatttttgataagccttgaattttatggagctgcagtttgtctctgtggctgtgacctatagtgatattctttgaaagagtcttgcagaagaaatttgatcctccaacataaacacttaatttaaataatgtttttatattatctcatttgattcttagaatcacgtacaaaataagattggtgatcattttcttatatcttataggtaaggaaaatgaggctgaggtgatggtcaggttaggatttgaacttaggttttctgactctaagttccatgttctttctttctgttttttttttttttttttttttaaattgagatggagtctcgctctgttgcccaggatggagtgcagtggtgtgatctctgatcactgcaatgcctgcctcctgggttcaagagattctcctgcctcagcctcctgagtagctgggattacaggcacccacgaccacacccagctaatatttgtattttattgtagagacagggtttcactatgttggccaggctggtcttaaactcctgaccttaagtgattcacccacctcagcctcccaaagtgctgggattacaggcgtgagtcaccgtgcctggcctaagttccatgttctttctattgtcctacctacatatttaaaaaatttttctcttatcctcccaagtcttctcttttttggaggggaaggcggatgaaaagatgtgatataaagtgcatgaaagcctgagaccttgtcagtcttttatacagttacatcctggaatattgctcaggaactgtttgttgaatgccaaatgaatcccttgttcatttttccaaatcccttcactgttctgggtccctctcgtaaattaagtgctgtatctgtagtccatccagtgcaaaccatagtgtgaataccaactgccttaattgatatatacttcccttctatcttttatcacgtttagtgtttttggctatgccattctttttaaatcattctgaacttaaattttgacaaaactgccctttttatacatttgccttttaaaccatgttttcaaactcacatttgttcaggagcacgggattacaggtacctgccaccacgcctggctaatttttgttttgttttgttttgagacaaagtcttgctctgtcacccaggctggagtgcagtggtacaatctcggctcactgcaacctctacctcccgggttcaagcgattctcctgcctcagcctcccaagtagcagggattacaggcacctgccactacacccagctaatttttgtatttttagtagagacagggtttcaccatatcggccaagctggtcttgaactcctgacctcaagtcatccacttgccttggcctcccaaagtgctcagattacaggtgtgagccaccgcacccggcctatacagggatatttcatgctttgttcgtgtatgctccaaaatagtcctatgagaactctgtaggtagaatttatttgaaggctgtttaagcacatatttaaatgcattttataatacatacttcaatagtttctttgtaaatctgattttcaaatgcttgaaagtatatgttaaagtaaaaagatccccactttatggaatgattttaatgaaaagtatttttctcactcatggaagtaaggtgaattgggattgttaggctttctgtgtaatgtgtgagtcaatttagttgtgcttttttgtttttctgtactctgctctattaagttctgcctttcatctccagggatttgataactgtttaaagtgggtggccacagcattgttagttggttaatcagagtactttttgtaaactaatttttttttaactaaaccattttcttggaaaagctctttttgcaagacttaatgatttgtgaatcagtgttctaaggctgttagatgtacttttattttatattcattagaatattatttatgagtcaagcactgtggcaggtgcctgcagtcccagctcctcaggaggctgaggcagaacgattggttgaacctaggagatggaagtttcagtgagccgagattgtgccactgtactccagcctgggcaacagagtgagaccctgtctcaaaaaaaaaaaattatgtaagtctcctgtattactcccagtagccctgcaattgtccctatttttttcatatttacaatgagaatatttgttgtgctttctcaagtaactaattctctgatttaacaaaaatgatctgaagtgtgtgttttatgagctttttttttgggggggtaattggagtcttgctgtggttgcatgcttctgaggaagtgagctgacaatctttggaaggtttcatgtgaatataaattcagtggggttctgtgaggtgtaaatctagcagtgctgttactatatttgttaatgtacaatttgatctgagtttgaaaaagggcaattataacataggagttaaaatatggaacacccagtgtctagtgccaagtcttaggagcacaataattgtttttttcatgagattatttcagaaacaagttattgaaaggaaaggaaccctttgatcagggcataactgaaatccctttggttctcattatttcttaatctaatccagccaatgaaataggaataccaatttatcattaatcttgccagtggtaaggagggggtcatagaaacacatagggctaattatgagttaacagtctctactttaaatgtaaatatgaaacaccttggtggtcaagaagaatatacatatatctacatgtgagtatgtgtacatatacttacataagccttgtttgttaaggaatcagtaatgtagcatgtaagtattgaagactttaggagaaagtagcctgtattttactgctcatattttcttaaaagcttttgaaaaaatctagttcataaagtgaatgttggttccaagagatgtgtctatatatagttctatgagatataggagtttctgaatgggtatgctgtttcacaaagagaaagtgtcaggcttagtaacccctgaatggttttaaaagcgactaaaaaaataggaaacaatgttgggatggtgctgttccaaaataaaaagccatttcacatattctctaaatgatttgtgaagttacagcatcaccataaatgtctaaaacgtctagaagaatactgatgtgttggggctttagcaaagtataaataaagagcaggagcaggaagatttttttttctccccaaagtcttgctttgttgtccaggctggagtgcagtggcacaatcttggctcactgcaacctctgcctcctgggttcaagcgattctcctgcctcagcctcccgagtagttggaactacaggtgtgtgccaccacgcctggctctttttttttctttaatagagacaagctttcaccgggttggccaggctgatctccgactcctgacctcaagtgatccagttccatctggcgtaacaaaggtcatcccaaattctacttttctccacggcaaacctttaacaaggtggtcgaaattaattcagataccacatccttttctttttggaccatgtaagatctcatctgactagaatgtctgtgagccagaatatactgtctttcttggagttgagctgaaaacaaaccattctaagagaatttaagcagaattttgagcaaagaattgttgcaatattcagttctaatcctagtcattttgttactgctttggcctcccaaagtgctgggattacaggtgtgagccaccgcatccagcctgaattcacttttacataccttttgttctaagttggtattcatgtttagaaaatactacacttacacattgtttatttccttcactgggaaaaaaacataagcatctcaactcgcatgggctatataatatatatatctcctctaaatgtgatgttcagtaatgactttagaagtagtttttagagcgcttattttgtctaatattctcagagtatttataaagctgtaaaaataagatgtaaaagcttaattttatttttccaaactttttgaattggacatctaaaatacaagcttcattgatgcttcagaggactttataaataaccaggaaggttgtacttggaaagtctgtacatttcatcagcacagattcatcatttaggtttggattgcttggaaagccttttactgtttatatctaaacattcttgtatattgtgaaaattacataacaatctaagtttggagatcttttggtggttattgggaaagagtcttgtcttatgaggaatcattttagctaaatgaaatgaaaacaagtttgcttcctgctcttctttgcctgttcacaaaatgactaggattagaactgaatattgcaacaattctttcctcaaaattctgcttaaattcacttaaaatggtttgttttcagctcaactccaagaaagacagtatattctggctcacagacgttcttgtcagatgaaatcttacaaggtccgaaaagaaaatgatgtggtatctgaattaatttcgaccaccttattaaaggtttgtcctggagaaaagtagaatttgggatgacctttgtaaccccagacggaactgaatttttgaacatgccttagactagctttgaaaaaagtctaacttgttaccaagtcattcttttaaggaagaactgcgattgatctttccctggctgctggtggacttttttttttttttgagatggagttttgctcttgttgcccaggctggagtgcaatggcatgatctcggctcactgcagcctctacctcctgggttcaagcgattctcctggttcagcctcccgagtagctggggttacaggcacctgctaccacacctggctaatttttgtatttttagtagagatggggtttcaccatgttggccaggctggtcttgaactcctgacctcaggtgatgcgcccccctcggccttccaaagtgatgggattacaggcatgagccaccgtgcctggctgctggtgtacttcttaaaaccactatggcttcagattttcactttcagaagtagaaaagaaataagcatattcatcttaaaaaaaaaaacctcagtctacccacaaaaagactgctgtaggttaagcacctaatcattcttttttagctgagtaccaaaaggtcattttttatatttggtagagaaacagtgactgaagtgggaaatttcccacttttctgttacacggaaggttaggttacatgccaacagaagaggagcatttcatcttggatgtgaacatgtgccttgtctctactcttctagtgccagttgctgcctgctactgtttctcagttttatcttttttgtctatgctaccttctcctttcttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtattcttagtagagacggggtttcaccttgttagccaggatggtctcgatctcctgacctcatgatccacccgcctcggcctcccaaagtgctgggattacaggcgtgagccaccgcgcccggcccaactaccttctcttttcactgtcttctgcttacccttggaaacagtattatgaacatatcaacagttgttgtaagcctctgagtgggaagcagacacgcaagtcaaggatttactgccaagaattatgactttagggaaaaacctaaccaaaggtgtctttttaagaaaggtaccaatttctagggttatactgctctgttctttgcatctagatattcaagattatctgcttaactcttgtctgtgcatttatatgtcctccctgcatctatccatagcatcaactgtagatattttgcataatctcaacccaaatatatcatatcattatctctccctgacttacctgtttaccatcccatttctttcccagtactacctaccaggcttaacatagttagtgacatctccatcttcatagttacgaagggtaaaaatctaagaatgaccttcagcttgttgctgtccttgatatgctagctaaatcattaattgccaactactctcttcccacacttttaaagttctctccttttctagaaactgctttgatttattacgtgccagccactgggttaggctttccacatccattgtctttttttaatctttgcagccactattggaagtaggttgcattaccttgttttcatatcacatttatggaataggcctgaagaagttaattgactagctatccaaacagccaggaaatgatggatcagagatttgaggctgagtgacctgaaaatccaacctctttccactaagcactcttccaccaggcatataagatccttccctatttcatatcctcccattgatatttctgggttttttactttctctttgggtatcttttcctagccatatggaaacatttctggtcctgtgaactggttatgctgttttatgcctctgagcctttaccctcacttgcttctctcaacttgattatctttctcaacccctgtcagcttggcaggttcccttcttcaagtccctgctgagaggtcatttcattgtagccctccttacctccaccactacttccagggaattgctacaaatattgttgggttaagattatcatgtattcttctgtttcaatagaatgtgatctccttgagagcagagacatgttcatctttttagttttattagtcttaactgtattttggagctaacagaggcattttctctttataagaaaatgcatatcctactttgtacccattctaaaggaaactgtaactgtagagtaatcttttttctttcttttttttgccgctttagtttccacacatacctggcttattagtgcaattatatatgttaaacatctgttgacagtttattagttctaggcactgtgccaggtgattgaggtgcagggaaatacaccttgggaaggagagtggaatgatttgattaaggcctgcacttttctataccatcagggaggaagtgtaccaatgagttgggattatgaaaaattgtaatgacatagcacccgattctcagaggacggttttgatactgttttcctagcaggtgtttgccacttacttagtatgaagtcagtaagtatttgtctaattaatgaatgaagaaccagtttacttgcctacaattagagtaataaaagtatccatttagagtgttgggatgtaatatttttttctctctgtattgacaaacatttaaacttgtaaccttccaaggtaaaattcagaaaacaacatcatggtaatctgcagaaatgctttccttgagaaggcatgatgttaatgatatgaaaaaagatcaattatatataatatatatataaaacatgattgttatatataaaaatgggattatgttttatatatataaaacatacgattatgttatatatatatttaacatatctgtgtatgataaatgcctcctgttgtgattttcaaaaacttactaaaaattcccccagtactttgtttgtgttaatgagttgtccctcaacaggggatccttgagatcactgataaaatgtttgtgaatagtagtttccctcctttatgtgtttattttattgtattatcctttccttttaatgtaactcgcccttatcccttatcctccacaccttttttgtttttgcagtatctcttgctcctcctcctccctccatcctacaggtaactcctcagttacctttaatgggatttgtggccagagtccaagaaaatagtaagtttatgtcttctttatgctgtagatcagattgtaggcataaaatgtcatttatatgtgattgactggatagtcattcatttgctgatacttcaacatttcaatattatgaacaaatcactgtctggctagtggagataaaatagagaaattttctacttttaaataactaatagtaaagacataagacaaatacatataaaataaggcacatataagaaaagaaagatcacatcctactgaggaggtatctttaatcactagatatcccatctttttctctgggttgctcagataagtggtagtctagtttcttatcactggagttttatgggtattataggtggtctgagaatcttcctccagttttgtgattccagatatcagaagggccttttatggtagggctcagaggaccaggctgccagtctgtctcccaagaagcctcataggttggcaatgaatttcccttggcctgttcaggtaactaattttgttcataccttgagtcttctagggaagcattaagggagctcaggaggctgatgacaaatcaggaggcctgtatcaacattcagtgaggaattgctgtcacagagaccagtgaacatagactgtatgatggacaaatcctcttcttatgggcagtctttgcgagggccacatcacaataataaggttacatgatttgcatgaatctgaactaggagaatgatattaaagatctcatgtcatcagaccaaagtagtccagtgtatatatctcataacaaggatggatgacttcactggtggggtagaaatatttgcaatctgtggcttaggactcctgcttatttggaaatgggcactgccagtactagaatgtaagctctataagagcaaggagttttgcctgttttgcttgctagctgtttccccagcacttggaaaagcatctgacacatagcaggcacttttggtccctgcttttttctgcttctgtagctgaccaaatgccccccttttatcagcacattcttctagatgtggttgtattttaactaataattcagtcttactggcctaagggctcagtgtctttcagctgcctttgcatctctatttgctaatttctgaaaatagtctattttacttacttttgtttattggaaggtactccatgaacacctgtaatgtttaccacaccgtgacttcataagatgttttgttgagtttaagagctattttcacatataattaggttgatttcatatgttttaaattatgctattggggccgactcttctttagcttgggtgtgacccacactggctcgaggagaaaactgcctctcagcaacattcaactattaatagttcagcatgtgccaagcacatccatagtgtgatcctctgccaggcttgtgaggtcaagtgtgggatacagggtcactgttgccaggttttaaaaaatgtctgctgcatccaaacaggataaataccaagtagaaaaggatttaattacagtacgagaattgaaggactttccaatgctggttccattctacatactccatacaaggtggaaagtctaagtaaatgtcattacagtaaaataatttttttccatcacaaatccggtttaatcacaatgattaatgatggtagtcacttgaataataccctgggagttttttctgtttttactattgtgatgagtgtacaccttagagaattctgccaatcaattgctactgcatgttctgtgagatgttgtcattcattttgaacaaaagtggttctgagcagcttctggagtaaaggccagattttgaaactgacattgaagactaatccattaatgaaacacgaatgtttgtatagcaactaagtggttattttcttagcaaaaaatgagacttgaaagttgaataggatttaaagcaggatgtcattggttttcgccagtcaccagtgaaagctgcaagctttgtagaaacagcaaaatgtttcatgaaccaaacctaagaagtattgttttaatttaatagtaaagtgcatgactatcactttaagacttaggaatgtcttaagtagatgactgcaaaacattattatagcagcactacctatattttaaaaagtcattccctaatttgaccaccctatcacagttgattgccttttggattggtctttttcatcttttcctacaatcatatacgtttctcatttacacaacgtataaaaaaattgtgtatgaggtgtgctgtgactaattttacagacgtggcaggacttaaacattagtcaaataataaacattatttgaatgtttaagtctttaaactctttaaaacattcaccttggaaaaatacatacatttcttttggtacatcttcaaagataattctttggaattatcttcaaagctttccaggtatattattttgaagatattccttggtagcaaatactcactctgcattaagtttgatgtttggaagaagtctggaataatttggaaccagttatagtgacccagttatactggggtaagaagtacagctatgaccctgttattccccttaaaatctttctgtggctcaccatggctctttggatagagtccaaactgctgtaaggcccttcctgcctcatcctcttcagcttcctgaagctggctactgaatttggacagttctttgaaagtttcttgctttcttacctttgtacttgcattgtctttttttttttttttttttggagacagtctcactctgtcacccaggctggagtacagtggtgcaatcttggctctctgccaccttcccctcctgggttcaagtgattctcatgcctcagcctcgtgagcagctgggaatacacgtgtgcaccaccatgtgcgtctaatttttgtatttttagtagagacggggtttcgccatattggccaggctgggcttgaactcctgagctcaaatgatcctcctgcctcagcctcccaaagtgctgggattacaggcgtgagcctccccgcctggccttgttttgttctttgtatctgacatgaaatatcaatgcctctgccatcctaccctcccctcttcctccccattaactcttactcttccttcaggtttcaggaagcctttcctgacccacataacaagtgtggtttatgctgtgtgcttctatagtatcttaaagcacacactacactcaattgtaaatgaagatttggtcgttcatgtcttcatgacttttgcctactgcccttttctcaatgctgagcataatatccagccatattagttaatgtttgttgaataaatactaatgaagcatgacttgaagtttttaaaatttatcccatcccataatagtgtagcttttaagataataggcattggagttcaggtgcttttccacttacttgctgtcagaatacttaatcttggaaagccagtctccacatctataaaatgaaaaacaccacctcccaatataaagatgaaatgaaataatgcattacaaaggactagctgagtaattggaacattttaagtcaaaagtagtagcttattaaactggcagttacaagaaaagtaaaaatgaccaatggcagcatctttgagtaattttgtagtgtcatttctcaaggttattgttttgaaagttcctttggatctatggttctgtgcagttgtttaaagtcagtctttttatcttacaaatggaaataggataaatttctctttctcacccaagtatatggtaaatcacatatctatatcttttgtttattaataaaaactattaggatgaaagacattctatttaatgactgaagttttaaagtttataaagtagatcagtatagaggggcacagcagatgggaagaatactgataagacagcatggtgttgatgtggctgctcccaccaggcatcagcagtctttgaaaatccatttaattcaccgggcgcggtggctcacgcctgtaatcccagcactttgggaggccgaggtgggcggatcacagggtcaagagatctagacgatcctggctaacacggtgaaaccccatctctactaaaaatacaaaaaattagctgggtgtggtggcgggcgcctgtagtcccagctacttgggagggtgaggcaggagattggcatgaacccgggaggcagagcttgcaatgagccgagatcacaccactgcactccagcctgggcgatagagcgagactccgtctcaaaaaaaaaaaaaaaaaaaaaaaaaaatccatttaattcaattcgtaggcttagattaaaaaatactaaataaattggattgctcagagagtcacatgggaactatactggtacctcataaataagaattagtgctgttcattaaacctggggagctgataaacaggtttattcatttcattctgttcagttgtgctcacgtatttaccaaccattttgaaagcttaaggtagctgagtttgaagataatctttttgatgttactatatattggtatgcaagctgtggaagcagatctccatgtgagatattttaaattactctgatagtacacttggacatttagcctgaagaaattctgaattatagtctgaattagaagaaattctataagtaaacaaacatcctcatagatgaagtaacccaagtttgttgatgatttttttcctcttgaatttggtaaaatgctattttagaaaaattcattaagaggaaagtagtgggttattaaaattttactattccctggactcatttaagtgaaaaaatattttaagaatttgtgaaatatggttttcagtgttagtatttctgataacttacccttgaatacagtgtaaagctcagctgtattgtactgatctctgggtttttttattcttattttttattgtttattttttttttgctgttgttgtttttgagatgcggtcttgccctatggcccaggctggagtggcgtgatctcgactcactgcaacctccacctccccggttccagcgattcttgtgccttggcctcctgagtagctgggattacgggcgcccacgaccatgtgcgactaatttttgtatttttagtagaggcagggtttcaccatgttgcccaggctggtcttgaacttctgacctcaggtgatccgcctgcttcggcctcccaaagtgctgggattacaggcgcgagccaccgctcctggccatactgatctctttggaaagaggatttgtgttaatataaacaggttccagaggctcagttaataattattttgtctaaactttattcagtgtccattagcattaatccaagggcaagagagggagaacgtcatacttggagctctagaacgttatagttggtgggaagacttatcttgctcattgattttttgaaggaatattacatttattttcaagtctaggtttatattccatgaacccagaagcttggataggaaatactgaactttgcataacatatagttttgttgtcagcctgatacgttcttagtttcagatacaccacctccaccgccacctgtggaagaaccagtctttgatgagtctcccccacctcctcctcctccagaagattacgaagaggaggaagctgctgtggttgagtatagtgatccttatgctgaagaggacccaccgtgggctccacgttcttacttggaaaagggtaagtttcagaaggatatctggatagatgggaagaaacctctacatagaaatgaaatttgcggtactgaagagaatcttattttctactaagtgaagttctatttatttgtatttgtgcatttttactgagtttacaaggttcatgattttgaaagttacactagtaaaattctgtgaatatttgattttaaaaaactgatggttatctatattgttcctattggacatgctttttatgaatggtttctatcagtgtttttctgttttcctttggcctcaggaagattatttttccacattattattcctacctccatgctttagaacattagtttgtgtcaccttataatcagatacttcagtttaaatgtctccacatgaaactttcttccacagaataatggtttctcagtttctttgccaagtaatattgggcatttcttttagtgaaaagcttctttgatattagctaattatgatgtagcactttgggatacaagctttcaaatccatcaagactaatcagctcagaaaaaaatgtgtgctgtctggaaggaaattttcttttaagaaaatcaaagctactaacccactgagtctcaaagctggctacacattagaatcacttggagagcttttataaagaaataataggcttccacttttggccaagagagagcaacagtaatcaggtgtaccctccctcctaaaacaggaattttaaaaccccacaaaataatggttttcagacattgaacaacaggcactggagagaaggaaattaatttttttctttatgtagctactataaataccacatgtgatcaagaaagtaaaggagaacatgaacatgagagagacgtggaatatatctttaaaaagagagagagagagaaagagaaacataatatttctggagacgaaaaacacatgctgcagaagaaagcattagcaaccttgatgccatgacaatagaaactatccaaaataaggcacagagaagaaagtggaaaaaaaggcaaaaaggaaaacagagcaacagataatgtgagacaaggtcagatagtctttatgtatgtgtaattggagtccccaggagatgtgagaggaaaaagagttgaaacaatcatagacaaaatatttccacgtttgatgaaaactatattagttgtgtattgctacctaacaagttattccaaaaatttagtggcttaaacaaaacatccattatctcccagtttctctgcgtggctcagctgggccctctggttcagggactcttcacacggctgcaatcaaggtatcagctgaggctgcagtgatctcagggcttgactgagggagactgctttcaggctcactcgtggttattggcaggatttagttccttgtgggttgttggcctgacggcctcggcttcttcattggctgttggccagaggctgcccacaattctggatcacataggcttctccgtagggcagctcacaacatggcagctaacttcattagaatgaacaagcaagaagcgccaaaaagagaatgcaagcaagacactagtccttttttcaccttaacccagcagcgatgacctgtcatttttgccattttctgttcattaaagcaagttaataggattagtcaacactgaaggggtagggattacataaaggcatgaatactatgaggcagaaatcattgggagctgttttagaagttgtctcccacaaaactataaactcacagatccaagaagttcaataaaccccaaatagaagaaaagaaaatcttgccaaggcacatcataatcaatttgctaaaaaccagtaccttagaaaatcttaaagataatcagaggaaaaatgacatattacatacagaggaacaaagataagaatgactgcatggttctcatcaaaaagctgttaagtcagagaattgagcaaaatcttcaaagtaatgaaggaaaatgtcaacccagtgttctttacttagcaaaaatatccttcctaaattaaagatcttttttttttttttttttttgagacggagtttcgctcttgttgcccaggctggagtgcaatggcgtgatctcagctcacagcaacctccacctcccgggttcacgccattcttctgcctcagcctcccgagtagctgggactaccggcgcccaccaccgcgccccgctaatttttttgtatttttagtagagacgtggtttcacggtggtcttgatctcctgacctcatgatccgcccgcctaggcctcctaaagtgctgggattacaggcgtgagccacgaggcagagtctcgctctgtcgcccaggctggagtgcagtggtgtgatcctggctcactgcaagctccgactaccgggttcacgccattctcctgcctcaacctgctgagtagctgggactacaggcgcctgccaccatgcctgggtaattttttgtattttttttttttttggtagagacggggtttcaccgtgttagccaggatggtctcgatctcctgacctcgtgatctgcccacctctgcctcccaaagtgctgggattacaggcgtgagccactgcgcccagcctgtgctttgtattttatgtggtttgccttgtttaatataagaatgctttgggctgtaatcccagcactttgggaggctgaggcgggccgaacacctgaggttgggagttggagaccagcctgaccaacatggagaaaccccgtctctactaaaagtacaaaattagctgggcatggtgatgcatgcctgtaatcccaactactcgggaggctgaggcaggagaatcacttgaactccagaggcggaggttggggagagctgagatcgccccattgcactccagcctgggcaacaagagcgaaactccatctccaagaaaaacatgctttgaaatgttagctctattgtaattcccattatatagttgaataaaaagaagcctaggaaagttaagtatgtactgtaaactattaatagttaagtgttagaattgggatttgactgggtggtataactctagaccccacactcttaaccattgtcctaaacgtgagctctggcatctggcagacctaggattgagtcttggctttacagtttatgagcattaagtcctccctggaaaacttttttactgcccgttttgtatctcttaacttttgtaaagccatctattcttttgttcttctggctcagtgatacagcttttagctagaagtataaatgatatataggaattgtcagataacatttctgtcttcacaagactgtgacagtccctttttttttttttttgagacggagtcttgctctgttgcccaggctggagtgcagtggcacggtcttggctcactgcaagctctgcctcccaggttcacgccattctcctgcctcagcctcctgagtaggtgggactacaggcacctgccagcacacccggctaattttttgtatttttagtagagacagggtttcaccatgttagccaggatggtctcaatctcctgaccttgtgatccgcccacctcggcctcccaaagtgctgggattacaggtgtgagccaccacgcccagccgacagtcccttatctggttcatcttcgtacctctaaaagtcagcatggatgctctattaatgattgttaaaaaatgaatagtgccattaattctttctggggaattcctagaaagcttctcagagaacatggcgttcttggtgccttgaatgatgaataggagtttctcaggcagagaagagagaaaggaagggccttccaagctgagggaatcacgtgagtgagagggcatggctgtttggggcagagcagtgtccagtgcatgagggtgggggtgggttgtagggagagagggtgatatgagcacgcaaagggaataaattgtaattaggtggtgggtggctaaaaatgacaatgcgaaggtgttggattaaaaaaaaaatctggtagtagagggaaattatggaggatttttaaaaaggttaatgataatatccatctacttatgtaactttttttggagatacctgataatagtgtagagtgcattggagaggaaaagtaggagttgtaaagaccattttggataaactttgaagcaagggataatggcctcaaccaaggtagtggtgctgaaaagattgtttacataaataagcagatacaaatagaaggatttttcaagtggcattgtaactgcacttttcaaagttatttgccaaaaatcaaataacgtatcttcaaaaatcatgtttgatgatgtatcatcaaggtctttcttaaattttgttgaaagcaaaggaataagagccacctgatttgcaaacggattgagttactcagtggagtaattcttttaatatgagcaccattattttgaatggtccctttggcacccagtgttttgtactttaagacagtgcaccactgtgctttttttaagtagaaggacaaaaaggatataaaaacttttatgactgcttgactgaaggtatgatctcaagcagatcaattttaggaagcagtacttaagattagaaaatctagaaagaggccaggcatggtggctcacgcctgtaatcccagcactttgggaggccaaggccggcagatgacaaggtcaagagatcaagaccatccagccaacatggtgaaaccccacctctactacaagttcaaaaattagctgggtgtggtggtgcacgcctgtagtcccagcaactcaggaggctgaggcaggagaatcacttgaacccaggaggtggagcttgcagtgagccaagatcactcgccaccgcactccagcctggcaacagagtgagactctgtctcaaaaaaaaaaaaaaaaaaaatctagaaagagagccagttgcatgtagtggctcacacctgtaatcccttaaagtgctgtaaagcactttaagaggctgaggccggcggattgcttgagacgaggagttcaagaccagcctgggcaacatggcgataccctcgtctctacaaaaaattagaaaacttagccagacatggtggtgcatgcctgtagttccagctactctggaggctgaggtgggagcatcacctgagcccaggagtttgaaggctgcagtgagctgcgattgcaccactgcctggggacagtaagactctgtctcaataaaaagaaaaaaaatatcgagagtccctataaactgtctgccacccacactgcttagaaaatctcaggtaccctgagtgataaatgtaatcaattttaaagatgggtgcactaactggggcggtgactatgatgatggagagaagtcgagtgttggtatttgggagatttagaaggtggaattaacaggacttggggatgtcggggaaggtgagtgaggggaaggcaaagatgactcctagtttcctggctccacagaagcgtagtaatcagataactgggagaagacactgtcatggaagccatggaggaaaatgtcaagaagcaggcagaggtaatcatcattgccaaacactacaggaacattagacaaagaactgagaagaggctcaaaagtagaaggccagtttttttcaagtgaatagtttcattggagtggtaggggcagaaggaatatggctgtattagttaagcagcattattttcattgaaacagcatctccagtgggttctaaaacatttcttagaatacattaagtggtttaaccaactcttcattgatagtgtccaggttaactttgctctacctcaggacaggttataacataaattccaaagtatgttaaatgttttgctggcttaggatgaacttttttccatataaataaaatgatgtcaactcacaatatgtaatttaatacaaacagtatattgaaatggataatcttactagcattttgatttttccagtggcttgctagtttagggtacttaattgttaggtgtggttgctaataccctacaatatttggtggtcagtctttttagttcagatcagtcacttctatgtaacatgctccttttgggcctttttgttttacattgttattttagtatcaccttaatttttcccccaatatgtatttaagttacctttattactcactgtgtaactgaataatatagaatatagatgtatttagaagtatccaaaaagctaggccttgtgttaggcgctagggatacacagagatgagtgatgggcccttacctccaggagtttatagtgtagagagttttatgtttagattgctcctctttgtttcaatttactattttaggagagaaaaaatcatctgggtccttttttttctgagacggagtctcgctctgtcgctcaggctagagtgcagtggtgcaatctcggctcactgcaacctccgcctcccaggttcacgccattctcctgcctcagccccacgagtagctgggactacaggcgccggccaccatgcctgctaaattttgcatttttagtagaggcggggtttcaccatattggccaggctggtctcaaacctgaccttgtgatctgcccaccttggccttccaaagtgctgggattacaggcgtgagccaccgcgcccagcccaatctgggtccttttctgctggcatggtaccattattctttgcttatctttaactctgcagcatacttcatataaaattataggattaaaattaaaaagagaatcatttaagctaagaagtttttttcagttttacagaccttcataaaatattctagaatgtattcaattgaaatgctaaatatgaacaatgtactttgaaatttagaatgtatttttactttagcagaaacatttagaagaacaatgtgtaagtccttttctgtttcagtcataactgcacaaaaaccagatgtctagcattttaagttttttcttacatgtgctttatcagttccccatatgattttgatactatgcgtgatatacatgcataattggaaaaagtgactttcttccctattgccaaaaccagttttccagactaaataaaatctagacagattttacatttctcaacatcggtattttgaatattggtgaaaacacagatactttattacaccgctttagagttactttgataaaagtttgttgcactaaatcaagagtattttgctttttgatgaatggctttacagtaaagaattagatgaagtaaactgctggtgtatatctttccctggagtgaagtaaactactggtgtatatctttccctggagtgaaaatgaatattcatttaaaaattacttatcagggtctcgttctgtcacctgggctggagtgcagtggtacgttcagtgcttactgcagcctcaactttctgggctcaagcgatcctcctgcttcagcctcccaagtagctgggaccacagacgtgcaccaccatgcctggctaatttattatttttatttttttagagacagggttttgctatgtttcccagaccagtcttgaactcatggcctcaagtgattctcctgcctcggcctcccaaagttctgggattataggtgtgagccacagtgctcagccagaaagtgaatattctatacagcatatttctgatttttgaaaaagttaattttaaaatagtgaatactaattttggcaaaagaaaaagctgaacagttgttaaaactctcagctctctaccattataaacagtctctggaatcatgttaagtgtaaattctatctaatctagtttctacttttgatttgttttgagacagtctcactctgttacccaggctagagtgcagtgggaaaatcacggcttatttcagcctcaactttgctgagctcaggtgattctcccaagtagctgggaccacaggcacgcgctaccatgccaggctaatttttttttttttttttgtattttttttttggtagagatggggttttgccatgttgcttaggctggcaatttctacattttaaagaagaaaatgaatgtagatagagcttactaactttccacttctaagcatctctgttacaacaggcttcatattctcttctgaattacttttcatgggtttgcatttctttttcttttatttttcttttttgagacaagagtctcactctgtcaccaaggctggagggaagtgttgcgatctcagctcactcaagtgattctcttgcctcagcctcccaagtagctgggattacaggcgcccaccaccacgcttggctaatttttgtatttttagtagagacggggtttcaccatgttggccaggctggtctagaacttctgatgtcagcagtctgcctgccttggcctcccaaagtgttgggattacaggcgtaagctaccgcacctggctggatttgcatttctttaagcatcaggaatgttgtctttccttaaaaaaacactagaaaatattaggttgactagaaatgctaaatattctaaattgtattttctgggtttttttgtattttcttatatttaaacttgtatgccatttaactacatttgattgtgttcaggcatttggttatatattgagaaatgcacactgatctcttcctagcaaggatcttctaaagtattttctgaccaggtgcaggtggctcatgcctgtaatcccagcactttgggaggccgaggcaagtggatcacctgaggtcaggagttcaagaccagcttggccaacatggcaaaaccccgtctctactaaaaatacaaaaattagctgtgcgtggtggtgggcgcctgtaatcccagcacttgggaggctgaggcaagagaatcgcttgaacctgggacatggaggttgcagtgaaccgagatagtgccactgcactccagcctgggcgataagagtgagactgtctcaaaaaaaaaaaaaaaaaattctggtgttcctacaatatcactataatggaaaatattcacaatttaaggaagctatttaatttttattaaaacaggccagaaacaaattttctttagggcacattatatcagaagtccctgttgtagtttgtttctcattgatttatgtgaggcacaaggttgcatgagaaactaacaaagacagtgtgtttgtcttggaacaatggataggtggagatttcattgagtggtataaaataggtacagaagatgaagaggttggagcaaaggataattcttcaagtggaattgaggatgttacagggcatcccagtataactaaactgttgaaattgatataatacttgggaaccagagattatctggttgaaataagataacagttgaaataaccactgagataatgactcaaagagccaagttaccaagtgatttaagcaatgaaaatcacaggagggcttataggtatctgattttcttgtcacttttagtctgttattatagttatattaaattggtgacatagtgcagcatatgttttgaaaaaatatatgtagcggactcccatcattcatacatttaacttggggaaattgaaccaccattctacttagcgaagaggcataggctccagagagagtgagaaaggagacagaaatctgctgttccattagtctggtttctcacttgactctcatagtgtatctcattgccctagtataattctaaggtaaagaaaagctttaaaaaaaaaaaaaaaaaaaccacaatatggtatctcaacacaaactcaaatgaagaaacagccatctttcttgattctaggattgtgtacctcttcaatgaggtacttccctgtaggctcttaaaaggtcatcaaaagcacatttgattaaatgtgctttttccccatttgtactcaatttagagcctaacatccctagaaaatggaatttcattgtatatgactgggtattacttagaaaaaaaaacatgtaagttttggttggtgtttagaaagtcaccatgtttgagtgctacaggatttgggaacagatagctattcactggcttggttctgtctttctaggaatattactgtctttcacatcctgttttgttttcttccctcctagttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggt

SEQ ID NO: 37336 - DNA, 265847 bp, Homo sapiens
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcggtgagtttgaatgtgacataacttctctcaaaacttaattgaagtgccttgtgtattatgaatgtgtcagctgtgtacaaagaacaattcctccttgtttagtcagcacagtgatattattttggactttctgtggacttaaagtggtctgtggacatattttctgaatgtcttttttggttgatatttggatctacaaagtgaaaaaatttgaagcgaatcttcccatttaaaaaaaattatcacgccatttaagaatgtttaaaatatattatttgccttgttcagcacctactcactcaataagaaatttcactgggcagggatataataatgtatggataatcttcaagtcaaaataaacaccaaataattttgatttatacattaagaaatagataactagccattgttgtaccaaacagattgtggcttgtcattgcattttataaggaatattttttggtatgtttgataatgaaaatcttttgacaaatctgacttttaaagcttgtgattgtagtaaattttatttagaaacatttgcctagtactaagagagaatattagtgagggtgcacaattgtgtatgtgcttcaaattagactttgctatttttaaactggtaaatgaaatctgaacagtgtttttccagtcataaagttatgggagatattcaagtcatatgtagcaatgtgatgttagtttaacagcatgagatttcgtactttattttataagactaatgagagaggtcctttgcgtgttgaaaatggtgaggttacaaagggttaacttgccatttaccacctgtgtctgttggagcttgatactagaagcagattctgctctctctgggcaggactcacttactgtagactagtagagtgtgaaagatttgtgatcttcctttaacgtgatttgctacaacgtagaacactaatgtgagctatgtagattgtttctcttcctgtgaggtttctggtgggttgtgcgaaaaggcagaagagaaagagcaaggcagaaagataaatagaataaaggagataaaaagaaaagggtgaaaaaagagagaggggaagcaagtttggggtctccaaggtttcagtggaatttgttggtggtggcttgattcgtgtcttgctgtttaccacaaacaacaatattagcacaaataaatggctctaggatttatgttcttgtataatgtgaaaattagatctagctgcagttgaggattgggttgattaaaaagaaaaacaccaaagattttctggttctcaaaattgtttctaatctcaaaattatctattccattaaacatctttggaaataatagttctaagaagataattgtgatgaaatagtaactgtgtaatgctactcttgagggcatctctcctaaactaggtacttggaaccagggaagctttagaagaaacttccttctattgactaataacccacacttcaatcctgcatacatacctctctagaagcatttctaatgataagagaggcctataaatataaagaaatagagaaactactttttatattaccttgacgatctattagttcatgaagcaaatgtcatctcagtttttgacatactgtaatattctaagcaatcatagtatttttggtttttttttaacctttattttaagttcaggggtacaagtgcaagtttgttatacaggtaaacttgtgtcatgggggtttgttgtacagattatttcatcactcaggtactaagcctagtacccattagttatttttcctgatcctatccctcctcccaccttccaccctctgaaaggccccagcgtgtgttgttcccctctatgtgtccatgcgttgtcatcatttaactcccacttaacacgtgagaacatacagtatttggttttctgctcctgtgttagtttgctaaggataatggcctccggctccatccaagtccctgcaaaggacatgatctcattcttttttatggctacatagtatttttaagtagttttaaattttcctagaatgccctgggctttaatcatggtgcctgatacttttggggaaggcaggggagggcatgttgagaagctgtgagactatggttcagaatggccagggagcaattatttgcctaataaataattttaggcaagaatatgtacttctcatttgtaatgcaagcttaaccagcaaaaacattaaggtgatgaaacatagctcttactcagcatctgctctgcggaagacattgcaaatacaaaaaccaattagatgtgactgttacattcatttatttaatgttgcagtacttacatatttaatctaaaatatattttcctcaagtattttaactgtttgtcatgtgttttaaggactgaattattactattttccaacctttattacttagtgaataaacaagtgaataaatgaaatatcactgaaggaattagtatgataatgtatatggtcaaagcaaggatcaaacaatatgttctttgatacctcatgagtaaatgggtttgagctggtttttgtaagcagacaaccgttgtagttctcggtttacaaaaagctattttaagaaagaccaaatttaatcattccataatcatagtcatctacatagttaaatttgtctttactgaccttgtgtttagaaagaagtcatgaaagataattttttaaagaaagaacaggatatcttgatatttttaactccaagctaccttaatttatgaattcccttacagaatagaaaaaaaaatgacagatgttatcttttattactaaatgttaatgccattccaaaaaagtgtttaaatacatgtttcaaaggatgatggtaatcattctctaagttaaaattgggacttcatcctctgttttttttcctttccacttaaacatattaccatattgagcatttagttgtgccctgatgttaatgctaatttactttagtctttgcaaaaacttttctgaaaaccaaaaaggcagttaacaccttagagcttattaagttccccttttgataatattaacaatacaaagaggaaaaaagttggataaaatcacattaccatttgaatactaacttaatttttaaaatattgaactatagatgaaattataaaagttcaataaataagtcagtgggttcgttaccattaatttatgaatagaaacttgtacacaataaattctgtttgttgtttattttgtattaggtgaatattggaaatgaatctaaaatttaacacttcagaagatacatccttgttaatttattgtttgggctaaaacttgggcaattttccattctttcatttctagaatttccatctagtttgcaaaatttattttttaacaaagtacttttaatagattaaattctttcaaagtatttttttcaaaaaataaaccagttaaaatgataaacatgaatcaaaattaaattttgaaattatgtgatcactgagggctaagaattagagaaaagtaaacatcatttcaatttgaaccaccagtaaaatattttgtattgtttcttcttagtcatcctgtattccaaagaagcatcgaactattaaaatactatatggataatatgaagtgtgttttttgtgtgtgaattacatatttgttatgatttttattctttactggcgtaaaggtcaactttattagctgtactttctaaatatatcccaaaaggaagagtgatgacaatgaagttacagtggaagatcatttcatttgtaagttaaaatcacctaaaggcagatgcagctctgtgttgggcgtccttcacttgctcctccacatctgctctttttctttctcattctttgcctcaagaagctgcctcctgataattgctttaacaggtcttttcttctctggtttcctgttgaattcaaccagcagcaatctcctgcaggagagtgaagttggaatattggtttccctggctgactccctgttggtttttggctaaaggctgcagatcctctcagaggcccttgctgcaggtccgagtcccctgactttgagtagttactccctccccttccttttcttcaagcttaggaggagtaaccatttcccgccattgctaattctagggatccacatcatattccttaccccctcattaaactttcctcaatatcttttttcttgccagtatcatgctctttttcctgccaggatcatgacaactacacacattaaaaaagtatgccatgatgttgtttatgcacataagaagacttccaaaataattgatatagtaattaataatataatttttgatatgaggtaaatgatgaatccatccatttcaatgagcacactggcttttagccatctccgtaatcactaagtttctctgactgaaaggaatgagccaacatgctacagtctgcatatgttgtttatacacagttgtttatacacacttttaaagaaatattaagttacagtttatcttcagcatctaatatatccatcagttgtaatcaaaaaaaaatttttcagtctctaatgaataagcttcaaaatatatttatgaccaaccgtggttagccaaaagcacaatgccgctctattaccatgcgctgcgtctgagcggtgagtgcatttaaatagcagagagtcatcttagcagagtgcacaaaggatttgcaaaagatctcaattgtagtaagtaaactccaccactaagtgattatgtgaccttcatgaaatcacttaagctatctaaatcaaagttcctcatgagttaagtagggataaaaacctctcatttactgttcacaactagaactttgagaaataaactcaactcaactctgaaatacacccctttagtgtacggtaagttctcacttaacattactgataggttcttggagattgtgattttaagcaaaaccgtatgtaactaacgaaaccaattttaccataggctaattgatataaacaacagttaagtttctatggcatatttcgggtcacaaaaccgccaccaatcttctaaatatagacccacaagatttctaatattaaacattgagataaatgtgagctacacatgtatttaagaaagattaatacaaggaagtaagataattatttgcccaatttttggtgaatcagtgagtgatggtcatagtggtagtacgttaaatcaaggaataaatctttgcaaagcaaaaattgtaaggagcacctcttaccaccacacagttcaaaatcaaatgaaaatatagcaggcttactgagcactttttgactgcatcgtttatcatcatgtattttatgattatcatagactttgtgaatttttattttacaataatgtatattcattcctttaattattttccaacctgcttattccagttcagggtctcagggccagagcctatctcagcagctcagggtggaaggtagaaaccaaccctggactggatgctattgcactgcaggacacacacacacacactcacaatggggcaatttagacacaccaatgaacctaatgtgcatatctttgaaatgtgggaggaaataggaatacctggaacatccatgtagacctggagagaacacaaaaactccacatagacagtgacctcagctgggaactgaattttttttttctcatcagcgttatatggaaaagacgttaaacaaaacatttttcatgacctgctgtattgttcagttctactattatattacgtgtatagtgtgccagtggactggagctgccttccaacaattgtgtcttcatgtaagcatacctcaagttccactttatatcaactttcggaagaaagatcattatgggtcttgacatcatcttggcttgtccacctcagttcttatactttagaattaaggaatctgaatcccagagtggttaagtgtattgtcaaagatcacacagcaaaatagtaacagaaccaggatgagaattcaagtcccttgactaccagttcaaagctctctttaacacaaaacatagcattttattagatgtgtataaaattttacagttgacaaaatgtttcccaatgcattgcacatgtgacctacctgggaggtaggcagatatggtaggcagaataatagtctcgaaagatagccacatcctaatcctcagaacctgtgaatatgttatgttacacagcaaagcagaattaaggttgtagatggaattaaggctgctaatcaactgactttaaagtaggtggaataactcgtattatccctatgggcaccatgtaatcacaagaaagcggaaggtagaagagtgaaagtgacatgttgtaaaaaaagacttgacaggctattgctggttttgaaagtggaagtgggtcaggagccaaggaagctggaaagggcaaggaaaccgattttctcctacagtctccaaaagcaatgaggtcctgccaacaccttgatctcagctctgggagacccacatcagttttctgatctgcagaacggcaagatactaactttgtgctagtttaagccactaaatttgtggtaacttgtcatggcagcaataggaaactaatccaccaaggtaagaattgttatccccaaattgtagatatggacactagaaaactgcgttttgttttgatgcgtttaactaaaccttcccatgaatttattatttttttatggtgccaagtggggaaggtagaatatatgagtgaaatacaatcctagacctcagggaatccaaggtaaaagtacttgtatagaaataatacaaggtacaaggtggggctgaaaaacactggacaagctagcccggggactgcagatgcaagcatctgctcttgaggcagtaaattgaaacagtgattcttattactagtttctgttaaagttcctcaaactcttttacacagagatatatctgactcttagatggcagctctaaaattttgaaggccaaatttagatccaggaaacacaggaatgcacatactcacttctgatgttgtcagatattgagagggcttgggtggagccttggaaatgcactgtaaactgtaagacaattttgattcgggtggttatcagaccacacttggagaaataattctagactttttggtgttggaaggttctcagttaatttgggtttgagattacatcgatgcctctctctgagaaattgggagccaagggaatgaatgcaagttcagcatttttatcagacactccagatgattcgttggtttgcacacccagttttgaaaatcactacctacagtgaggcaagcttagacccaatgccccaatacatgctcataaaaaggtaactagagataatgaaaaacagagatgcatgctcccaaagaaagacttcacattctcactttatttcaaagccaaatggattgtaagattaaagtgacaattttcaatctctgtttgaggacaagagagccaagtttctgattagctattttgaagctcaaatttgtctggacagggtttctatctcctttaaagaattcaccatgaaaaagtcctcaagcaacaagtgatgggtagataaaatactgtaattacgatcaaagtgcaaagactctgtctatgtaattacacacttcccaacctctgcaagccactttgttccattaaaatagaatgagaaatggacatgggtgatgtgtacttattggttagtcaaggttttggaaatgacagttattaacatgtgtgttttaccataaaccataatatttgggggataacttagattgtgggaattaattcttgctccatccttatttttattgttcgccttccattctctacttaatctgactatcttatggtgaattagattatttgaagttcagaatgaattcattaagcttagaagaataaatgtaagggctcaaaatctcttgccactttcaaatttccagttcttttttctttcgtttcaaatgagtaaacctaatctgttaggttgaacagcaaacacccattctcaaattccattaactcaggcagatttttcataattgagggcaaaaccagcatcatcataatgttaagactgagaaagcattttgagtcaagaaatacaaaaccgaagctagcgtgattatttagtcagccatatggccggctagaaaaggtgtttaatctttttaaacagatgttgatttatcatgggaataaataatagaacatatacaggtttataatagtggactatgggaactctttcttttaaagtcaagtatattatgccttaagactgttgattgcatttaatttaaccctccatcaaatgctgacattttatcaatgtgttcaatttttacagcttccttaaaaacatcaaactttaaatattttatttgaaattcatcattagcttttctttcttctttattattttctggctcaaagaaacttctgtctttgcacttgaatttagtagtgtcatttacttcttaactacataaataatgaatatattattcattaaagctttcaatgaggaaatatgctttcttacaacttttccatgacactgcaactgcctctataaaaaaaattttcataagatgtatttttctattttacttttttccttttaacccttttgttatctcaggcaataaatgagacaaaatttttcaaactaaatgatgaacaatcaaaactgacgggttttctttcagcatcttaattgatactgtctaatatgataaatctttgtaccttcataagctcattttttagtaccctatagaggctgatgtggctgtaattgagaattctgcaacaaaatgtgaaatattaatgcacgatttatcttcaagttagtactgctgcaaatgtggtccattgtaaatgttgcagtcacactgacacactttttacagtcagatgttcaatcatttttttcttgctgaacaaaaggcttcagtgatgctctataaatgcactaccgaacctcttgtatgatatgcaaggtgccagcctatgttcctacataaaatgtacatacaattttacctctgtgtcttaaatgctttaaagcagtgaagtggaaagcttgtttttcccttcagcttttgacctcccttcttttcttttgctctttctctctttcatagaagctctgcattctttgctgcttgttagtacagaatatgcctgaaaaagctaaaaatattatagaacacttttttaaaacaagtccaagctttgctttgcaaaagtaaaattgggctattgtgtaaactaaactaagacactgaaacagaaacatatcaaaaatataaacacataaataaaactggcaaaacatatgccttttggattttatacgataattgtttttaatacctagcctctctgaattaagtacatttaagaagatttgtaaatagctgatctttaaataaattcataaattctatttggttggggggacaaggaacaataggagaagggaaatagttcactttcattgtaaacttagtagttgagtttgtagtttgaaagctacaaaactacttaatattgttctgcacatatttattaaatacttgatactggatatatgataagaaatttacaacttcaacatttttatgtatttgtttttactgtagcaaatttggttctgaaataatcttaattaagtgtgaggtaaaggaagatcttcgaagctcaggtagaaatataaatgtcagagcattttagatattctcaggtaaaacatactcagataaaagtaattgtgacttgctactacttatatttcaataagtatttattacacaaatgaagtgtttctaataatcatgatgccaacaaagaaaaatttagtaaaacaattgttttccatgccatcttctaggttcataatttttttacaaacaagttataatcataaatagtttcaatgtcttattcattaataaataatctaatgagcactttccagttattatgtaagtgactgcatcagtatctcatcatatctatgtaatttactacatttattatttcccttatttttgaacatttggtttggttataatttttgttattaattaagaatgttatacaaccacctttcttttgaattatttccttgggatagttcaatggtccaaatatttaaggaaagcaaacttatacatgttcaatctaaacaaggtatgtaatttacctgaattatctcatataacacagttcttaagtaatattcccagtttgcagatgagaaaaatgatgcttggagatagctaacttaaccaagggtgacctaactagtaagtggaaaaacctgtttgtactatcattctcacctgagtcagggctatctgacccaaagattttactgcttcccccacaacatcctgccacctaagaagcaagagggctgggtagtaaatgagtgtatactttttcaagtttctggaaaacattactatttaaacagtatgccaatgtattttgctaaacagttgcagctttgaatagtattatttttaaatttcattaagttaatagatgtaagatgatatgtggttttgattagcactttttattaactaggacttccgtattaactacggaaaccacaattactaattttaaaagacctcaacgtttgattttgtatttttacaaaatgaaaatgagatatgaacagcgaaatatgtagtatttattgaattttaactatgttccaggaactgttccaagcactttacacatttaactctcaaaccacctttaaaggtagttactagtattatttctttctaaccaacagacaatagtataacgtttaagagactggattcgggggccaatgcgcataggttcaaaaatctcactctggcaaatgttatacctcctaacttaatctatatgtctattttttttttcatgtataaagaagagtgataatagtagtacctacctgattggattgccttaaaaattaaatgagttaattgtacaaatgacttaagacagagtctggcacacagtaagtactacaggatgataggtcttattatttatattttatatgaagaaatcgaagcagagagaggctgtgtaacctgtcctgggtaaaagagctggtagttatgggtaggattctgatttctatcacatgttctttaatagtaagtgccttaactttcagtaaattctatatagaaatgattttaaagcataaataaaacatgacagaaaactgcaaaaactaataatttaacattctagaaaaatggtctgagtctaaagaggaaatatatttccaagtatcactcacacccttaacttaattccagacagccaaatttatttatttatttatttatttatttatttattcattttagatggagttttgttcttgtcgcccagggtggagtacaatggcgcaatctcagctcactgcaacttctgcctcccgggttcaggcaattctcctgcctcagcctcccaagtagctgggattacaggcacatgccgctatgcccagctaattttgtatttttagtagagatggggttttgccatgttggccaggctggtctcgaactcctgaccccaggtgatctgcccgcctcagcctctcaaagtgctgagactacaggcgtgagccactgcacccggccccagacagccaagtttgaggacagtctattctccctctggaaataaatgtttccattagaacccttacagacaggggcttaactttgaaaacttagagttgcccagtttggaaacttggagtcacttacttcaaaagctatcctttaaactgattaaaaaaaaaaaaccctcaatgcttttgctcccctatttctgttgataactcagaaatctctcatttaccaatttctgttactgaaatttggtgatgtggatcaagccctcctccatgaactcttgacacaatcagattaattaatttccactctatcaatgtgactgttttttccctaatgtggtacttcagctcaccatcatttctttccatctctgttctttttatcttttatgcttttgctagcttgtcttaactgaaggcttttctttctctgaaaacatctacatcgcccatggttctttagtagaagcaatgccttctgcacaaactccttttcattgcggtggacaggagaagaaactatcatattttttagacaacactgctgttttgggatcatagttgacccatggttactcaataatttcacgttttctgaaatctcaaccatcaaagtgatttactgacctttatgacaatacactgatcttcagaaagctctcctctgttacatggctccattttcctctttactgtggcatctcatctgccagttctttgggaactctattcccttttgattgccttcccacaatgttgtcttacagtccctctgccttttcagctcaagaagctcccatttccacttcaggtaccaatccacacaaatgccctgggttgttcatcattacctgaaattatcaggcccaaatcacacaatcttacactttcctttctggccactatctcctctctcatacccccagcttgcaccaagtcccttcccctctctcatacccccagcttgcaccaagtcccttcccctctctcatacccccagcttgcaccaagcctgttccttctgcacaccctcacaatcttccctgtgaaaatttattcccttcttcaaagtttgtcttaatttctatttatttcataatgtattttgtgcatattcacttatgagtttctgttcacctactagaccctactacttaaagtgaaatgcatagaataatacaaaatgtggggcccacatcagtcctactaaatgagaatctgcattttatttatttttattgtttcaatagttttgggggaacgtggtttttggttacatggatacgttttttaatgctgatttctgggattctggtgcacccatcacctaagcagtccacactgtaacccaaaagtgagtagtcttttatctctcacttcccaaccactcttccccttgagtgtccaaagtccatatatcattcttatgcctttgagtccacatagcttagctcccacttacaagtaagaatataccatatttgattttccattcctgagttatttctcttaaaataatggtctccaattctacccaggttgctgcaaatgccattatttctttcctttttatggctgagtagtatcccattgtgtatatacaccacattttcttttttttttttttatggtgaaatggtacttttatattggaccctaccttttcccacccaattcagtttgagacagagcaacagaggcactgtaagggactatggctgtcttcctcgatattcagacatcctagtttccaataatttgttatgtacctgttacccatgaatcgatataaacctattcatatttagggattagtttccacaagtactaagttgaatttccttttatttgtcctaaaatgcttactttcaaacttgaagggacttcaattattccatgtagttttcaataatattcttttatcttttcagaccagagtcaaaatattcgtacagtattcatactgcagcaccttccacacaccctttggtctcttgaactgcccttctttggttccttttccactttcagatctttcttgaagtctagtaagcagaactgtactgggtattccagctgcagtttggtctgtcattgttggaatgacttctgctactccatggtcttccagctggtctatttctaggattatatgatcttcttttttaaatttttttttattttttattgtgttttttaatttttttattatttattttattatactttaagttctagggtacatgtgcacaacgtgcaggtttgttacatatgtatacatgtgacatgttggtgtgctgcacccattaacttgtcatttagcgttaggtatatctcctaatgctatccctccccactcccccaccccacgacaggctccagtgtgtgatgttccctgccctgtgtccatgtgttctcattgttcaattcccacctatgagtgagaacatgcagtgtttggttttctgtccttgtgatagtttgctcagaatgatggtttccagcttcatccatgtccctacaaaggacatgaactcatccttttttatggctgcatagtattccatggaatatacaccacattatccactatgttggttgatgggcacataagctgattccatatttttgcatttgtgaattgtgttactataaacatatgtatacaagtgtctttttcatataatgacttcttttcctttgggtaagaatctgtattttaacaagaactcaaggtgatttgtgaacacattcaatttgagaagcatggatctaatccagtggttcccaaggtgtgatcccaagagtacaactgtagcacctgggaatagtattagaaatgcaaattctcaggtccacatgtgtactattgaatttaaaaacttgaagttgtagttcaacaatctgtatcttaacacagttaacagggaattctgatgcacatggaagtttgaaaacctgaccatacaactgacaaggggaggggttgtcttgttaattttggtcttctctgtaggtgtagggtatgcgttttacaaatgcataggaagtgaccgagcaaatggatgaatgaatgagtgaaggacgctcttgcttatctcacagataatatgtattgttttcttctctgatacaactttatacttcacatatggtatttacatttacttacttcaatgactaaacttttaattatttctggatatacattatagctaacattgagtcatgtatattataaatattcaataaatgtctaatttgattgaaataattctattatacattcttctacttttggtcccacccccaccaccatacacctttccctttcacgacacattgcttcaggccaagtgaaggaacaaacacaagatataaggcaggtgggaatctgacctatagagatttgtcttctcataataacaaaaatacatcttaaaaacaaagtcgaaaataaaagtgagaaaagcaaataaatctggtttgaggctacacgtagttgctggccacacccataatttattcttttataaaatgcctttggttgccatgttgaatcatgtgagaacatgtggagtgcaaacactgttggaaacaaagggagcttgggtctgaaataggcttttccagtcataagagaatgccacgattttcattgctcaaagcatgctgcttagtttcaaccagtgaaatgaaatcgtcaggctgggtaactaatggtgactcttggcagcagtgttttgtggatccttttcattgaacagggacagactataaataatagcatttgtttagcacttggtcgcttccaagaactccaacagccttaacaaatagacatcagtgttctttgccagctcacaggtggttagtttttaatacccggtaaggagggttgctataagtagatagcaacacgaatgctgatgaggtccttcagtttaagaccttaggctaacagtgactattttgtcattctaggcttttcttaattagtcataccctaaaccagtaggtcttccctggggcactaaaaatgtccaaaagtatgaatatctgcgttaaggcaatgattgattaatatatctaagtttcgtgatgaacagttgaccaaagtcactaaatatgactcatatttcagcaacctacctctaagatggtccaactcaacaggtcctcctctggtgccttcttcagtcatacacaatgatccagagggttgacagaggatccgttgattatatttatctggaaagccattgcaagctctacgtggattgtttttagggagatggggggatatctctcaggaaacctgacatcccttttttcagttacgtcatgctataagatacgcaagctgtctggtcattgtgtatgcagcccttgtaggaagaccgaagccaaattatcaaagaacattgtcttaaagaaaaaaaaagtaaaacaaacctctaccctgccttctcccatccatcgctatagatgtttccatgaatagaaaatttagtaataaaaatcatgagattcaaaacaagtgactaaaaagtatgcgtacattttaaagataatgttatttatttcacttgcaatggaaatgttgcttcttttgaaagcaatcactattaagagagcctatgatatagactgtatttcgtaactaagattaaagatttcacatagaaagattaaataaacgaatttcaaaagattttacagtaatgttttttaaagatatgttattacaactggttactccagtagaagtatgtaggctctgtaattttaagaaagcatatttataatatagttttaaacatttaaagaaaccaaaaataaagaacaagaagtaatggaagaggaggaaagtctttaaatggtagtgtgtgttcgaatgccatggccccatatttattgcaacctgacccccttcccttcacacattctcaattcctagtttcttatttatgttattttgtccatataacacacatcacctttgaaaatacaatttagtttacttttttattatgcttattgtttcttatctgtctcttcactttggaaagtaagctccatggaggacagacatttgtctactttgtgccccaattcatcccaagcacctaggccacaggctggcacacagaggtgctcagtcaataactactgactgaatgaattacggagaaatcattaataaataattcttggtacatttacttatattgcttttcctgaccactgggatacaatttcttttaaatgagtgaaaaacaagcttattgaaaaaaagaaacttttctctctcattaggataaatgaatcttaacaggattgagtaattaactccaaatcacaaagctggttagtgggagaaccaagacttaatagccagaatgtcacactcagaattcagtgttcttcctaaatcttaccattatcctgtttatacgtctagatatcttgtttgctcaaatccctcatagtcgtttaggactttgtcatgtaaaaccatttcacatatagtatttgagccatagaactattattagtttcattttatagataaagaaactgaaggttagagtgttaatgacttgctgaagatcacatagatgcctaattaatggcaaaggcaggattaaattcctggaatctaatcaaatagccttgttgttattacatagttctctctagttactgttcattttaaaaatgtactaagcaccatctatgggctaagccttataccaggcactagttagcaaaaagttattcatgctattatggaagtgtatcttcagtccataaatgaacacatgatatattgggtggtggtaagtctctgcataaaaatgaggaaaataacagatatatacagagaaaatgaaagggttgaaaacgatgctattcacaatagcaaagaaatggaatcaacataaatgcccatcaatggtagactggacaccatggaacactatgcagcgtgaaaaagaatgagatcatgtcgtttgcaggaacatggatagaactggaggctattattcttagcaaactgatgcaggaatagaaaaccaaatagcattatgtttcactcataagtggaaactaaatgatgagaacgcgtggacacagaaatggaaacaacagacactgggaccaattgaaggatagagggtgagaggaaggagaggatcaaaaaataataattaatgagtgctaggcttaatacctggatgatgaaataatatttacagcagagccctgtgacatgagtctacctatacaaccaacttgcacatgtacccccaaacttaaaagttaaaaagaaaggaaaacagtgctatattaactgggatggtcatctaataaggcctgtcagattaagagactcaatgaattcaactgcattttagagatctgagcgacatggatctgaggggaatgaggatggaacttggtagagaaagagcattccagacaaggagtgtaagatcagagtggctggaacagagtgaataagaacagggaaataggagaagagagcaactgatgaggaacagggatgtgacgtgtaggtaaaagtaatgattaactttttttcaaaggattttattgtctcatattttaaagaatgactttgactctatgctgtgtaggaaataaatgtatagaccaagtttaggggctattgttctatatgagaatttatggtgctatgtactaaggtggggaagcatggtagcatcaagcacacatttcaaaagttgaccaatggaatagttgacgtttacagagattgacctcacttaattcttgggtgtcatccataggagggcatctggttttcacagcatggcattaccttacctgagtgaatatatgtcaatccaaagctggttctcagcttagagaacttggaagcctgatatgtccgcaaaagatcaatttcttgtttaacaaaacactcaaagattgatatatgagaaggagaaaaccaatcaatgcattacctcttacaataagaaatgtaatttatcttgaataagcttctgttgattgatgagtgatatggtttggctgtgtcccccgccccaaatctcatcttgaattgtagttcccataatccccatctgttatgagatgaaccaggtggagaagattgaatcatgggggcagtttcccccatcctgttctcatgatagtgagttcttatgagatctgatggttttataaggggcttcccacttcactggacactctttcttctccttcctgccaccatgtgaagaaggatgcatttgcttcccattctgccatgattgtaagagtccaaaggcctccccagccatgctgaactgtgagtcaattaaaactatttcctttataaattaaccaaatctcaggtatgtctttattagcaatgtgagaatagacaagtacactaaattgaaaccagaagtggggtgctgctattaggatagccaaaaatgtggaagcgactttggagctgggtaacaggcagaggctggaacagtttggaggactcagacgaagacaggaaaatgggagaaagtttggaacttcctagagatccggagggctcagaagacaggaagatgtgggaaggtttggaactttctggagacttgttgaatggctttgaccaaaatgctgatagtgatatggacagtgaagtccaggctgaggtggtcttagatagagatgaggaacttgttaggaactgtaatagaagtgactcttgctttgctttagcaaagagactggcagcattttgccctgccctagagatctgtgtgacattgaacttgagagagattatttagggtatctagcagaagaaatttctaactggcaaagtgtccaagaggaagcagaacataaaagtttagaaaatttgcagcctggtgatgtaatagaaaagaaaaacctggcagagccaggtgcagtggctcacacctgtaatcccagcactttgggaggccaaggcaggtggataacttgaggtcaggagttcaagaccagcctggccaacatggtgaaatccaatctcttctaaaaatacgaaaattagctgggcatggtggcagaagcttgtaatctcagctacttaggaggctgaatcaggagaatcggttgaacccaggaggcagaggttgcagtgagctgagattattccactgcatttcagcctgggcaacagagtgagattccatatcaaaaaaaaaaaaaaaagtaaagcaaagaaaaacccattttggggggagaaattcaggcccaagctggctgcagaaatttgcataagtaacgaggagccgaatgttaatcactgaaacaatggggaaaatgtctccagggcacatcagagacattcacagcagccccttgcatcatgggctgggaggcctaggagggaaaaaatggtttcctgggctgagtccagggccccctgctctgtgcagcctcgggacatggtgctctgcgtcccagatgcttcagctccagctgtggctaaaaggggaaaaggtacagctaaggctattgcttcagagggtgcaagctccaagctttggcagcttccacatgttgttggtcctgttggtgctcataagacaagaattagggtttgggaacctccacctagatttaagaggacgtgtggaaacgcctggatgtccgagcagaagtttgctgcaggagtagagcctcatggagaacctctggcagagtggaagggaaatgtggggttggagctcccacacaacatcttcactgggccactgcctagtggagctgtgagaggaggacccaaaatggtagatctacttacagcttgcatagtgcacctagataaaccacagacactcaaccccaaccatgaaggcagccaggaggggggctgtaccctgcaaagccacaaggtggagctgtccaaatccatgggagcccacctcttgtatcagcgtgtcctggatgtgagacataaagtcaaggagatcattttggaactttcagatttaaggactgccctgttggatttcaaccttgcatggggcctatagctccattgttttggccaatttctcccatttgaaatgggtgtatttacccaatgcctgtacccttattgtatctaggaagtaactagcttgcttttaattttacaggctcataggcagaagggacttgccttgtctcagatgagactttgggcttggacttttgggttaatgctagaatgagttaagactttggaggactgttgaaaagtcatgattgtgttttgaattgtaagaacatgagattttggaggggcacagtgcagaatgatatggtttggctgtgtccctactcaaatgtcatcttgaattttagttcccataatccccacgtgtcatgggagggatcaggtggagataattgaatcatgggagcagtttcccccatcctgttctcatgatagtgagtttgttttcatgagatctgatggttttataaagggtttgccactttgctgggcgctcattcttctccttcctgtcaccatgtgaagaaagatatgtttgcttctcctactgccatgactgtaagtttcctgaggactcccagccatgtggaactgagtcaattaaacctctttcctttataaattattcagtctcaggcatgtctttattaacagtgtgataatggactaatataatcagcatgttctttttctatagatatagaggacagaaaattaggtccagaatgttgccagataagtatggcatcgcagaaaataggaaataaatggagaatttaatagcatgattcatccatctacctatagctaattccataaagatatacctattaaaaggaccatatagttactcatgttcttggtccagaacatacatatgccaggacagagtgggagaacctagagtcaggatatctctttctctcttgtggtttctcgacactgaccaaagaccaaaacatccttcaacagcctgactagcacatttgtactttagatatgttaatatatttgataggtttcattctatttttaacctgaaattaatccatctgtttgatgactttgtcaatcagatccagtgtttatatatttttcactcatgaggacaatcaatcttatttctcagtttctatgttgtaaccattatatgtcacaattataaactatgttatgtaattttcctagatttctactaagtagacttatctgctaatttcagctggttgtaccaaaacaagtgcagtctcttttcaaattttagtacctgcttttgctttttgttttaaattactctacttaaactaattttcctcatgtgtcagttgagtcaacctaaaactagacctttgtgaatatatggcactcaatctttcataaactgcaattgttaaccaaagattcagtcagtatttaattttcttaaagcttttctcacaaaccatatttaacttataataaaggtgcttgtctagttttccataatctttatatgtttaagggattaaatctaaacagatttcttactgtttgttatcttagcaccaaaccagtgttagagagaagcatcttgagtgtttcatggggtcctaagtgcttaggggagaaataattgaatttcaattcatcttccactatggctgaagagatttaaagattcaaataatgactagaacctctctcttcatgcatttatgttattctcagtaaatactgtatacctagtctcccatttatttgtgagacaagtttgtacttattagcctaagctgagaaaacatgtatctcatttgccagtaaaatgtcttaaagacaaaaccagttgaagtatcccactaaacatttgaaacaaacatttaagtaaaagaatgttaataccaagccttttgtaaaaaaaaaaaagaaaaattgcaatcattacaaataatcaaaatggcaggactcatggcagaatgaaaaaaatatatagattattaaactgaaatgtatgtgaaaaaatccattttcttccacaggctataggacaagaaaaccagtctggctttagattaactaattattttgtttactggctttgatattagaactaaagaagctcatgttactatttaggaattttactaaggagtaaaaaataaacacatttttgatgttatacttttattattgcattaattaattttaagaagtacttttcaatggaatctttgtggtagagatgtattaccaatgtttaccttgggatagcctggggttttcagatatgctaaagttataatggctttttacaaaaatatatttaaaaaccctaaaaaatgattaatggaatatgcaagctgaaaaaaatctattaattacaaagcccttttacatatgtatgaatgacccagttatgtagaaatttttgtgtgtgctgagtttcactcagatttcaacataaaatctcctggctcaactattttgccatgtcattttattttccattgtaacatgccctcaatgtaatgtcttgttcaatgtgttgagctggaagggattttaattaggttagaggagagaagccaaattttaggttttgcattccactgagaacacctggatggaaatatcacggaacagttcttgaactatataggactctgcagtgactactgcagtgctgttaagtcttgatcatcggttagaaagaaacgccataattaatctctttatggactcacagaatttgggagaataaaaggaagactggagatcatttttgtttatttttagtctattggaacacaatgtaaatgaaaattgagatctctgcttctataaaagttttaaaaaattattttaggagacttcttggttagccctaaaatgcaaggagcttggaggttgtcactcctcttacgacaagaaaaagctggacaaatcaataactttttttgaacccaccagaaaacagagactgtaggatgaatggccacaaacaaatctggagagtgggcgtggtggctcacatccctaatctcagcactttgggaggccgaggcgggtgcatcacctgaggtcaagagttcgaggccaggctggccaacatggcaaaaccccatctctactaaaaatacaaaaattagctgggcatggcacatgcctgtagtcccagctacttgggaggctgaggaaagagaattgcttgaacccaggaggtggaggttgcagtgaggtgagctcatgtcactggactccagcctgggcgacagagtgagactctgtctcaaaaaaaaagaaaaaataaaataaatctggagagacagatgcacatagagaaactgcttagctagaacagaagccataaagtggtaagaacacttagttggtaaatgtgataaattgtttgaggctgtgtagactatctatcttaacagtgagaaaccccttgacacttcagtcttagaaaaaacccacacattgttgggcttttctgtcattaacccatcaggttctcactgtagggatctgagtacaagagaagaggaagtggaacttttgtgaaatatacacagaattttttcataaccccacaaatgacctattatccataagaaaagacattgacagggactcattgcttttgggagaaggaaattcttcctgactcttgccttatccaggtttaatgccttagtaagaaagaaaaataacataatcaacaagattgtataataattgagaataaacaaacataaaatatttactttttttatccttaattggcctgaaagaaaactgtttaaaacaatagtaaataacaatgtattaaatgattaaagtgtatagcagggtgaaatgaattacatcaatatcacatgggatgagagaagaattgggagttctctattataagagaacatgtactacccataagatagtgtagtgttatttggagacagacttagattagttaaaagtgcatatttcaactctaaatcactaaaagaatgtttaattgcaatttttacataaatagaggaggcaaaatggtcttatataatatgcttagttaaaaccaaagaaggcataagggtatgtatgggagatggggaacaaagaacataagcaatgaataaaaagagtttcaaacaaggtaagtacaaatgtacctcaaccaatcatcacattaaatgtgaatggtttaaacataccaagtaaaagacagagattgtcaggatagaataataaaaaacaaaagctcaaatataagttgtctgtaaaaaactcactttaaatacaaggacagagatattttaagggtaaagagatataaaatatatgccatgctaacactaatatagaacagctatattcataagggacaaaaaacagatttccaaagcctgaggaccacatggtaacaacaaggttaattctctaagaatacatagcaacactaaatgtgtatgcacctaacaacatatcaccaaaatgtatgtctccaaaacagaaagaagtgaaggggaaaatagacaactttattattagggtttgaaattttaacaccaaaaattggaagcaaccaagatgttcttcaacaagtgagtgaataaactgcagtgcatcccattcatacaatgaaatattactcagcaaaaaaaagaaaaaatattatgaagcatgcaaaaaaaaaaaaagacaacaagaatctcaaatgcatattgctaaggggaagaagccaatctgaaaagtcttcatactgtatgattgtgattttgtgacatgctgtaaaaggtaaaactatagagctaagaaaaagattacatgttgccaggggtttggggtaaagggaaaaatatttaatagaaggtacataggagatttatttttgggcagtgaaactattctgtataatactgcagtgatgcatacatgatattatgaatttgtcaaaaccaagagaccattacggcataaaaaatgaacctcaatgtatataaattttgtgaaaatttggagatcaagcattctccagtggaaggcagaatggggtaaaacagttttacaatattacagattagtgaaacaacctcactgaaggagatgaaaaaggtgctgacctaagtaactttagaaataaatagagactataaaatgaagacaaaagaactagacataaaaattgcactctctttgatgaagcttttacctgtggagatacaatttaacaatattgcaacaacaaatgtatactggaattgaacaattaaacaaatggatggtacatggtaagaaccatatttatctattggagtaggagattacaacagataagcaatgaaagaaaatgagagtgattcatgtggtaatggattagagttacagacatcagtgtgaatttatttatgtttaccttgtattagatatggatggttatatatagaaatatcaatatgcatatgttcaagtgtttgtatactttcatatttccttgctctaccaactgatggcctcggaggagtgatgtcccaggagcaaagggcatattccttgattctaggactggtacagaagcaaggacacctaagtagttacaagcacactttcatccagaatttgatttctaatactagcttcttatatctgttcctactaccagagcttcttggaaaagtggcaattctcaaactagggtaagacatatacaagataaaactgatgcatcctgtgttttcaaaaagtaaagcgtttctaacaacagaaacaatccacaaaacataataacggggatatgtcagtggtacaaaggcaccaactgaagagctcccaacccacaaaaagggaatgatttcagtaacaaaattaataaagtagtattgggttgtaatacaaaatattaaatgaatattcatgattccacactaatatgaataaattattggataagcaaattaatataggagaatagaaatacttgaagaaagggatttcaaataatttttgtagatattctgccctcaagcaggtgaagccctcactccttaagtacgggctgcatgtagtacttccaaccaaaaatacagcatagaaaggggaaaaaaaagaagaacttaaaagtgagaaactttgcaaacactcctcagacaggtgatcaagaaaaatatcaacagtgacaattcaagtagatagtatgtagccttaacaagatgtagtaaaaatggctttgatcccccttggttttcttttaaaaatccataacgctaattctaatcatgagaaaacattagacaaatttcagttaaggggcattctacaaaatgtgtgactagtgctcctcaaaattttaaatgtcatcaaaacatggaaaatttgaaaaactgttgtaactaagagccaaatgagatatgatgaataaacataatgtggtatcctgtatggaatttaggagaagaaaaaggagataagcaaaactaaggaaatatgaataaattatgggactttagcctatctaactcagttggtagagaatgagactcttcagttatggactttgataataatgtatcggtattggttcattaattgtgacaaacgtacatactaatatatgatgttaataatagggaaactgagtcagggtaaagggaaactgtcctatctttcaattgttctgaaatataacgctattctaaaataaaagtttattaacttatttattcatttatttttaattatttcaacttttattttagattcatggggtacatgtgcagttgtgttgtatgaatatattgcatgatgctgaagtctggattatgattgattccatcacccagtacccaatagttcatttttcaacccttgccccatctctcattccccactctagtagtcaccagtgtctactgttgccatctttatgtccccgtatacccaatgattagctcccacttatacatgagagcatgcagtatttggttttctgttctgcataattcacttaggataatggcctccagctgcatctgtgttgctgcaaagaagatgatttcattctcttttatggctgtgtagtattccatgttgtctatgtaccatattttctttatctaatccactataatgggaaccccaaatgggcaccttgattaattctgtgcctttactgttgtgaagaatgctgagaggcacatatgagtgcatttttaataaaatatttttttcttttgtgtatgtactcagtaatggaattgctgggtcgaatggtagttctgttttaagttctttgagaaatctcctaattgctttgcacagtggctgaactaatttacattcccaccaacagtgtataagcattccttttactaggcagcatttgttactttttgagtttttagtaatagaaattctaaatggtatgagatggcatctcattgtggttttgacttgcattttcctgatggttagtgaagttaagcatgttttttcatgtgtttgttggccacttgtatgtcttcttttgagaagtttctgtttacatcttttgaccatttttaatggattagttggttttggtttttccaattgtttaagttcctttagattctagatactagaccattgccatatatatagtctgtgaatattttctcccattatgtaggttttctgattactctgttgataattccttttgcttcacagaatctctttagtgtaattaggttccacttgtcaatttttgtttttgttgcaattgcttttgaggacttcatcataaatactttcctaaggctgatgtccagaaagatgtatctaagttttcttccaggattcttatagtttgcaatcttaaatttaaatctttaatccgttttaatatttgtttatgatgaaaggtagggggtccagtttcatcttctgcatattggttagccagctatcccagcaccattgattgactatggagtcctttccgcatgcttatttttgttgattttgtcaaagatcatatggctataggtgtatggctgtctgtctgggttctctattctgttccatgaatgtatgtgtctgttttggtaccagtaccatgctgtttttgttactgtagcatgctgttttggtcactctagcctatagtttaaagttgggtaatgtgatgtctccagctttgttcttttgcttaggattgctttgaattttcaggctctttttttgctccatatgaattttagaatagttttttctagttctgtgaaaaatgactttggtagtttgataaggataatgttgaatctgtagattgatttgggcattatggctattacaacaatattgattcttccaatccatgagcatggaatgttttttttcatttgtttgtgtcatctatgaattccttcaaccgtgttttgtagttctccttgtagagatctttcaccttcgatgttagatgtagtcctaggtatttttgtgtgtgttcctattgtaaatgggattgcattcttgatttgctctcagcttcaacattattggtgtatagaaatgctactgatagcatttctatcagtgtaactatacatttattttgtatcctgaaactttactgatgtcatttatcagttctcaaagccttttggtggagtctttcgggttttctaggtgtaaaatcatatcagcaaagagagactttgacttcttccttttctatttgggtgtctttcatttctctcttgcctgattgctcttgctgggactgccagtattaggttgaatagaagtagtgagagtaagcatccttgtcttcttctagttctccaggaaaatgtttccaatttgtgcacactcagtatgatgttggctgtaggtttgccgtagatcactcttattattttgaggtatattcctttgatgcctagtttcttgagggattttatcatgatggggtgttggattttatctaaatctttctccacatcttttgagatgatcatggggtttttgttttgaattctgtttatgtgttaaatcacatttaattgatttgtatatgttgaacccagcgtgcatcccagaaatgaagcctacttgatcatggtgaattaactttttgatgcgctgctggattcaatatgttggtattttgttgaggatttttgtgtctatgttcatcagagatattagcctttagttttcttttttcattttgcctttgcgagcttttggtatcagggtgatgctggcttcatagaattagttagggacgagtccctcatgcttgatttttttgaaatagttttgatagaattggtaccttgccctctttgtatgtctggtagaatttggctgtgaattatgtagtcaggcttttttggttggtagaatttttaatgccaattccatttcagaactcaatattggccacttcagagtttcaatttcttcctgcttcaatcctgagaggttgtgtttctagaaatttatccatttcctctagattttccagtttgtgtgaatagatatgtttataatagtctttgagaaacttttgtatgtctctggattggttgtaatgccaccattgtatttttgattgcgcttatttggatcttctctcttttttctttgttaatctagctagagtctatcaatattgtttatcctttcaaaaaataatttttggttttgttgattctgtgggtgaattttggggtctcaagtttcctaagctctgctctgattttagtcatttcttttcttgtgctaattttggggttagtttgtttttgtttttatagttcctttaggtgtgatgttagatcattaatttgaggtctttctaacttttcgaggtaagtgtttagcactataaacattcatcttaatcctgcttttgctgcatcccaacgattttggtatgcagtgtttctgtttttatttatttcaaaaaaacttttgacttctgccttaatttagttgtttacccagaagtcattcagtagcaagttgtttaatttccatgtaaattgcctagttttgagagatcttcttggtattgatttctacttttattccactgtgatctgagagtatcgttggtattatttcagttttttttaatttattgagacttgctatatggttaagtatgtgtacattcctctaatctgcacacagaataaaagtttatttttaaacaaataggcttctttctacacttgagtggaagatcttctgaataaacatctagtgtttatgttcttcataatatgtagaatttatttaaaaaacaaattattaggttagctctgtgtttcaaatatatagtacagtatttcaattccttaaataggctgattgtttatcttagtcattgaaagaaaaaatataaataaatatatgacttcacatctctactttcaatttgtcttttatggggatgaagagaacatgttctttcctctattttagtttcttaaacatttgtggatatatgttacagtttatgaagcataccaaagataaggaaactgttggaattctaatttgatcactaattatttatataagattaagagagtctttctgggacttatttttgtttctatgtatataaagtggtctgaatagattaagtgattttaacttattatgtggctttcataagtgctctgaatttttttttgcaaatttaactattgcaaaataaacattttagagttttgatcatatttttaaaattatcagttacccacaaagtggttaagatcctccggtcttactgatgtttgtagctggggtattaattctgtagagaccttgaagatggtgctctgactactgttgacaaatatcagtaagtatcaaaatacttttacgacattgagttctgtacaatagtgattatagttaaaaatataagataggttctggaaggacttcagagttatcaagaaccatggagtccttaccatttaagttctttttcatcaatgaaagaaattaagacccagaggaaaagatttatagaaacatcatcttaaagcatcttatagaatcatttaaagtggttatgctatcctttgctgtccacaaagatgagctgctataatttcagtacaatttcaggcaagatgaactaaaacacctaattcataatttaagtggcttatttcattcattcttttttttttttttttttttttttgagacagtgtctcactctgtcacccaggctggagttcggcagtacaatctcagctcactgcaacatccatctcctagattaaagagatcctcctgcctcagcctcctgagtaactgggattacaggcacatgccgctattttcagctaatttttgtatttttagtagagacaggatttcaccatcttggccaggctggtgttgaactcctgacctcaagtgatcctcccacctcagactcccaaaatgctgggattgcaggcatgagccactgcacctgacctgagccaccgcacccagccatttcattctttcatttttattcttaaattcacttacgcatttagcaaataataatgttgtaatatatgttaagcttagtgttaggtgccttggacacagaaacaaatatatatctattatttcttgagtgtctactaagtgctttagcgtaattaacttccaaaacattttaaatatctaaaaacatggagactgggaaaaagtacattacttatccaaacctctacagagagtaagctgcagattagaacttaaaacttaggtctgacttccccctaaactatatttttgtcatctttcctatccccccaagccctgcctttaaagggtttaagagctttttggtaaaaataggcacttggacatgtgaacagcaacaggaatatcacaatacccagcaaagaaatttaacataaatctgacataatttattgcatgcctatctcgttactaaaatcttttgtaaattttaaatatgaagggcagtactatgctcaaaattacatagaaatattttttcaaaaacattcaaaatgacaaactttaaagctagagatggtcggtctttggtactgccatcctatttcctaactgaggaagataatgctctgtgatgcaacatgcattgcagcatgccacattgcatagacatctgaatcccacaggaaccagagcctgagttaaaaaagaaaacagtgactcagaattcaagacttctggccttagttgattcaagatgtcattttttcagtttttattttttttcctccagatcaaatttcagtaaaatgtgacagtaagactttattgtatgtgcctcttatttctcctttagtttataaaatattttggtgttctctgactattgctgaattgtatgcttggatattaaacataataaagttccatctactttcataatgaatgaaatagtagtatttgtttttatgtaatgtttaagagaatccatagccttttatgtgtgtagatggtagaaagctataatttcactaaaagcagaagagatctagctggtggggagacagtgttgtatcggagctagcttgtacctgctcataccatctggttattaaatattcaggaattttacaaaccaattgtgaaatatagccattattaaaaaataaactgtatagacttataactaagtaaaaatattagaatgaaagcataaataaccaaactcatcacttcttaattcttttactacatcttactattacctgtgttctcattattttacacttactgcctttgcatggtaaaacgactccttatgagagtgtactaccacccgtggttttcttcactctgtgttcagtgacataatttttgtagcttaaaattggccatgttgggagtatttatgctgtagaaattgacttatgctacggttcagggatttttatctcagatatccagttgttaaacatgtgtcagcatgccactgagaatagaggaatatcacaaatattgatcagcttctgctattcacaaattcaaccctacttcaacattataatctcgtgttcaaacctgataagctactttttgtcaggatcaggtcctagtttggtatgttttgagtaaaattcccaaatagattagagtatatgtagtttgaggatgaagtgaatgtaatatttgatgttattgatatttgcaactatgaggggatatatctgaaggcaaaacctaacatgcagaggatggctgagcaggaagaagagtgaatccttgatgatgatattgaatcacaacactaattaattctggagtcacacttcagccaccttgtcatgtgaaaaatatattctttaaagccacttttaattgtggtgtgtattatatgcagcagaaagtaacctaactaatacaccaattacccattttatagataaaagtcagctaattcctacagccacgacatttaggaaagttcatgtaaggtcttattagcacttctattttaaaggcttgtcttttttgttttttaattttaagcataactttaattatagcttccagtatataaaagcattatttgaacctgggtcaacatgaaatgcaaccagaaactttaaaaaagtgtaagcactgcaaatatatatttgtataataatgggtactgatgactacgatggatatctaatatctaactgaaaataaatatagttttccttaggaaaggaaaagacatcagaacccagttattcaaatacttacttaggcctttcttaagtaggggaggttgtttatagccataagatacttatcaaacgtaataaataagcacatttccaattataaactaatgagtagattttattaaacattattcttacaattccttgaaaactctagtagttatagaaagagcacaaagtattctgattttatgcttttaaaaatgtgaccctttaacagagaaactccacttaggtttaataagacatatttgacattctactatcattcaaaacccctgagattggttacacaaaagttatatcaactaatacaaaaataatgattatatgaagttatttattctgtgtaatgaacaaatactaattaatgaaatagacttatactgtaattatgactttttatattctagcaaaaacaatgaaattgggaggttttaaattcaacctatagtctgaaatccaatattattctagcaaaaggagagaaagagaatgaaatagagaagagacagatgaatattaagaaatgatttagaataggtaaacagtaaaatagtaataaataatacaacattggttaatatggcagttgatttaccttgtgaggtgtcaaaaatctgaaaggtagctgaagaaacttttggcagtttcttggaagaagtgagtaattcattctcctaaattcaagcttagtgtatatgggtagttctcaagtaacatgaaatgagtataatactatcactggcttaatatctactaaaagggaaattgtgtgtatgtatgtaaatgggtttacatgcatttacaaaagaatggattggatatttttaaatgacagtagaggaacttatacttgtgaccatatataaacacactgatattggacaaaatatataagaaaacttttcaggccttgaacaaaagacagcacaggcttacagtttttgaaaaaaaaaaaaaaaactcataaaagtgtgtctcatgattgaacctactctctgcctgagaacaatttcctaaactgtgaaagaaggagctgacacacaagcatagcacgacagtcccactgaagctaaggcagaagttagaatttttttttttttttttttttgagacggagtcttgctctgtcacccaggcgagagtagtacagtggtgcaatctctactcactgcgacctctgcctcctggattcaagagattctcctgcctcagcctcccgagtagctgggattataggcacccgccaccacgcctggccaatttttgtatttttagtagagacagggtttcaccatcttgaccaggctgttctcaagttcctgacctcttggtctactcgcctctacctcccaaagtgctgggattagaggtgcgagaaagtagatttaagagttgctgaaggaggtagaatctgtggactagggcaccagagagcagggagctaatttgagtaggaaccccagagtttgtgtgggagctcttgtagggtgtctggctatgggataatctttacaagctcaggaagagactatgggaggctgcaaagcaaataagtactaaagacttgagagtagaacagaagctgaagattgcatggttatggaagaacccaatgccccaactcagctagagtgcaaaaatcttattaatatcctgagtattcaactgagacatcaagaagttcattccttaagtatagaccatgttctacagcaagagacagcaaatgttttctgaccctggtccctataatctctgttccaacttcttaaccttgcttttgagatgtgaaagcatctatagaaaatacataaataaataggtgtggccatgttccactacagctttaatcataaaattaacaggtatcagtcgagatttgacccacagaccatagtttgctgaccctacccaagagtaaggcctatacaacacctccttattaaagcgtaaaactcagctttgacaatatccacaggaagacagagtttagaaattaagccgtagcaagttacaggggcttgagaaaaaaaattaggcattgcacagatatgttcaacaaagcataaaactaagcgaatacaagtttaaggtaaataggctatgatagagctacttatttgaacaaaaatcagcaattttctggaaaaaaaaatccaaaatccagtttatctaaattacatcatccaagatgtccagtataaaattgaaaaaattaaataaataaaaacagattttaaagtcatcctgaggtttaatttatcaaataaaaacttaaaggaaactattgttcatttcaaggaataaaatgaaaatatgcttttaatgttatatagatgaggtatctaaacagagacatgaaaaatataaaagcaaatgaaatagaaaatctacaacaaaaatgcagtaactaaaatcttaaatccatatgagctttacagatgactgaaggtagaaaaagaaagtgtcaatggatttcaaccaaataaatagaagttatccaatgttaagaaataaaaatattgaagaaaatataatagcaactcaagcatacaggacaatatcaaaggatcttagcaaatgtttaactaatatcctagaaagacaagtgagaaaggggtgaaaaaagtatttaaagaagtaatagctggctagacgtggtggctcacatctgtaatcccagaactttgggaagtcaaggcgggaggattgccagaggctaagagttcaagaccagcccaagcaacacaaggagaccttatctctaaaaacaaaaatacataagtaaataataactgagatttcccccagatttcatgaaaaacatttatttacaaatccttaaggaactcagaaaaaaagcaaacagaaaaatacaaagaaagtcacacctaggcatatcataaattcatttctttaaagctaaagatgaaagaaaccaaaaaaaaaaccttaaaatccaccagagaaagcagaaaaaacaattattcagggaataaataatataaatcatgactgacttctcatcagaaaaatggacaccaaaagataatggaatagcgtcttttaaatagcaaaggaatgtggtggcagttaggtcagttggttggtgtggtgctagtatatagcaaaagaaaaaaacaatactaacaaccaaaaaacctgtaaaacttgattctatgtctagtaaaaatagttttgaaaaacaatagcagaatgaagacatttatggtaaacaaactgaggataatttgtagttagcaggtgtgtactacaaaaaaaaaaaagaaaaatgttaaataattttcttcaagctaaaaggaaattataccagacaaaaactcaaacctacaggaaataataggggacataagaaatgataaataattgggcaaatagaaaatgttttttgtttctcgaattttcctgaggaaacaactgtttgtatgaagtaaaaataatcacactgtaaagtgggtttataaaatctgtaagtaaaacctgtgacaatagtgaaagggaagacaaggaaaatagaactataccccataagcttattacatttctgaatgttttggaaaatgggctctgaggcttaaatctgaagtgataatatatgggctctaggtagacattaataagttagagatacagaatattagtcctagagctattatcataaagtaaataaaaagagatatagtaaagcaagccaatagagaaataaaataaaacaaaagtatatgactcacccaaaagtggcaagaaaggaataagaaagcagcaaaaacagaagggaccagtggaaaacaaatagcaaaatggtaggtttaaacatggctatatcaatgtttgcattaagtgttaaacattcctattaaacagtagagtttgtcctattgaattaacaaaaaaggggccaaatataccatataaactatattaataagaaagctgaaatgaacaaagtataaaccaacaagaagaataatattagaaataaaaatagatacttgataattgtaaagagacaatcaggaagaaataacaagcctgaatgtgtatgtgcttaataatagagatttttaaaaagaagaattgaagactgacacatccaaagaagaaatagactcataaacagatatagttggttattttcatcttttcacagtaattgatagaaaaattgagttcagaacaggtacagaagatccaaacaacattaccaaccaacttgaaccaatcgatatttgtagcacacaatacatgacaactgcagaatgtacattctttttacctaccaagatagagcacatgttgagccataaaatctctcaatgtatttcaaaatatggaaatcatgcaaattgtgttcttggagtctaatgttataaattataaatcaatacaaaaataagattttaaaactcataaaatatctggaaattaaataagaatcttctaaatgactcatgagtgaaagaagaaatcataaaagaaaatatattgaacagaaataaaaacaggacacataaaagattgtaggatgcacatactacccaacttcaaaatatgctacaaagcattagtaaccaaaacagtctggtgttggtataaaacagacaaatataccggtgggacagaacagagaacccagaaataaatctatgtgtttgcagccagttgatttttgacccaaggtgccagggacatacattgggaaaatgacaccctcttcaataaatagtactgggaaagccatcaaactagaaacctttccctggtcatatatgaaaatcaactcaaaatgaatgaaaacttaaatgtaagatacaaaatgataaatctaccagaagaaaacatgataaatgctttaggacattggtctaggcaaagatttcataggtgagacttcaaaagcacaggcaacaaaaacaaaaagacaaatgagaatatctcaaactaaaaaacttgtgcacagcaaaggaaacgatcagcagagtgaagagacaacctgtagaaagagagaaaatgtttggaaagtatacatccgataaatgattaatatccagaatatacgaaaaattcaaacaactcaaaagcaaaacaaaccccaaaaatatgattttaataatgggcaagggatttggataaacatttctcaaaagaagacatacaaacttacaaaaaatataagaaaaaatggtcaacatcactaatcatcagggaaatgcaaatcaaaaccacaatgagatattatctcactccggttagaaatgttattatcaaaaagcaaaaagaaatcacaaatgctggtgaggatgtgaaggaaagggaactcttacacattcttggttggaagataaattagtacagccattatggaaaagagtatggaggtttctcaaaagattaaaaacaaaactatcatatgatctagtaattctactacagggtatttattcaaaggaaagaaaatacatatattgaagagatacctgcacctttatatttattgcagatctatttaaaatagccaaaatatggaatcaacctaaatgtccatcaatggatgaatgaataaagaacttatgatacatatacacaatggaatactattcagcaataaaaaagaatgaaatatggtcattcacagcaacatggatgagcctgggaggacattattttaagtgaaataagtcagagacagaaagacaaatactacatgttctcactcatatgtgggggctaaaaatattgagttaatagaagtagtgagtagaactgtggttatcagaggctgggaagggtagcaaggagggaaagataggaaaaagctggttaaggtatacaaagttacagctgagtaggaagaataagttctatgttctgcagcactatagggtgaatatagctaatgataatgtagtgtatattttcaaaaagctagaagagaagatttttgaatgttcacaacacaaagaaatgataaatgtttcaagtgataaatatattagttattcttatttgatcattacacattgtagataagaatgcaaagatcactctgtatcccataaatatgtacaattattacctgtaaactaaacataaaaggaaaaaaataggttgcagccaaagctgtgcagaggcaaatttacagctttaaatatccatattaggaaaaaaagttttaaaataaattatgtaagctcctacattaaaatatttgaaaaaggctgggtgcagtggctgccacctgtaatcccagcagtttgggaggtcgaggtaggaagatcacttgagttccggagttggagaccagcctggacaacatagagagactttgtctctacaaaagatgaacaaaattagctgatcatagtggcacatgactgtagtcccagctactaggggagctgagatgggaggattacttgaacctggcaggggaaggctacagtgagccgagatcatgccactgtactacagcctgggtgacagagcaagaacctgtcacaaataaagatagaaagaaaaaaggaaggaaggaagggagggagggagggaggaaggaaggaaagaaggaaggaaggaaggaaggaaggaaggaaggaaggaaggaaagaaggaaggcaggcaggcaggtaaaaagaagaagagattaagacctaagataaacataaaaataaagtatgagcagaattcaaccatagagaattaaacaaagccaacaattggtttttttaacataattaatacaaacagttaaacctctagcaagattaatcaaaaaaagaggaaaaagcaaaagaataccacgatcttggcttactgcaacctctgccttccacgttcaagcaattcttgtgcctcagcctcccgagtagctggaattgcagactcctgccaccacgcctggctaatttttgtatttttagtagggacagggtttcaccatgttggccaggcttgtcttgaactcctgacttcaggtgatccaccctcctcagcctcccaaagtgcagattaccggcatgagccatagcacccagcctatcagaatttaataaataacaatcatctgaatagatgcagcaaattttttcacagaactgaacattcttccataataataactctaggaactaggaaagaagggaatcttcctcagtctgataaaactgatctgtaaaaaacctccagctaacattctacttaatgattgaagaaatctttcttaagattagagaaaagggaaagtttattcttggcaattatcttcaatattattctagaggctccagttaggacaataaacctaaataaataaacatgcaaagtagaacataaagattggaaatatataaagtaaacaaaaaaactgtaaaaattacaaaaataaatctatcagataagataacttagcaaagtcacatcatataaatacaaacaaatgaattttatttttgtgtataggtcgttaacaactgaaaaacaataatctttaccatagcattaaaataacaccacaaaacaggaagaaatttaacaaaaagataggcaggacatttatactgaaacattgatgagataaatttaagcacatattttcgtttctgttataccttgtgtagaggggtgggaatcacaactcaattcaattatttgcagctgtttcacttctgcaatttacttagcttaaactcagtttctaattctttgtcatcattcataaaattcattttctggataggtcattaatagaattggaaatatgtgaagtaattggcataaaccctgaacttaatagaagtacagcaaattgaaatagttttattattgttattatgaataatgcgttataaagtgagatacttatatttattactttagcaataaagaaaccataggcaagactttgaataaagaaaacaacatatgattgatagcgtaagtgaagattaattttcataatggtgagaaatccaggcttatttagccttttatttactaataaattctgaagataagtcataaaacaatgtacggatagtagatacaccagtgtacataatgtcaggtctttgcagaagtggcaagtagctcaaaagtaggttaatatgagaaatttctttttcaaacaaaatgagatagcattgttccaggacttcttattgggacctattcaatcctgaaccactccatctaagtctgcatatctccaaaaccacagtcgtcattcttgtttgggatgatgttcttaaatgtcttatttctggttccctcaaaaacagaaacccagacaggaactttggtcctggtaatttattcaggcgatgatccaggaagcaagaaaggggagcaaacaaagtaagacagggacacagaagcgtcaatatagaatgatttatcgaggttacactgtgggcaatgagggatttttttccaaaacctgagaaacatacagaaagtttcccaaaattttcccttagccagacagaaatctgcaatatttatccacaagctccatgaattgaaaattacatgaaggcattaactcccctaactctctgcctatccaggctgcgtgtgtaccaggctgagtagattcccaaagtgtcagagaaggcactgaagcagagtacagatatacacataaaatgagctttagatgggactctatcaatgtgtggcagatctgaactagcacagaactgccctctgcagctaaggctgaaatcagaaatgagctaaggtgataatgatattaactagaagaccctatgtagcacatcaagtgtaaaaacgggttaggttttcttcactctactaatgctgaggcactcctcagcattgacaaaatcatgtattttgtcaagtgtcttagtcttttcaggctgtgataacaaataccatcaactagttagcttatagacaacaggaatttctctctcatagttctggagaatgggaagtccaaggcactagcacgtttggtgtccagtggggaatcatttccttattcatagatgataccttcatactattccttcacatgatagaagggactaactggctctctggagtcttttaatgagggcacaagtcccagtcatgagagctctgccttcattcataactcagtcatctcccaaagacctcacctcctccattgccttaggggttaggatttcaacatggaatttgaggagatacaaacattaagatcatagcaagaagactgtcatcagaagataattattgaattttaatatttaatcatgatacaaaatagaaaaaaattactgtctataggtcattttaaaagattataaaaatataaggaggtcaaaaaatttagattgcatttagaatataacctaaacatcataatttgataaagtctagattggcagtgctatttgtaccaggtcacatattagacatatataagtcacatataaatttagaggtcataaatattccccatattcccaacccatagattttttcgctagtctactcagtctttatccacatcacctgctttgatgcctgaatcaatgttgactcataaatagattgacatgaacgagtactgtggcacggttatgtctcctgctccccctcacccaccactgtgctgggtgagctgcatcaaataaatgaaaccagctacagcctggaagtatggtgtcacttatgtctgctgttctcctaaatgttatcccatttaagaggctacagacagaggcttaattcttatggaaaatgttcttctggtgtgttaattagctcttctgaggaacagaataagcatgtgctcccacaagtccttttttttccagtagagccagaaacacacacattcattaaaaagaaccgtgaaccctttgaaaaaccattagtaaagattttattttgttcagctttattgtgatataattgaaatataaaaattatatagatttatattgtataacattatgttttgatgtatgcgtacattgttaactgagtaccaaaagcaagctaattaaaatgtccatctcctcatatacttaccatttttgtgtgtgtgatgaggacacttaagttctactctcttagcaagtttcaagtatacaatataaaattattaactatactcattatgctgtacattaagtctctggaatttattcatcctgcataactgaaacattgtgccctttcaccaatatcctcccatttttcgtactcccaaactcttggcaacaccaagctactctctgttcctattatttgacattttttagattccatatgtaagtgggatcatgcagtatttgtctgtctgtgcctggtttacttcacttagctttatgtccttcagttatatcatgttgcaaataacaggatcttcctttttaaggctgaataatatttcaatatgtatttgtattatatagaatatatcgtgtgtgtgtgcatgtgtgtatgtgtgtgtgtgtatcccgtatgttcctttaaaaaaaaatagacttagggagtacacgtggtacagttgtgttacatggatacattggatagtagtgaagtgtgggcttttagtctagccatcacccgaatagtgtacgtcaggaatccccagccccctgcccacagactggtacccatctgtggcctgttaggaactggaccacatagcagagagatctagttttaatgcttttcatgagaatctaactaattcctgacgatctgaggtggaacagtttcatcctgaaaccacccaccccccaacatcagtggaaaaattgtcttccacgaaactggtccctggtgccaaaaaggtttggactcctggtatacattgtacacattaagcaatttctcatccctcactctcttccaaccctcccaccctcccaaatctccagtgtctattattctgctctctatgtccacgtacagggtatttagctcccatttataagtgagaacacatggtatttggctttctgtttctgagttattttacttaagataatggcctctaggttcatccatgttactggaaaaaacataatttcattctttttatggttgaatagtattccatggtgtgtgtttgtgtgtgtgtgtgtgtatacatattgcatgtttatatatgtacatataatgtgtacatatagatatacacacacacacagtggaatactactatataaatgttttatatatattctatatacacacacatatttatatatataaatatatataaataattatatatttatatgtaaataattatatataaatatgtgtgtatatatatacatatatacacgtatacatatatacatatatatatacacacatatatatacacatatatatatggcattttctttatctaaccatgagttgatgcacacttaggttgattccagatctctgctattgtgaatagtgccacagtcaatgtacaaatgcaggcatctttttggtataatgatttcttttcctttgggtcagtatccagtagtggggttactggatttaatggtagttctatgttttcttctttgagaaatatccatattgtttgccataaaggttgcactaatttatattcccaccaacagtgtataagcatttctttttctccccagcctcatcaacatctgttatttttcgactttttaaaaatagccattctgactggtgtaagatggtatctcattgtggttttcatttgcatttctctgatgattagtgatgttgagtattttttcgcatatgttttggacatctgtgtatcttctgaaacgtgtctgttcatgtactttgcccgttttttcaattgtgattatttcttgttgtttttgttatgatgttggagttacttgtagattttggatattattcctttgtaggatgcatggtttgcaaatattttctcctgttctgcagattgtctgttcactctatatttcttttgctgtgcagaaggtttttattttaactgagtcccatttgtctattttggatttttttctatttgcttttaaggtcttagtcataaattatttgtcaaggcactgtcccaagtgttttttctagattttcttctagtatttctacagtttaaggttttacatttaagtatttaatccatcttgagttaatttttgcatatagtaaaagatggagaagcagtttcattcctctgcatatggctatacaattttctcagcaccatttattgaataggatgcccttgccctagtatatgtttttgttgaagataagttggttgtagatatgtggctttattcctgggttctctattctgttacattgatctatgtatctatttttataccagtaccatgctgttttgtttactaaaaaccttctagtataattttaagtaatataacatgaaatctccggctttgttctttttgctaaggattgctttggctatataggctctttttcagtttcatataaatttcgggtttgttttttctaattctgtgaaaaatgacattggtattttgataggaattgcattcaatctgtagattgttttgggccgtatggtcatatcaatgatattgattcttctaatccatgagcatgtgacatttttccatgtgtttgtgtcatccaaaacacaaacatttcattaaacacatttcatttgtcagtgttttgtagttttccttgtagagacctttcacctccttggttaaatgtattcctcaatattatttttttagctattgtaaatgaggtttacttcttgatttgtttcttagtttggttgttattgatgtatataaacgctactgattattgtaagttggttttgtaccctgattttaaaatgagcaaagaccccaaatttactgaagttacttatcaaatctaggagtcttttcttaattcattcatgtttagatgaacagaggttgattccgtatctgagctattgtgattatgcttcagtgaacatgggggtgcagatagctcttcaagttactgatttcatttattctgtatgtgcattgaaaagtaggattactggaccatgaggtagttttatttttaattttccgagaaacttttatactggttttcataatggttgtaccaatttacattcccaccaacaataggtttgcttttctccacatcctcaccagcacttgcttttttttgtattttttataatagctattctatcagctgtgaggtgacatcttacaatggttttgttttgcatttccttgatgattagtaatgtttgccatttttttcatatacctagtcatcatttgtaagactgtttttgagaaatgtcttttcaggttctttgcccatttttaaattagattatttgttttcttgcaattgagttgtttaaactccttatatatttagaatattaaccctctatcagatgtctgatttgcaaatattttcactcatttcgtaggtgacctcttcattctgttgattgtttttttactgtacaaaagtttttttgtttgatacgacttcatatgtctactctggcttttgttgcctttgcttttggtgtcacattcaaaaaatcattgcccagactaatataaagaagactttctcctgtgttttctttcagcagttctacagctccaggttttatgtaaagtattcaattggtatttatatttggcataaaataagtatccagttttaattcttgacgtggatattcaatttttttcaacatttattgaagaagctatctgttccctattgtatgttcttggcactttgtggaaaaaacaattaaccacaaatgcatagatttatttctaagctctctattctgttccatttggtatacatgttagtttttatgacagtaccacactgtcttaattttgaaaccaggtaatgtgatgtctccagctttgtttttcttgctcaaaatcactttggctatttgggctcttttgtggtttcaaattaattttatgttttttttctctatgtcactgaaaactgccattggaattctggtagggattgcattaaatctgtagatatcttttgggtgtttggatatttaaatattaattattccaattcatgaacatgggatatattttcatttatatgtgtcttctgcaatttctttcatcaatattttgtagttttaagtgtatggatcttcagcctccttggtcaaatatgttcttaagtattttatttttatactattttaaataattaaataattaatgcccatccttttcagactcttccaaaaaattgaaaaggagagaccaccaccaaactcattttaggagaccagcattccactgatactaaatccgcctaaataaagaaacaaataacagatcatcaatatccctggtgaacacagacataaaaattctcaacaaaatacaagcaaaccaaattcaacaacacattaaaagcatcatacaccatgatcaaatgggacttaccacaagaatcacaaggattgttcaacacatgcaaatcaatatatgtgacatatcacattaacaggtccacaaggacaggcctgtatcttggttctatggtggctggcatggagtcagggtccactggagtgagcctggtgactgggtatgctgacatggacctggagcctgtgtctatggaggctgtcctgaagcctaggtacaaggggtccatcctaaagctggggtggttcttgagcctgagtttacattagctagcctgatgttgaggcaagtttggagccagcaacaacagagatgagcctggagtctgggtctgcaagggctggctggcctggtgccagggtacactggtgaaggcctggtgtttgggtccacagtaaagtcaggtgcttccttcacttttatctcatcacacagccagtatgtctttccatgaggcactgcttaggtgtgaggaaggggtgacatggggaattgtaaaaatgtccttccagttctgctaaatgtatcttttcttacttctgtgctcctataatctttcacctggttttctcagctcctggtaatatattttcataagtgaatagtcacttatgtatcttttcttacttctgtgctcctataatctttcacctggttttctcagctcctggtaatatattttcataagtgaatagtcacccaaattgtaagtgaacaagagctggaacctcctatttcactattttgctgatgtcacttccattagcatacattttaaaatttgtaattaggaaggttaaaaataacttgaagccaagtttattaaaatgtctaacatatcctaaattacaagacgtatttcctatttactttacctcctttgctaccaagcttgcatcttagcatgatttctttctcatgaacttaaatccaactagctaaaagtggcaatctttttgatcactgaagccaggctctatatttcagctcacgtgctccataaattatatgcaatatttgaccctgttaataactcttcttcttgccattcctttggcttccttgactttgaactctactggttctcttcttcctcctcctcctttttttctactctctcgctgactgcctctaaaagtaaatattttccaaaaaatagggtacaatatatggatacttcctcaggttctctcctcaggtccctcctcttacttctgactctcctcatcaagaaatgacctctatccccacaggctggaatccctcatttgttacctagggaaccaggcaatcaccttttacacactaagtgaaccaaccagaccaaaatagcaatgcaaaggctttgaaaactatattgtcagctgagcacggtggctcatgcctgtaatcttagcactttgggaggccaaggtgggaggatcacctgagaacaggagtccgagaccagcctggccaacatggtgaaacccggtctctactaaaaatacaaaaattagctaggtgtggtggtacacacctgtagtcccagctactcaagaaaatattctaatatatggcagagtgatgacattcttaatatctatattcatatatcagtgcaacacagaagacctcaaataaaaattaatgaagagcattaataatttcccaaagaaagaccacaaatgaccaatgcatatatgaaaaattctcaactttgccataaatcaaagagaggaaaattaataataaacttccattttctgttgaataaatcagcacctttttttttttttaattactacttagtgttgagaagtttctaggaggggggtacctttcttacactgctaccttaaaagtgttacattatcctggaaaaaaataggacgatattttgcaaaagcctcaagaatgctgattgtttaacccagcagtttcattcctgggacttggtcctaaggggaaaaaaaaaaaaaaaaaatatatatatatatatatatatatatatatatatatatatatcctattcacaaggttgtttattgaagtattatttataattgcaaaaaacacaaggaaatataacttttagctaatttatttcacttaggaggtctttcaccattattctgcactgaacatttctactcaaaagtaatacaggtatcactcctgcctctgtgatctaatggccttttctatatagtgccagggttccctttacctcattgaccccaaaccataattttacttcctaaaatttacttctagactagaactcttggggagagtgaatcattggatctctggagtctccatttctgaattatgcaagaatggtttataaatgatactaatgagcgcttacatccatcaaaaatcatgatagggacttcatttaatatgctatttaatttaatgattacaaaatcttatgcttcagatgcttttattatttccattatacagatgaggaaactcaggattagcagataattagcctgtcagtttcatgcacctattaagtggcaaggttgagatataagccctggatcaccttattttgtggctcaaactcttaataattataaagacattgcctaaaggattcatcatatctaatgaatattagataactatgtgcaaggtactgtagtaagtgctttatatgtatctgttcatttaggcttcacagctctgagataaatatcattattatctccattgtacagatgagaaaatatgcacagcacaaaacatatgttgcccaaggcttatgtcagtatgtggcagagctaaaataaagccacatgcatttcactttgctgccttgtgaagctcctaccatctacataatgttttgataataatttataacatatgcttaattcattcactttcttttagaaacaaatctttctttgacaactcagttgctaaaatacaagatgctggagcagcagacacaggaaacaggaaaaatgccacttctaaaacatgaagagctatatttcttcctcaacagccagtgaatcagttccatcccctatcatatttagcatattgaatgtcccactatatagttggacaattgcagttcccaaacatggccaagatgatttcatcctctgctcttttgtcggaaactcggtctcctctttatacttgaacatgaagtcattgcagtagcctgccaatcctaccctctcctcactacttcagaatttatagaatctctgtcttgcatgacctggaataacaacaactcagcacctgctctcaaagtgttaaagtgcccaatgttctcaccagaaggaaatttgcagcattcagacatgtcacctaggatgaaaaatagattcagtaaggttttacattcaaagttcaaaactaacaaggtttgattacaccctggacatctgcagcttcagcaactgcaggaaagcagttggtaaaatatcattatgacggtaatacaaggtgtgagtgggtaagagaaaacccacagcatgatgtggattttctgtacaaatataacaacaccttaagattacagagattactcaaaagaaatactttcctttcattctttattctttaattcagtaattcaacatttatttggtacctatggtatgtaagacacttttctaggtaccagaaatatgaagctgaataagatacattcttcaaaacctagttctttaaaacctaacatcctatagggaagagtgatagttaatcatcatacacattataaatgctgtggtggacatctgaacagagagttttgagggttaaagaattcaaatagtgatcaactccactttacaaagtcaaaaaagataacagagggaatttcagaacaggagaattgcatgtaagtatgcgtaaaagtatgaataagactgtgttctgagaattttgagtagtttagtgtacctgaaggttaagggcaggaagtgagagtagattagagcaaaagagaaatatgatgcctattagtgatgtcaagggatatagaattgatctatgcatttcttatgttttctttctttcttttttttttttttttgagatgaatttcactcttgttgctcagcctggagggcagtggtgcaatctcggctcactgcaacctccgcctcccgagttcaagcgattctcatgcctcagcctcccgagtagctgagattacaggcatacgttaccaagcccagctaattttttatatttttagtagaaatggggtttctccatgttggtcaggctggtcttggactcctgacctcagatgatccacccgccttagcctcccagagtgttgggattacaggtgtgaactaccgtgcctggccaaggatatacttatatattatttgtgtaatagatataatcaaacaaatacatatagagtagaatagtttagaaaagaagtgaaagagcaaaaggaagactacaaagtatggcagaccctagacaaaccataaatgagaatagacaaatagaatgtggtggaaattctgactttttctaaacgaatatgagagtattctaaatgtaaccaaagacagaaatcagtgagtagattaccataataccaaaagtacttcaaaaaggaggagattgcaaggtggtggcaggagatggcatggggaggatgctaaggggcttggttgggttagagttgataaaggcagagtcaaatggactggagaggtttttgtctcttcttaggttgatgtttctccctttgccctgcattgcaggttgtttcttcctctgcctcacttagttttggataagtccagtattttccttttttcatcctcagtgttactcttctttcacttctcctgcctttattcttttcaccctagcttcttttgttctctaaggcccagtcaagatgaagcttcccgcagccagcttctgtagcacttactttaaacctctctcataacatatggtttcctgtgaactccatcaaggcataaaaggttttaactctatatttcccaaactggtttgtgtagcaagtcttcaatacatgtgtgttcaatggaagaaaggaggaagaataggaaaaagaaaagaaagctttttctctcacagctgatttttctatagaattagaaatttgatagcaatattgatattaaatttgaaagcattattttatagcaataacgcaattgtatctttccagtcatcttaccccagacatgtaggatgtgaatcagaggtaatatatttctccttcttaaaacaacaactccgagacaatatgagctttttaaaagaagggaactatctgagaaacaaatgaacaaagagaagggggataaaatggtgagaagagtactgctttgctctgggaatcagaaaaccctacatttctgccttgactttgcactaagtagctgtcttgagtactgcacttcatatttctgagtcacagtttcttctcttgtaaaatgaggagtttggctcaaagttctccaaattgtttgattatgtggcagaaagtaaagaagaagagagtgcagagctgtgactcgtcatttccggagggaaaggaaagcacagaggaatgtgtactcttggtgtccaggttcaggcctccatcctgatcactaatttttgagtttgtcccttgaacttttacctgttttctttttatgagacaaaacttatattttagattctgtctttgcagtttctcctccttcatactgaagctggcaatagaagacagtgagtgagtaagaagtgtcttaaacaagaatggctggaaacagagctctctcccaggcagggtggtaatgccagcaattcaaagaaactaagatgtggcatcacaggatgtctccagtttttggggatcatggaccctcatatcttggctttcaaaaagtgaatggtaggtggctgttgactgaggctttcttagaaacataatttcatgaactactggaaagagacaggaacttagagtctacccagtggaaaaagaataaataaataaataaataaataatgcccaagagcttaaaaaaatgatagcaaagtttacaaacttgccagataagggaacataccaccagtaaaataattcactgagaactttactcagggggtggggggcaggggcagggtttttttttttttttttgagacagagtcttactctgtcagccatgctggagtgcagtggcacaatctcagctcactgcaacctctgccacccaggttcaagcgattctcctgcctcagcctcccgagtagctgggatgacaggcacctgccaccacgcccagctaatttttgtatttttagtagagacggggtttctccatattggtcaggctggtcttgaactcctgaccttgtgatctacctgtctcagcctccccaagtactgggattacaggtgtgagccaccgcgcctggccaagggtcagggtttttaatgctaggaagaggaggtccttggtggttgggtgaatgaaggattgaaaattagcactctagataagggagaagtggtctacagatctgtacacagttgggcaaaatgagctccattgtcttcagttaggttcaatagagtctggagtacccagatcattcaagtccatggtcaaatcagctccacttgatttgactcagttatgatgaaacggtacatagttttgctattttctaggtgagttttcacataaatgcaaagttttcttttaatacaatccaatcccatcattttagagatgggaaaaccaagacaagaaatggaaaaacacttgcctagtttgaatgattccacatttgtgtcagaaatcagcattattttatctttgatgcttgcctgttacttgagcttgataactttacagccctgcctcagttgaagtcttacctcctttgtaaaaggggaacctagtttgtagtctccttttgtaatttcaagggaatatagaattgcaaataaaaatgaagtgggctgctacaaaaaacagtgagactccgaattatctaggttacttaaagaatagcaagacaaccacgtagtagggccactagagggaaatatcaagcttcaaatgggcgactggacaatgtgccctttaaagtgacttctaattctaatgtacaatggtagaggaaccatgagtattgtatcgttaccctcactgtcttctcttctaccataaacatcttgagagaagaaataatgtcttatttacagttccctgaaatgtagcaggtgtccaataatacctgttaaataacagaatgaacataaaaactgtgaagcaaacagttggagatcctttggaaggacatctgtcaagactagactatgttatggctctttatttccctttcatttcaaagaagctctcaaagtaatgtgatctgaaagaaaaaaaaaaaacagctagcaacttgctcatctattacagctttgtaattctgttagaggagaagtgaagcaatggttatattaaaaagcccagaaataagcttcaatacttggctccttcaaaggattttggggttgggggattgagtttaaagaaattggttctgaggaaaatgcactaaaattaaaatcttcaagttataaaatgccttagagataatattgtcttcctccattttagaaatgaataactcgagatgtccaggtgaaatacaatttaactaaagtctccacatttctaggtcttacaaattcagaaatgttagcagtgaatatgagtacaggatataatccttcctaagataagaaagatttatacccttctttagtgcctggggaaagctccttgattataaacagacagttggttgctgaagaggatgcagttcacacacacttctgacactgagcttattcactacaatacctctgtgtcctagaaacagctgtttcatctcctctggctctgaggctacttcctgacctatcgtctctcaaaatccacctgagttcttatcactgtacccttttgctagtaaagatgtggctactgataggggtcaatgctgcaggggtttatggccagaaagattggtaagggagctgataaaaaacctgatatccactgtgacagtatctggcttcaccagtcacactctaggacctagccaaaagcaaatacgttgttgtttatgtaaatggttgctgaagaggtcctggcaggatttttgtttatagcaggtgaatctatctccacatgcttattagggagttaaagctgtttcctgtaccaccttattctttcctgaattaagaatctcaaaacactagacccacaagatgatttacaggtcatcttgtattcattcctcactttacaatggcagcgactaagtcccagagaggggaagtaaactgcttgattcacaacatgaagcagtgacagatgggattttgggactcctggaatatcttccaccatactcttctaatttcatcaacacatagaatgacagagtggccagcattcaaatctacctttttcttttttttttttttttttttttttttttttgagacggagtctcactctgtcgcccaggctggagtgcaatggcatgaactggttcactgcaacctccgtttcccaggttcaagcgattctcctgcctcagcctcctgagtagctgggattacaggcacgtgccacactgcccagctaatttttgtatttttagtagagatggggttgcatcatgttggtcaggctagtctcaaactcctgacctctggtgatctgcctaccttggcctcccaaagtgctagaattacagatgtgagccaccatgcccagcccaaatctaccttcttataggtggagaaactgagaccctgaggttcatttcacatgtataaggcaatacacatacttagttgtagaatttgttctacaacaaaaattcttcacctaaagaatttggggtccattgttgagctactggggatttcttgaatcgtgtattgggagtgtgccaaaattgtgtgcaaatatgttcatttttctgagtatataaattgtattaggtattcaaaagggtcatgcctcaaaaaaaggataggtaacattggtctatgtcctagattactgctcattgtggcagttatgatgtatatttttaattgtcttaaggccatacataagaggagtttctgtcttgacttgttgggaaactagcagttcatctctttgctaaagtagtgtttatactgaatggtccacttgaaatatcattagtcactttataggacaggtaatggcaggagaggagggtgaatattgagaacaatgaggcagatttttgaacttttatatattgtgtcttaacagggaaagtccttggggttttaacctccaaggtaatggatatctttgcctccttccctctacctctctgctcctcctgccacactgaaggtcccaaacaattaaatttttggactttgaataagatgacatgggtttaaactcatactcagctacttgctagttttgtggccttgggaaaaatcgctttttcttttcagacttccaatctcctggtaaaccttttcagtagaatgtaatatcatgctttctactaggtgggaaaaatcatctacaaatgaagaacccaacaaacaatctgtagagtaagtagaacatggacttatttaatctgcacatctccatctcttctcaggctgatggggtccaggctctttaggaatccaggatcctggccctgatagtaacttggtgtttggcactcagccagacactctcctactccccccaactcaggacgtctatttctttatctgaaacttgagctggttaaaacaagtaattccttctttctttctagctctaaaattctgtggtctctccagctgtcactgaggtctcatgtggatctgctgaaatcattgtcattctatgattgccccacagctacattttgaagaacttcctatagacacatttatttgaattggtcctgggtgatacctggcagctcaagaactgagtggctcaagaaggaaaacccaaaccccggtagaataaggagaaatgaggaatgatgattttggcctgttatttacatgcttagctgttttgttcctcattcaatgtgggtatcactcatttttatagaatccttctattaatgcaatttctgatcattactggattattttagaggcacattaccttctttgtgacctttgccttttcagttagacttggaacatatttccacatgtttggagtttgtcctgaagatgcttttttgactggactcctgaacccaatgtgttacataatagaaaactggagttgtcactctcaggaactgctccaccagaacaagcacgatatagagtgatttaaattattcacagtatatttaaccttcttcactactgccagagatttagaaaggtaattgattgtggctcggtgcagtggctcacacctgtaatcccagcactttgcaaaggctgaggctggttgatcacctgagatcagggagtttgagaccatcctggccaacatggtgaaaccctgtctctattaaaaatacaaaaattagccgggcgtggtggtgcacgcctgtaatcccagctactcgggaggctgacacaggagaatctcttcaacccgggaggtggaggttacagtgagctgagatcatgccactgcactccagcctgggtgatagaatgagactccatctcaaaaaaaaaaaaaaaaaaaaaagaaaaagaaaaagaaaagaagaaaggtaattgactgtgtatggcaactcaggatttctcaacctgggcaattgacattttgaactgaacaatattttgttgtgggaagttgtcatatgcatttgtaaggtgtttaggaacatctctggcctctttccattagatgccaatatgacacttctgcttcccaagctgtgtcaaccacatatgtctcaagatatttccaaatgtttcttgggggccaaaattgcctctggttaagaaacgctgctttaaataatcagttttcctgtttaagcttcagggttcctatctgtaaaaggaaagcatgtttctcacactagctgtgtaagagtctatactacagtcctctggtatctacagcactagatgtttccttctaaagaccattctcttttgtttttctgttgttgtcctttgggtttctgttgttatttactatagaaataggccagttaaaaaaactaagtgactaatagaaacatagaatatcgtacctagaaccattcaaatagatcatcttgcccaagtcaattatgttcaaggcaagtgtgcttttcaagatcaagcttgttaatgtcaggactgaaatacagatttcttcatcatttctttctgacacaattcaatgcttttcttttattgctacgggttgtcatcttcggaagcacctataatcttaccttaataacattatttctagcactctctattattttattgataaacagcaactgtgaggtaacactgatgtgactgaatatgtaacaaacttacctgagtttacctctacacaccagtattctcttcttaaaagttatttccatatggacttgacattcacttgaacaaatacaaaatacttttgaaacagctttagattttgtgttagaatatgtgcctcttgttttccttcttttttcttttattttctcctctttccctctgttctctatttctttcttcttttcatcccttctttatttcttttacctttttatttccatctcgtcttctttccttttttcttcttcctctcttctccttttcatccttccccttcctccctccccacttttatttactatgtgttacacctcattacaaaaggaatgtggcataacttacaattaataggctaaaaataggcagtaatcacagtgaaaaaatatagcttttcctcattccacaaatgaaaagaaattctacattatttaataactataaaaattatatataaatgcattttatttttggacttgggagagaagaaaagactctatgaacaactgagcaatagggggaaacaggatggtcatcacagaatcattgattcagagacaatccagaactgtgaaaagtgaagatacggagatgttgcgagcaatgacctgtcaaaagctgctcacagctatgagtggccaatctgtttactgaactccttctcaaaacgtgtcttttctctctccttcaggcagatctagcatggattaaatcactgtggagccagccagtagcaagtgtattcaaatctatttaatatggtcttaatacccgtacaagagagtcatgtcctgtaaatggacgagtattatgaaaatctttagaaaagggtacatctgaacctttcctgccagcaccccctcaaacaaaaatcagtgttttcaggagaataactatgttacaggtgcttgttacctacaacctttggcttatatcttatctcaagcatctactccgttatgtggcttcatcaataaaataattgaaatagataggatgactgtttctttgactccagaatttcatatcttatactatttaaggaaaggtgattaatgaaaacaaagtgatttataaagtatatacattttagaatttaaactaattcttccaattgcttgcactaatccattgaaggttagctactcttccctacgttcgtattctgcagaatgatttcagattgaggaacagacacccaagaaaatgttttcccccaaatacacattaattaaaaccaagggagaagagaacaaggtgtgacagcttttctgtgtgaattaagctgggtaaaatacctgaaccatgaatctttatttgtggaatgataatagctaaatccaaatagggttttgcaccaacaaattattctacaaatcatggagtgcttcgtatactaaaaaaaggagttattgaacggaatttggatggggacgattattctgaatttgtgctactctaaaaggtaagaaaattatggtagatattaggccttatgttttgcctatttgaatatatacggctatagtaaaatggaaagcagtagaggtagaggtaaataaaacaatctggacttagggtaaatgatagctctctgatcattagatgtgcatttggagcagattaactcacggtgcctggtgttctcatttctaaaatgtaggtggtgataacaaagataatatatgcctacctcacaaggtcgttgtgaaggttcagtgagtgaatagatgaagatgattttaaaaagtttctgacacctcaacaacaccgttttagtgttatcttttattacatggccatattgttttatgcattcaaaagatgtacatgaaattatctaaactatctgaggtttaagaggtatagctcagagtgccatggactataataaagtatgttggtgttatttcttccagactattaaacagcggaacagaaatgtgactaagatcaacccaatagtatatccttcacttcctttgaatatagttttctcattttacataagcttttaatcttagaacagtatacaatttacagaaaatttggaatgatagtcaaaggagtttccacataacccacacccagtttttcctatcactaacatcatacattattatggtatatttgccacaacgaatgaactaatagtgatacattatttttaactaaagttcatgctttattcaatttttctttgtttcacctaagtgtattttgctgttccaagaccttattcagaataccacgctgtatttagccatcatgttgccttaggttccccttggctgtgatattttctcatacttttcttggttttggtaaccttgactgtcttaaggcatgctgttcagaaatttaatagaatgccccttaattagactttgcattttttaatgataaacctgggtttatgttctttggggaggaagaccatgcaggtaaagtgccattttcaacacattatattaagggtacatactatcaacatgaattttcactgttgatggtaatactgatcacctggctgagtcatgtttgttaggttttttcactttgaggttaactcttttttcctctttttccatgccatactctttgaaaggaggccagtatttacagcctttttttttttttttttttttttttttttttttgagacagagtctcgctctgtctcctagcctggagtgcagtggcgtgatcttggctcactgcaacctccaactcctggtttcaagtgattctcctgcctcagcctcctgagtagctgggattacacacgcccgccaccacacctggctaagttttgtatttttagtagagatggggtttcaccatgttggaccaggctggtcttgaactcctcaggtgacctgcccaccttgacagcctattctttaagagtggagagttattttctatcttcttgagggtagaatatctacctaaattatttggaatttttctgcatgggagacgtcttttttctcacttttgttaatgtatctgaatatttatttatatcattataaactcatggatagttatgttatacattggaatataattaaatactactttatttcctcgctccattgctccagttttggccattgaaagctctttcagttagttcctgtgtccctttgatatactcatattattttgagcatggttttaaattttttgtttgtttgtttgtttttctttaatttgtggtgctacaagatgtttcaggctcatcttatatatgtcctgcttcagtcatagaagcagctacttatccaaggatctctggtttcttttactggaggatagttttagaaaccaagaactgggcattaggttttctcattgctgctgggtgttgttgcttctaggctgtctcagctgacagagcaaggaaatatatggatatatactgacccatgtatatgcacatatctataaatatttctatgtggaactagctgtacctatgctgatttctccaacttttattcaaccacatggatcattctagcctttttgccttgtttttctgtatcctcccacactaaagtgaaaaacctcgctctcatacacgcatcatccatttacttaattgttttatcacagtgtacatatatagtggtttcagaattgttaaaatgtagcctgtggaaaataattttatcaagtaaagtacagtgcttatatatcgttcattcggttcattttacgttaaattttatagattcgctaacttcagagttacttaagttagtgtctcctcccttccacttctttagtgaggttgtttcatatatttgtaatatagtgagaatattttatcacactctacattccatcccaagatttcctgacctcctttgtattttattttgtttttaatttgcacacattaaggttcattacttgtgctataaagttctatgggtcttgataaacccataatgtcatgtatccaccatgaatataccatacagaagattttcactgccctaggttcctgtactcatctattcatcctttccctgccaccaactccaagttccagacaaccactaatcactttatcttatttataattttgccttttacagaatgtcatatacttggaatcatatggtatgtagccttttcagactggctttttcacttagcagtatacctgtaagattaatcctcatcttttcatggcttgatagctcatttactattattgctgaaaatattccatagtatggatataccacaacgtattcattcaccaactgaaagacatcttgcttgcttccaattcttggtaattatgaataaaactgctataaacattccaatgtgtgtttttgcgtagatgtaagttttaaatcagttgggtaaatatccagaaacataattggtgaatcttctatagtaagggcatttttggctctgtaagaaactgtcaaactgctttccaaagtacacatacaattttgcattctcaccagcaatgaattagagtccttctggccccacatcttcaccagcaattgcttggcagtcgtttatactttagccattataataagtatattgagatgtctcattgttttacttttattttcctatgacaaattatgttgaaaatgtcttcatatgcctatttgccttcttgatatgtactttgttgaggtgtctgttacaatcttttgcccattttaaaatgttttctaattgttgaattttaagagttcattgtatattttggatgtaagccctttatcagatatgtgttttgcaaatacttttccccagcctgaagcttgtctttttagtctcttaatagtttcctttataaaacaaaaggttttaattttagtaaagtctaagttaccaattattttatttctgagattatacattttatctaaaaatttattatcaaactcagtggtccagatttttcccatattttcttccagacattctttatatttttaaaatttttacattgagttctatgatccattttaagttaatttttgtgaaagatgtaaggtgtatgtctaggttcagttttttttttttttttgcatatggacactcgattgtttcagcaccatttgtttgaaaaaaaagtctattatttctccattgaattgctttttcttctttgcccaagatcagttgacggtatttgtatgggtctgtatatatatctgaaccttccattctgtttcattgatctataagtatattcttttgtcaataccaaatgtcttgattactgcactttacagtatgtcttgaaaccaggtagaatgaatcctccaatttttttctttttcagtattgtgttggatattccagatcatttgtctctccacataaacttcagagtgagtttgccaatatctcaaaaaaaaataaataaccttccaggattttaatttggaatgttttgaatgtatacatcaagttgggaggagctaacatctagacagtattgagtctcctctcccatcaatgcaaaacatatctctatttatttagatcttgcttgaatttttgtcagttttatacttttctgcatatagatcctgtatttattttattggatttatagccaaatatttctcttttttcagttctgttataaatttctataaattttcatttttatttgttgctgacacataggaaagcaatttctgtatattacccttgtattttgtgactttgttatagttgcttattagtttcaagaggtacctgaagacccatggattttctatatagacaatcatgtcatctgtgaataaaaccagttttatatatttcttctcaatttgtgtattttaatatgattttgttattttacttcactatttagggcttccaggacaatgttgaataggactggtgataaaagacatccttggtttgttctcattcttaacattttaagaagcatccagtttcgtaccattacacatcaggtttaggttttttgtaggtgttctatgtcaagttgaggaatttctcctatactcccaatgtcctgagactttttggtcataaatggatatcggatgttgtcaaatgattttttttctccatcaattaataagatcctatttatcttctttagtctgtttatgtgagtgaataatttttaaaagtttacattgaaatgtcactagaaattcaataattactcatttactccttcctttctcttatttttctcagtttcttccatctcaattagaggtggcaatcattcctttatttaaggcaagctatgtgttatttctcgaagggggaatagagaatgtaatgatacctttctaaagccagaatgcctgtgttaactgtccagctttacattttaattatccatgagatgctatatagattactcctttacattgcctatctgtaaaataggctaatagtaagatctgtcttgtgaggattaaatatgcttatacatgtatgttcttagaagaatatctgcatgtagtaaattacgtaaataatttattacatcctagaactcatattctttagctcattgttgttcacattgtaaataagagcctattgatcatatctaaactatataatatttaagttacaggtcaagataatattttacacaatatttgaaaaattgatattgcttttttgaatacagagctataatattgtggaaattacagtgtatgacaggaagaatagtatctattatatttgtctcacagaaattctattggtataaaacagaataacagacatgaatgcaagtatattgagttaagctagtattgaatgcctgccaagtgctgaccacggttagctcccaggcacatagtgatgagatggccaacatggttcctccattcacaaagcttacaatcaagtaggaaagaaagatcaattttcctgtaaattatttccttcatacaatacagtgagcatttcctctgtccaaagtgttccacgcttactgcctcattttaacactcacagtaaccctctgaagttgctcttaatacccttattttactcatggagaaactaaaacagagagaagttgaggtttgcctcaggtcccaagactaatgtgacttaaattcacttatttctcctgactcaaagttattgctctttacgtgcaagtttccacattctacaagctagcatgatgtccaaaaggtattttattcacttgtcccatgaaattggaacaataagaaattaaaagtttggacatatttttcctattttgtcttggagtcggagaggaacttagagaatgcattaaatgattctaaaacattgagcctgaatgcaagtaccatcagcccatcatccagttgtctgtagttttatccacaacaatgatataagaaattcagaatgactaaatactaggaaagtaggatctacctgcccttcattaacataggttaatatctggtaaaaatggcactagcatatttgttttaaaaaaaaatcctagcatttatgaaactataaatctagatatcttgacatagctttatggataccatcactgatttgattaatgtcacttctgttattatagataatttaaattttttgcttgttctcaaagaaaaaaaggaaaagaaactattcttcatattttaaatttcaacattaaatagttaatgaagcttgagttatgattccttacacaaatatttaccaacatgaattttaactgctgaagaaatgtattttaatttatctcagctttggcagtatcttgttttagaaacaaaagagttatgtgcgctgatgctgtttggtgactggggaacactggtctgactgcagtgctgagtgggtaaatccccttgtgcctttaagaagtcttagttgcttaatcttcatggacatttgaagtgtctggagtgagctttgataaaaggtggatcaacaggttgtgcaataacttgaggttaaatgccttcccagaggctcctaaagatgatcattttgatttttccaattgaggtttttaaacagcagctgtagggcagcattgtgatgagaggaaaagccagcaggatggttttctggtacagctccatcttaagtaatacaggcattatgaaaaaaatggtgccatcattcatagatttcagtttcaacaaacacttactgaatgccttactctaggtcagtcccagtgtttgctgtttccatgtactccatctcatttgtttctcactatagcactactgctcaagtacttattaatatcccaaaattgcgtatgagaaatggaagccccacatgaagaagggaaataaagtacatggtaatttcctagttgcagatgctggagctctaatatgaggtaggtaggtagatgggtatcatggctagaatgtggcatcaccattcaggatcagagattaatgggaattactgctgggtagctataacacaataacatatccttatgtcccttgatgtgggcggggtaaactttccattttgatcttaattgcgatgtgctccaatgagcagctggtacatagagaattggaaacaggagtgtctagtagcactgacttccccacttctgaagttaagataatgagttcttttacatcctctgaatattccagggatattttaggaatatgtttgggatgggatggtaataatcacaacataccaagctaggaacataaaaaggtatggatcatattaatatcacccaaatctcttttaaagtaaatgtattacaaaaataatgttaatgaatcctggttaaaagcgctaccaaggcccatccaaaccagaaaatctgtgatatgtgattttagaaaggatcatttaatattttcaaattttctaaaatgagagataggctttgaaactgaagattgttcctccttcaacttccaacatgattgtgatgcctccccagccacatggagctgtgagtccattaaacctctttttctttataaattgcccagtctcagatatgtctttaatagcagcgtgagaatggactaatagaactccagtacgtgctcctcaagaattatctctaatgaaagggaattaagaattagtctgtttctgtgaagatgtgaaagctatgaaaattcatttctccgtatgtctgagtatcacagtaaatgaaggagtgagtcttccagagaagggattacagtagttatttaagggaggcatctaaacatgaacaagaaatcaaggcaaagtccaactgaatatgagaagccacctttcaggaagctggagataagggtgtatgagaactgattttcagtaatgtgaggagatatatatacatatatatatatatatatatatatgtaattttatatatatgttatatatatgtgtaatttttaagttcagcaggaaatgtgggaggaatacaaaagagtacctatttggatcatatttattccaacagaaaatggaggggaaagttcaaaaattcacatggtccaatgcaaagaggcctagagttaaatgttctgataaggcgctccattccttttctatcatttactagataagtgacctgggattgattcctcactgtctctgtactttcctattttttgaagcagaggtgataatacctggcccacggtcatgttcagtacaattagttgagtgtattcttcaaatctgaaggacctctgtttgtttctaatcttttctttctttttcttctttttccatgtaggtgaacaccacatacacaatttaccttaataaattaaataaatgtgtaacttgtctgcaagttggaaattcctgagggcaaatgcattatcttagggagcctgcaacatgcctagtattactgagttggccagagaattcttaacactagccctggaggcctgtaccagagtctgggtcctgctgaattggcccttggggtttttctggttctggagctgctttggtgggttagttactgagcttctctagtgggcctcttgttgttttagtagcttccctgagggaattaaaggttttaactgaatgtgaaacatcagacagaaactgcagggaagatttattgacaatgaatctcaactttccaaaggttcatttgaaactaacttccttctaagccaaaatgattcaaatttgaaaccctccaggggcttctctgggatttagggtattagggagctttttccttgctgtcgtagattatctcaccattgtttcttgacttgtagaagaggaggtttgattggtaaatcacctcttccctacagctttaaattctttactcattcagaagataagcaggactctggctgtggtgcattccaaatgtttcctctcctgcctgggtcccaaggaaaccagcctgggccctgccaagggtataatgagcagggcacatgccacaggaaagagccagagggaaaagttgaggttgagcatcgcagaaggttaccatggatgctacactgtttttaaaaaggtaaatattcaggattgagcagagcaaaaagtacagacatgaatttgagttttacctctgtcacatgaaatgtgatctcaggaaacataaacttctttcatgctccttttctgcttctgtaaagtggctgaaataagttttatcttacagcaccattgatatgattggaaataatatatgtataaagaatagcaagaaattaataaatcacatcattaacaacaggttttaggcactggctcaggcaatgtgtgccaggcattgtgcaatgtacctcatatgtattatcacatttaatcctcttgaatctgcaaggtaggtgccattgtcatttccattttgcagatcagaaaaactaggctaggtttaaggaacttgctcccagccagctgatgagtggtgcaatcagaactgggatcagggttaactacaaaggccactccatgttcacaaacttctctcaggccgggcacggtgtctcacgcctgtaatcccagcactttgggaggccaaggccagcggatttgttgagctcagggatttgggaccagcctgagcaaaacagtgaaaccccatctctactataaatagaaaaattagctggtcgtgggggcatgcgcctgtagtcccagctactcaggaggctgaggcaggaggagactgggaggtggagattgtagtgagccaagatcgtgccactgcactccagcttgggtgacagagtaagaccctgtctaaaatagatagatagatagatagatagatagatagatagatactctccctgatgctattttctagggacccaatccgtaggtcttcctattgaaaaagaaaagaaaaggcaggtggctgccagtttgagtagggtgtgcataagatgatattgaaagaaaaggtagagggcagagtcattagaactttaaataaaagcagttttctaaatccagatccttacatactatactaatacagagaaaagccagaaagtgcactaacaccccatattttggtcacagcattgtcaatattctataggaaaatttagagcaatttcatttgtatctttttctctaaagacaaggaaatagaaactaagaaagtgatcatgacttattcagagttatacagtgagttgttgggaaaacagaggccaaaacacagttctctaccacaccagaccaccacactctacacaacctcaacctggcctctgatggagagtctacagtcagtgagatagcctcaagttctctaataaacattcacttactagaaaggactctatagttatcacttacacttcagtgtgaattaaggacactttgttgttccctgtcccagagaacatttctttgggttcacatttggacaactaggccatacatatcctgtttccacttactaaccagatactacctacacttcaggctagccctgcgcaataggctagatgataagagctacaatggtgggagaaaagtatgattgcctgtaggcaatagtgtgtgtgtatatgtgtgtggctgtcctgctccaacctaaaaggttaagtagtaaggtgatgttggtttgtgctatttttctttccagaatgttctttttctggttctctacgtggtaatactgaattaacatttcaagtctcagttttcattacttcccttgtgaagccacccatagcttacatagtagtttctccagctttttagacagcccaccatttaaataatatctacctattgttcagatttcactttaaatgccaggatctcagggaaacataccttcataccaggcttagactcccctaatacctgctttcattgtaccctctgttttcttcttcatccaattgtcaaagttgtatgagagcagttactgtgcttggttaatgtctgtctcgtgactaggctataaatttaaggaaggacaaggttcttttattcacagctttatttcctcagggcctagcacagtgctcagcacagaataggctctcaataaatattcctcgacagaataggttacctgcattcttttaaattgtatataatttttcacaattcggacactctcactgaattttgtttccttagagcttggcacagagtgttggccactagaaaatgcttttaaaaagatttgaaagaaaaacatgaataaaataggctaaaatctctcatccatgaaaattttctaaattcctgtaaatccagctagccagctagaataattcctataggtggtttatcacttcctttctccttgagaagcattaaaatcacagaaacctagtgttccaaatatttgtaaaatgctatgatttttaaatttacattcacctagatgtatgattttcttcaatattttttacctatgtataatatttgtataaataacatgtcatcattaaaaatccaatttagcaactaacaacccaggtttctcaatgctcaagctatctgagaagctgtatagtgcagactcaagagcttagatgttttatcagaatgagtatgacctcagctcttcttactggatgtgtcctacaggcaaattgcctaaccattctgagcctcagtttcctcatatgtaaaatggggatagtaataggacctaccctataggattagtataaggtctaaatgagataatgcccagtatttagcatatagtaagtaatgagtaactttgagttttttcttcatttcaacgcttttcattcttattcttttttcattcttattcatttctttcttttctttttcttttcattcttattcaattcttttcattatgattatttagcctgtggttggtaatacctaaaacacatccttatggtgcctgaagttgctcctgagtgcgaagcagccttctcacctagacggtgcacacctcccatcccagatcagaacctctagtcaatgggagagcatatggagttttaaagaacatatttattataatatatacttttatatttagaaaatttaaaaggaatctgttgttttcaagaaccttgataaagaaaaatattctcaaggggggtacactgaattctccaggtgtgtttaagattttttgtatgtcaaaaggtagaaaggaacactggcctagacctgaaaggagatcatttgccaccttaaattgcttattatatgagggagaaagtatcagtctactgtgaattcacaatgccagcagccatttaacagtaactgtgatacttcagggactgggatatccataaagaagcctaatgttgacctgatttacaaattaaggaaaaatttattaattctgtagtgcccatgcatatactatgtctaataaagtgtggaattctcccactctgctttgaattgtgcattttaaatatggagaaaatctttatatcacatcgtattaatctataatcgccccctggtttcagctccaccagcccaccctcccctacaaatacaaacagttgttacacagtataacaattatgacaaacattattttagaaaaaaagagaaatcagcttgccattgtgaacttacttcttttttttattttattttattttttattttttgagacggagtcttcctctgtcacccaggctggagtacagtggcacaatctcagctcactgcaacctccgcctcctgggttcaagtgattctcctgcctcagcctcccaagtagtgggattacaggcacccaccaccatgcctggctcatttttgtatttttagtagagatggggtttcaccatgttggccaggctggtctcgaacacctgaccttgtggtccgctggcctcggcctcccagagtgctgggattacaggtgtgagccaccgtgcccggccgtgaatttacttcttaattctgttttttcccttggagactcttcccatcttctgccgtgggctctctgcatcttgtgacatccagcaatacatctcaagcagggaaactttttttccaaccagtaccaataaatcagactcagaatttgctatatcctatgtatcagccaggcgaatttaaaactctaagaccaagggacacaggttatcaccagctttgttagatagataagggaggatcacagagacgacttgtaacattgcctaaggcaatagtagttctgactctagatctctgatacttcaatggagagtccaaatagacaatccaaatccaggagaaacaatcttcagcattttatacaatttctcctacacgctgaaagatccccatgctgtgtaacaggtcttgatttattctgttatggttccttaaaagtgttcttttgctagctcactttcttaagattttagcagtgtatatacagatgaagcattttagctttgctaattgttgtcaacacaggttgtatcttagaaccatactaagacatgatcatttttaatagtacagttttatgataatactatctaaaaaaggaattttttaaaaaccatctactattttatcacttcagcaaattaaacatttctatttttctgttccttttcaaaatcttgctaaatgcttgcatagtatttgcatatctgtaatcacagcactgataaaattatattacttaaatggattgtatattcatttttctgaatttgccacagagtaatcattttaattactgtatgtaatattgtactatgtagatttgccagaatattataaacccaaacttttatgttgaattgtaggtgaattatatactctttttgctattattaacaaatctatagtcgtcatctatatacatttgtacatttttgttgttttacaaattttcttttggagatattcccagacatgtttgctgtgtcagaggataaggatatatttatgtctatagcataatcaaatttttgctcttttacatatgtcatagtaaaaccttcctgagcagaatgctgctaatttaaaatttagattattatcctagaaaatgattactttaaaaaacaatattattctaaatgttaatactaacatcataaccattataaccacaaatagaataaattaaacatcaataaggcaaatttattgcctaaatttagaacttaagaaagttacttatgtatacttcttgttaatttaaaatagaccttacctattttttagagtggctttccaatatttttgaccactagctataataaaagtactatttatgtggcattgtacattgcgtacatacatatacaaagacatgcaagtatctataaggtgaatcctaaaatttcataaaacaatacttgttcatattacatgcagtgaaatctgatatattccatgtcgttccattgccttttattctatttcagagtcatctatgtttttttcgttccttctttattttcttaagctggctgtagcccactaaattgttttcatgatctcaatcagcagagtgaaaaatcatcttttaaagcagccttgacaatacctaagcttaaaaatggtttactaacattgaattcaatttgtacaatcttttaacttcgaacttggaaccagtttcagcaaacaatgtctctgccagtagtagcagtcatgagaaatacacggacttaaggaaatcaacctgttgtttcgtgaacaacagtttcaaagaaaccacaatctatctttgttttctcgtttgtttgttagctacagcctgatttttggttcagtcatttatacaagttgtgccaaaacctaaactgtatgattggcatacagcagtatttaatttggtggattaatttcttctctggaatggatgcatctaatttctgaggaaaacctcaaatgacatgtccttactgagagatggcatgccaaagtggcttgtggtacctgacataaatagagctgtgaagcatgtttgctgaccacgaatgaacaggttgtaaagggaagcacgtgcaagggtgcttttaagagtagactgggcagggtcttgaacccctaaacccacctggaactcaaagacacagatttcattcattaattctgtcactatccactattctactagaatctataatgaacatcgcctaaactgctaaaaaaaataatatgcgaaggaagactttcattttttataatacttaaaataggattactcctcttagacttctttatacccatacattgcttcacggctcagagacattgctggaacacgagagttaagagcctttacgttgtgttcaagaaattttagagtgtcagtttgttttttcacagtttccaccaaaagcaatcctcttacatacctagaatatattttactgtggtatatctcagtattatccccatatagttagttagattcatccttgtttgctgttttatttcatcatctcacttttaatccattatcttatggtacattatttttcttgtacatcatgaaaatgtacactgcagctgaaatatgaatttttgtatgtaattattgctcagcttttttgagaacaaggaagatacaatatgaaataaattactacttttcccttttggtatgattttaaatttgcttttagaacaaattattatgatggttttctattctgaatctaaatagcctttttttccataagagttgaattaataaatttgttatagctttgcttcatggaactttaacaaacatcaaggttatatttctgtctaatcccttcatcattctgttgtcctatttatgatttttttcttttatttttccactatggagcccacagtctgaaaccgaagcatactattacaactttgtcttcatttttattttaaatttgtcttatttaagacagctttatgttatttattcttaatggaaaatgcactgaggagaactttttttatttgcttttttaaagaattacaattgtgccactgtactccagcctgggcaacagagcaagactccgtctcaaaaaataataataataaaaaagaattacaggtgctttttacatttatgctgtcctcaataaatgttcttcagatcatttgtcctgttctctgatttataattcctaagaggacactttaggaggcatacatgggaggcaatgtaatatggataagctacagttagggatgatataactcaggattgtagttttcctttgaaggtgggtcatacaacttaacctttgctcactttttctccatccataagatggacatgcattaccttgtttatactttttaggaatattttataaatgaataaacatatttatcaataaatgctttgagttatttaaagacactgtaaccatatcatttacttagtaatagcaaaaatagggggttgtgtaatgtcaagtacttatttgaatttgttatgttttcaaaaatggtccatgtttcactagacttagactatactattaaatcatagaagtctgtgtatatgttagggaaaggcgtggggagagaaaaggaaaagagaaaacataccttcactgtgtcccttgtaagtatagtttgtcaggtaaccctcctaacaggcctaggggatagatattattacctccctgttgtagaggagaaaaatatagctgaaagaggcaaaataacttgcctgaacttataatcaatatgtgactgagctaggatttgaactcagctacaaaactcagctttacaggtcaccactcagtttctcagctttcagattcctgctttggaaacatgttagcaattaaaatagaaaagggcagggataatttaattaaaatacttaatttataatgttagccaaatagattttttttttagcttccctcaatatttccattactgctttagttgcagttttggattatttcttattttatcttgctgatttgtccaactctagttcctggactcacaaaaatatacttgctaaagatgcgttaaagtgcatgacctatactgcaatttctctacatagttatttatgtgcttaaaatggccatcttggagagtgcctgaaggttgagctagaggagggtgatggaaggaggggtgattcaacagagtcagggaaattccagatgacatgggttgccagatttcctgctggcctttcactgccaaactccacctcctgctcttcttacacagctgtgtgcttcattaaatagtgatgtctacaaatcacagcagtgttaaaaaatgcagagcagggggaattcctgtgcactgactgctgccaagttcctagagttttaacagcacactcatcaaactgcctctctcttctccaaaaactataaataagttcaatatcaagagtgttttcatcaattataatgcctctctgttctcttggagagttgggaatagtatatagacacattggttacagtgcccatgtctaaggcaatatggtaggggtcatctgttgtcagagataagacttttgaccttgatgttgccactgttcttccagttgagccaggaaccattacttaatcatttacagcatagattttcccatctacaatttgcttttcagaaaccagccttgtggaatttaggccaagaacctggttgctactgctcagagtaggtataggagaggtatgcatttaattcaacaattcctcttgagggtttctgtgtacaaggtcctgtgctgggtgaggttctacctcatctttagcaagtatatttttgtgtttacaatgacaacattagtaagacaaggctgctaatacattcatagtacccgtgtgaggtgagtgctgatgagtggtccactagagttgttaaaaagtgccacaggaacgtggggaaaaaaatagaaattttacctggaggattggagacatttcaaggaggaagtaacattggctccaggctttaaagaagagaggggtttaatagataaatctggaagtactccagatagagggaagaatgcaaacaaacgggtagagaacggagaaattcagtgaattgtcagaatagtgtcttgccttgtgttgtagcagtaccataatgactgacagcctacagtactctgacaatttaaaaaatataacctgttttctttcatgtgggtataatgtctccagttaggcctatccactttttatgatcttataccagctggatccttacactgatgtatgggcttgagcaaagaatataaggcggagataggtaggctgatggaacttccgtgataggaagctgtcatgttggtttggtggatggacagaggaagagcaaaagcatgaaggagaaaagtggaagaagtgtggaggccacttgaagaaaagtagtagctaaatggtaggcaggactcgagtcaactttcttctggaaagtttcaggactgaatctggaaaaggaaaacacagaacaattaaaattgatgtgcatttattgagcacataccttgcacaaacactacaataggcaccgtggtagacactgagatacaataatgcatttccctgtcctcacttacgaggacaggaaacagacacgtaaacaactaactactgcacaaggtagaattcagtcacagaggtcagtttgtcacagaaatatggaagaagacatttttgattggagaggaataagaaagttttctgaaatattctgaggtaagaagtgaagattagctaggttattaataagtcttagtccactaggagtgctgtaacaaaataccataaactgggtaacttacaaacaatagaaattctcatggtcctggaggctggaaagtcttagatcaaggcactggtggattccgtctgatgagcaccagctttttcataggtggcaccttcttgttttgtcctcacatggtggaaagggcacacagcagctctttgaggccttttttacaagagcactaatcccattcatgaggagaggcagtaatgatttaatcacctcctcaaaaccccacctcttactatcattaccttgggggttaggtttcaacatatagatttggtggggtgagggtggggacacaattattcagatcacagcaataagaagacaaatatggaaaggtgtttcagattgaaagacagagtaggcaaagagaaaggttataaaatgcaaggactatttcagaaatgaaggtaggattatgaattatgttttattatgagatgagtttaagctcagatcattaggtgtcttcagaaccatgccattgagtttgggctttgatcttgagagggagccattgaaaatatctgagatgtcaagtgacatggggacatctgtttttggacttaggggtgctgggaaattccactattgccacatcttaaacctctaagaaagagctaggtttgcctgggaattctcccagaccaccacagcacagacagagaggtcagattggatttcctgattatttggcttatggtcagatagattgagatgcaaaaacctcaaaataggctttatggccacttcatctccatttgtacccctgcctttgggctttatagcattctgtttattctgtgtatttctgacacttaacacactgcctggcaagtaactactcagtaaatgtttactgaatgaatggacaaactactaacttgtttcaacagtggggaagaggccaattatcagagcttgagtaaacaatctacacatgagcatctggttttgagctgacagacaactagcctttgataccatcctctggtccttgagtttttggataaatacttcattttcctgagctgagttcttttcatttgaaacgagttcatcttattccaaacgtttagggggtaatctcaaatgtacttcatctccaatgaactgatccagttttaacttcagaaagtcaagcttcacatctcccaaatttatttgatttttgaattttgaaaagattagagactgaagcctgcataaaataacaaaagtaattcaaaaaagtgttatatataccatagttgaacaattaaattacaagttcaagtctaatccaactttttaacttataacattatattaggtgtatattctgtgaataactttatatccctcttcataattataattgatgcttttataaattttataattgatgcttttataacttttataattgaatattatttcaataaataagtccataataatataataaaataagtagcaaatcaatttctaagtctgagaggctttacaaatcactaattagaaaatatatgatcaagtgaaaaattttttgttcagtatggaaagagtgattaaaacctggtcttcattctctccaaagtacggttttaatagtttctgttgatccttaacacatctgaaacctaaaagcaatttagacaaagttggattttccaactcttcattttatatgtggtattcacagatcctcagtgccaaatgattatctgtagatgaattaaagacaccccgtaagtggaattgtgtgtatgtgtatgtatgtgtgtgtgatgcaaagcgtcacaggaccctcataaggtggactttgggaaaggtactattaaacctctaagagttctgccttcaagttctattattctctgccatgacttttgggaaagtgatcatgttcccggtgttctgaaagtttaaagagacgtatgcaaagagatgaggttttagcaatcgctccagaaattatcccatcacatagtgtaggctcattgcctaagaacagaatataaccgagaataatacagaaatatcaatatccaaggacaagtaccgaaaaacaaatcttgttttgacagaggtctgttaaagtgtatgttcgtacaccaattatgcggaaattttgagaagtttcttttctgtccatcctagtaatgtttgagtgacttggttgtgacttagaggcctccttttcaagactgtatctctcactgatgtacaccacagtttctgataggttttccttggctggagattatccttacatctttccaaaattctctcaaatatgagaggcctggtttctcaggagggagtattgaagaagggcatacataaatgacaaagagttaattcagcttgcttctcagagttagagtcattgaacgtaaacacacacagacatacatgtacacattcatataaaaagcatctcttttttttaaagtgctgtctaaaaagcaaaatagaacaaaaatccaagaactcaaaaattctacacaaccagagaagcactgggagagaaacagtactgtacgttcagcaaactgttttattttcctcttgcacgtagttagctatatttttccaacctcccttaaagttaggcatgggcatgtgacttggttctaactagtgcaatacaggcagggtgcttcatgctgcttccagatgtggccctaaaattaccatctgacccttcacttgccctcgtttcctccctttctcctcccttctcctctcctctctttatcataggctgaatagagaggacccagaagaaatctttgaggccctagaggactgctaagccactagatggaaggattctagacctcttagtcaccctgagtaggaaagtcacacaagagagctgccagaagggaaatatctgtgtaagattttgtgtgagaaggctgattatagcatttgttttgaaattacggcatttgttttttcctgtggttatcttttaatctaaaacaggaagcattgagggtatgttctgatcacttagaagaagataaggtataacatccagatttgatctctctaagaatgtgctacctttgctattctagggaatattccttgatataaacattaagacctattaggtatatacatttcagcaaaagatgattgtaattacaaactgacattgatggtaaattactctatacccttaataaggtcacgggttgtgagtctgaaaccgtctctctggtggtttgggacatagccaccatggtatgtaaatctgatgctaaaaattggagcagctagccatgtgaagaatttggatactgtacataaaccacaatgaatcttattgtggaatagtaaagatttatcactgtataaatttctgtgcactgatttggtctgtttgtttttcttttgttagaaaaatcaagagaccatgaaattgtttgagaaataattctaagtctacgtgagcactgaggcttcaggaactgaaccatgctcttctgtgcccatcccttagctcattattctcagagggatgtggatttcactttcaaccactttagcttagatagtgataacaattacctaccatttattcagtactcactacgtactatactaaaaactatatacatctcatttactcatacagcgatatagcacattaaatatttttattcctgttccacatatgaggaaactgaggcttagaaagtttaagcaacttggttcaagtcaaacatctgtaatgtggcaaaaccacatttctaaaagtcatgttcctaatcagtgctcaatgcatccgttactgacctttgtattctttatctgtaattgtattagatacctcccttttatgtataatgtccaattttataaaatatatttttatttactcttgagtgagatcaaaccccaggggatagcatatttgttcagggccattttgttttaatgattttacaccataaaatttgtttagattcttagtcactggactttgtggaaagaatgtcataatttctgtgctgaatttaattttaaaaagccctggaaatgctacttccatgatcccttcccttttaaagagagagaatttgccaatcatctttctcactcagtcccaacattggaatggtgtcattaggaaaggaaattttcagctttcacatcagtaaacacagtggagatgcaagaaatccatagttcttactcggaaaggactgcggaattttatgatattctgaattttatagcccaacatttttaaaggaaccaaaataaacaaacagttcctcagttgcattctttttcccctttggcactagtctatcttatctgaaattttttcagttcatctacttcatgataagcacttttcttctcctaggaagagctatcagaatctcttagtatcttttttttttttagatggagtcttgctctgtctcacccaggctgtagtgcagtggcgcaatctcggctcattgcagcctccacctctcagcttcaagtgattctcctgtctcagcctcccaagtagctgggactacaggcgattgccaccgcacccagctaattttgtattttcagtagagactgggtttcaccatgttgaccaggctggtctagaactcccaacctcaggtgatctgcccgccttgggctcccaaagtgctgggattacaggagtgagtcactgcacccagcctcttagtaactttctatctaattcacactatcaattgcaacaactgaaatatcaacatacacgtatacgaactaaacaaatatgtacacacacacacacacagtgtttgctgtcctaaagctgctcccatgtttcaacatctctgaaattaaagagttattatcactatttaataacctttccaacatgcaaacacatgcttcatctggatcaatcacagataatttcataataaataatgtactaaatatcatcttccacactgatcaagagaccagcttgagagagtgtgtcatgtaacttttgacaaacacaataactttgaataataatttgcttattagctaagatttgggaagctgactgcttccagaagcatctggatgggataagaaatgagaacagctatactgttttcatatagctatactgaatttgaatttctttaaactcaatacactaaaaatatgacctcacaagcctgtaggtcacagataaaatctgaaattaggattgtagacatcctgattaaatgaagttggtctcattaaccaaaagtaatcatgcttgttcagtccctaagctgcttaatgcttctgcaaaatctgggaattaggcttgaggatatctcttctgtgctgcataagccctttcctttaaagcagttttctttgtgttctttttttcttttagcttgaaattggacccagcctccaaaagtcagtctttaccctgagcttagaaagggaagacatagagttagtagtaacaggaaacatattaaatgcaagggatagaattaaagaatgtgttaatgtggaaaaatgagaaaccttgctatataatccactatttctgtcagactccaagaatctaaaatggaaaattattcaagaaagataacaacataagagaatgcgctgatggaggaaggtctatattggaaaaacaaaaacaaatgccaatctttacagagggtaacctacaaggatatatcacaagcatctacaagtgatggattttgattcccaagtgtgtggagaaaactcctagggacaactttgcagtgaccagaaagccatgattgaataaggggacacatgttcctgggataggagtgatcttgtgtttattttggaaagaattatttaaagggaaaaataaacctgatgtattagtttgttttcacagtgctataaaggactacctgagactgggaatttacaaacaaaagaggtttgattgactcagacagagtttcacaagactgggaagacctcaggaaactgacaaccatgacagaaggcaaaggggaaggaaggcgtgttttgcagggtggcacgatgggggaactaccaaacacttttaaaccatcagatcttgtgagcggtcactcactgtcatgagaatggcatgggggaaactgtcaccgtgatccaatcacctcccatcagatccctcccctgacatgtgaggacaagatttgggtggggagagagagccaaaccatatcacctgaaaatactgcataaataacatttagcaggctaagtgtaaagacctttatcacatcatttagaaattcaatgtttcaattgttaaagaaacatgtaaacatataatattgttaagttagccaactaatataagtgattcagttttccttgggggtagagaacctatacatgtaagatgggattgtcatttttgggaaaggtggaaaaagatggaaattacttttgagctttactttgaatcatttatctaaaaaaacaaaaacaaaaaaacaatgtagcctatacttttggagaggggtatatttaacagaaataagaatataaagaatatgtgaagaacataaagaatacttcggaatatgaatgtctctagctctttgtgaggagctctgacatctctcagacataactgaatgaaaaagcacaaatttctcggttgccgtaattgaagtgtagggtaagaggaaaatagcagcaagaacaaaactcacagatgcagacaaggacaaaagccatagacgcacgaaggaaaaacctgcccacagaaaaacggtgttctcggtttggtaaaagtgagagaacttgttctttgggaagccaggcagctcctagcaatcacaactttcttttgtacatactcagatcatttattttaaaacgaatcggtagccttttttgaaaatactcaaacttgtccttagttataagcttcctaatctgcgcttgcagagtccatgatgctcagttggctctccttgattatgtgcccatattcactctttcatatctattctttttgcatccgatgtatcagaaatctgtttattcctccagatttcttttgtaaagttctacctgaccaatcaacacatctagtccctccattttatggcattatcatgccataaaatgttatcttcgagtctagtccagcaaagtttttctgtaaaaaaatcagattgaatattttcagctttgcaggccatgcggtctctgtcacagctactcagctctgccgtcgcaggttgaaagcagtcatagactacacctaaacaaatgagcatggcttaaacacgctgcaaaaacagatgagagtatgtgggtagcagtttgtagatccctatttcagagagtcttctgtttttcttgagccagatctccttcgtgagcgcttttctttggaattatgctcctctttttctctatgaactttaaaaagcaaatttctttcttgaaatgtagataaagcctgggtttgtcctctaagtactgcatttgagaagcattgaacaatcacataaaccttaaaaggatttttattcatttaatctcatttattctgtttctaaaaggatattaaagaagatccagttagtaatcttcagtagcagttttcactgtttactcttctctcctgccttcacaagctacaatctattcatttttcctctgccaaaccctgtctcaaattcttgcccccagcaagctcggcccacaaggttttcattttttccacgccacctctgtctcagagctctttgttttgtaggtagactaaagcatcattgctaaatttgttcatctgtcttctccctccatcattctcagatacagaaatcaaagaaccaggccaaggaggaagaatcattgaagggaagatcaaagcttgtgaacactcctgattttaaatgtttatcctgttaaatattatttttattatcattattggcttaagtatatttcatttacttgtgaaaaaacttctcatacattgtacatagaatgttctcattagacaaggccttaaagaccatcctgtctccaataactttagatagtgcatctcttccattaaagaagactgaatcccagcactttgggaggctgaggcgggcagatcacctgaggtcaggagttcaagaccagcctggtcaacatggagaaaccccgtctctacgaaaaatacaaaattagccgggcgtggtggcacatgcctgtaatcccagctactcaggaggctgaggcaggataatcacttgaacccaggaggtgaaggttgcagtgagctgagactatgccattgcactccagcctgggcaacaagagtgaaactccgtctcagaaaaaaaaaaaaaaaaaaaaagaagaagactggaggctggcagggagcagatagggagatagggagagactctgctacacattcattatccagcatctcctaacagactcagccatctcacactaagagacagcaaacaaagagaaggctcccagcagccacatggcaatcacactggaattaccttctgtgcaccactggacagctggaggggtgaggccagagggcctattcgtaaacaagtctctcccagtcatgtccataaaggcatttgcctgtaggaggtgattggcttccgatgaagttgctataagaggacactgacagggaagatctttgcagagatttagaggcctgatctgcaatttaggcagagagtttttggtgcagtaggaagtttgaagaagtctttgcagcagtagttattggtttacagtggaccgtctttaccagaagtcgtgaatagattttctcagatgaattgcctgtcatcagctgaatgttgaaagaactagggctacttgtgtaacagagagaggaacaataggttgtgggccttccaataatagaataataaagtaggaaggatgcttagtgattttctagtattttctagtaatacaataaccttctattacacatgggggaaatgaaaactagagagagaaagggattcccccgtagttacctggctagttagggcagacagtgaaaaatatatggatctatcaggtgcttttttttttttctctgcattgcccgttgtgattggaaatattaactgggtggcaagacacaacaagaatccttgggttgctctgctgaagtgggcggcaggaaagtataatgatccatcttgctttggaggttcagctagaactttgtttcataaagggacttcttcaaaccacctgggaggctctcgcttgtttcacatgcccagacttacctccctgggcgtaaggagtatccagctgcccaggtgatttcgatttgcttatcctcgccacttgagactccttaagtctagacagcaatggttctgaacctcaccaagcattacaatctcttgtggaatttctagacttttaagtaatattccagctcagatttaagtctgggaaattctgatttaattgaactggggtagtgcccaggcatctgtattttaagcatcccagatattctaatgtgtagccagctttgagaaatacagggctaaaggaagcctgaaggtttaagcctggaattaaacaacagcaagaaagtagagaagtaggaaggatggattggagagatcttactgaggatgaattaggtcagaagaatgtcattgcttaagaggagagtaggaaaggagagacaagaaactggtgagccttcctaggagagtaatgaggttcaaacaggctcaggtggaagctctctgggggccagattaaacaaagacagcagggcttggaaagaattccgtgaagacgctgatctaccctctctagactgaagtatatgtggtttcctcagcataaaggaatgacagaggacaaataactcagcaggaagtgtttggaattggcaggtaaggaaaaataataagggagcagccttagaaggataagcgcgtctttagtgtcagcaatccttgggctgtagttcatctgataacaaggtcaaaagtctcctgtaaaatgcacgatagaatctttggaccagagggccttagagctcaggggaatcaaccccttcacttcacagaggaggaacttgaatcccaaacaggggcagggacttgcccaagatcccagccagtgaacgcattgggcctgtaaggcagggctctgaactctgttcactcctaggagagtccgcacagtgcacagtgtgatagttaagaactactccaggcgcagaaagctcatgtaccttccccaaagttatacacctagtaaacgtgggtgtgtataaaacaccaactttctcatgttttgttgggaggattaaatattcgtaaggcacttagatcaatgcccagcatgcagtatgtgttatattaattataattattacatcatactattttgttcaagtattaaagtgacatcacagtgaataagactgaaatcttgtctatttgaggacagatatttagagaaaatgcagacttattaaagtgctctgtctttaataaaactctaaacattagaatttaggtgaatactgaagccatgtgttttcaagtgcagtttgtttaaagtgcagatttgtaagcctcagtccagatcatttgaaacagaatctcttggaggaagggacaaggaactggcattttccagatgtactcccaagtatttctgttgaactgtaaagtgtgacacctaccgctccttactggggaagtggagtaacctaaggtaaagagtcaagacctttttttccttcagtgatatagttactactggattctccttctcaccattacagatatggaaattgaaggttagagaggttgcatagctcgcccaaagttattaaccttgtgaatgacagactagggactctgaagccatatccttaggaacccagagttaccattctcccggttaccatgtgagtttgagcatttttcttatctattaaatgggttcatgttggtatctaattcaagggatgttgtgaaaattaaacaatgcctgtcaggcatattgcagatactttgctcatggaaacaatcaaatgatagctatcgattctcttattgatgttagcattgttacttgtccttttcaaatattttattcaacaaacatttgtttgacaccccctctgtgccatatactgtgctaatctgtgaacccacaaaggccagaaactaaaatttggtttttctctccatgaaccaaccagtcaggtaggaactgtaaataaagatctgtaccatagacaaaatgtaattctgatcagagaggaacaaaatgtgccctgatgatttagtaaaaacaaaacttatctaccaggtatccttaagaaatacattattctgggtagctgagttttctataatagttgaacatatacttgttagatagcattttatgtttctttttgtattggaagatagacatttctgaatataatacatacttactttttaagccaaaaatagtgtgcaccctcaggattaccatggggaactttattttctgggttgtgttatcacaccaaaatcctcaggggcttttgcaagtacttttttgtttttgtgcctggctttcatttttttttttttttttttgtctcattgttgcaaatatccactccactcctcacagaggtcattgcaatataccagaaagaataaagacttaggagttatccaacctatatttttatactaaccctttcaggctgtataaattaagccattcatccattcaacaaatgtttatgaatgcccagttgttatattaggaattctgttatgtgtagggatgcgagatataaatgtatcttcaaggttctatagtgttaaagtttccctaattgttcattacttttttgtggtatgtaatttatattatatttaattcttaataatgatttattttcataggttattggggaacaggtagtgtttggttacataagtaagttttttagaggtgatttgtgagattctgctgcgctcatcccccaagtagtatacactgaacccgatttgtagtcttttatccctcaccctcttcccaccctttccccggctccccaaagtccattgtgtcattcttctgcctttgcatccgcatggcttagctcccacttatgagtgagaacatatgctgtttgtttttccattcctgggttacttcacttagaatgacattctctaataatttctttgcatctctacagtggagctggggcaataactaacagagatgttttgcaagagtggaagacaaatacaattaaatgcacctgggattcaaatcccctccatctcctctgttcacattctgtattcacaagcattatggttatggaacaccttcgtgctgagcactgttccaggccttgggggatgcatccgggaacggggcaatcagctcatgttaagcttacattcttcaggcagtggggtggatgggggtacgggagagactaacaatcaacatgtaaatatataacacagtctcggataattgatatttaaaaaatatggggcaaggataaaccagcaatcgatttctttttctcccttacttctcaccatgatttgcacaaatgtgttgcttaataaataaatccttatgatttgtatcagactttactgctagatactattttttcaaggtgttatacctcattgtgaaaaaaagtctaaaggttgtgatttatataaaccacatttcctgtctttagtcaattttgtgtatttaatttactaaaaatgaaatttaccaggacaaataattaaaacagacatagtatatataattattactttgaatgttaaggaattaggtaaacatggtaatgtgaagtttatacacaagacagaccctgtaaagtccactttcaaatagggttaaagcataatcgacagaaaatttaaaaaataaaacataggacttatcgggactaggaatataaatatgtaaaaattaatatataaaaggaaattgttcctgaatggcaagatgactaattttaaagtttaaaacttctatttttatgccaccaaaacttaataatacgtatcccgttgtgataaagtacattttaaagactctgatttaagctattttactaccaagagttggaacaaataaagtcaggacaggtgaaaatatatatttccttcactttgaagggaaccacacgagggaatttagcaatatgggggcagatggtgggggaggaaatcctgcttcggaatgtgagtgtgtgaattctcagctttctgccatggttctttgttactactgattcttcagtgcaacacatacatagccaatacaaatgtaaaattattttgcaggccgggtgtggtggctcacacctgtaatcccagcacttggagaggctgaggtgggcagatcatgagatcaggagctggagatcaacctgaccaacatggtgaaaccccatctctactaaaaaatacaaaaatcagctgggcgtgctggcacgcacctgtaatcccagctacttgagaggctggggcaggagaattgcttgaacccaagagccggaggttgcagtgagccgagatcatgccattgcactccagcctaggcaacagagcgagagtttattttgggtggggcgggggggaatattttgtcatcattgctagtgaatgtttggaataaaacatgtacagattaggcaaatttatatttaagaaaaatccataaacacgtatcttgttcctccatatgaacgtcactcggtcttactctctgggtgggccgatcgtcttatcactgagtagcggcagtccaaagaatgaggctcaacaccttggtctgctgctattgatggaatatgtgatcttgacaagtattttaatgttattcagctgtagaatattgacaataatattcattctatgacatcgaaccatatgaacttggtagcattccaccattaacctacaaaacaggaagttcctaaggttcaatatgatacataattcatcatatgactatcaaatggagtatgtgtgaaagtgattttgtactgaagtattccaggtttgaatcattatgtagcaatagactattgaatcatatctttgtgatatatcatgctttatgaattgggtcaccatcccatatttaaagtgctaaaatattaatgaggatggtaagaaaaatacatgaacagttacaataaaaaaaatcaggtgtgaaccgaggatcctgcctcattggtccagggtcacttcttatttccaggtccacatctgattgcttgtaattccctgggatgacaaatattagcccagtgatctcccacctttattttgtactccacatataatggtccaagagaaagtttctacaacttcacaagtattaactcaaactgcaatttattttaaaatctttaaaggtcttttatgtacatcaggtgttagcaaactttttctacacagggccagaaaatatttttgactttgcaggtcacatggttgctattgcaactcctgaattctgctgttgtagctcaaaagcagccatataccaacacctaaataaatatggcagtgtccttaaagactttacctagaaaaacaggtggtgggatagattttgcctgtgagtagtagtttgtcaacacctaatccagatgaaagattatggtgcagattcttcactaagctttcagctatgggacttggattaggaaagtggattaaggtctataaaatctttgaaaatcaaacccaatcacttacatgtatgtcagtatgtatacttcatttttacttttttttgtttattgtgtaagattgttcagaactgtcatcagattcccataatagattctataattgagaaaaggttgaaggccactgcaattggattattttctgcatgaatcagaccagtatctggaggttttagggcagtaaacctttcctcaatttttaaatcactcattcagcaatctgagttgtctgacaaagagtgagcagccttatgtggtacagatgctcggctgaggttgcaagatcactgttaataagttaagagtttggactagatgacttaaggtacttccaaccattaggccttataattttttccaagaagttctactttttctttttccatattttcttttcttttttgtctaaattcaatttatcacattctttaaacctaagaaacctcctctacaggtttctatttccccatagtccttcctgagctccattttcatgtatctgggtcgtggatgttacatgcatttttcttcaagtgttcacagttgtgtaaaaccctaatgtattccaaacctgatgtcatggtgattacacttattcaaatgtctcctaaattctaatttgggggcagtttgtcaaaaagtaccctgtttgtaagcatgcatgttactgtgtttgcatgctataatgctaaaatgacattttaaacaagatactcaagtattccttatctttgtcttctaccaaatgccagattctagactgaaatggctcggaatattaactgatgaatttagtatagtagagcgaagtttgagaacatgttttatgtttgtggagttagtacagtttgcaaaagtgttgactgtacactttatgtctgaagagctttgcctaaggatccaggatggctaggctccagaactagatacttgtggacttcctgtgggatatgagtaaaatccctatgagtttcgtttataaaaaaaaaaaaaaggagtagagatgatgagaaataaagccctttctagtttttcccttctacggatctgtccaaaaaataaaaaacaaggaaaataatgttttttaagtgtcagtatcttattagttgaggcaacagacctacatacacaaaatggaaatgccatttcaatgtgggtaaatttgtgggtaaattatgatagaatgaactaaggacaagaatacttaaagcatgccaggttgagggtgtgaacccaaacaagatatataaatattgtatcctttctaggtgagctcagtgttggcaaatgcaaagaatatgacttgggggaagatggtggattatgtaaaaggtcaatctgtaagggctcaaggatgaaaacaacctgtaggatacagctgatgtaatagtttgctttcatgctgctatgaagagatacctgagactgggtaatttataaagacaagagatttaatacactcacagttgtgcatggctgggggaggcctcaggaaacttacaaaatggcagaaggcacctcttcacagggtggcagaagacagaatgagtggaagcagggaaatgccagatacttataaaaccatcagatctcatgagactcacgcattttcaggagaacagcacaggtggcggagaacctcccccatgatccaattacttcctcctggtcctgcccttgacacatggggattattacaattcaaggtgagatttgtgtggggatacagagccaaaccatatcagctagctaaacaatttgtaaggagggtttgctcaaaagaatgagagacaaaggtgattagatttttgtcaaggatgcagggttaatgactgtaaattctctgtcacaaaaggagtaacctaatgaaaattctgcttttgaaggctgatcattacatagtcctttaagttagaaaatgctgactaatgaaaaaggcaagaggtttagtgggatggggagcatgagtgaagggcattgtattcagagaaatcattacctttaaggaagaaattggttaggataaagaatgggccacaaaacataagacgtcagagaatttcataattgagagagaaaaaggacactccctcagaattaatgactgccaagtttgggctaaatatgtagaactttaatgggagaaattcgcggttggactgcacagtaaaaggtcatggaagaagcaagccgtgaagctgtgggcaatcagatcttaagacaggtcatggtcagtcaggagagaaaagatttctgaagatgaaaagaagccagtaactaggagaaatgagtgttgaaatatgcaaaatagagttttttaagaatattggttcagtaatatataaaaataaattccttgataagaatttttgttcaaattgtggcaaattgagatattaaggcatacacaatgctctaaatgaattttattttttgaagttgtgttttctgagagttaagctgacatggatttgagttgggatgagtagagagataaggaacttcatatttttccatttgaggttgaaaaggaaagatttccatctaaggaaaaaaaaagatgctaatgggcttaatttagagtttgcaagtgagttttggaggcaaatttatctcaagtttatgaataaatttagtcctccagggtccttgggcactgttaggtacaataaaaaggcaatacactaaaaggcatcaaggtattctttggcatcctcaaaactaagtatgatgattaatgatggaatagttatagtaatggcagggtaaattctaagtattggaatgttttctgaactaaaaatgtaaaaggaattgtgtggtcaggaatgcttctgaagctaacccgaagactcattttgcaaaagatctagggaggtggataatgaaggcttaagcaataattggatggattgataaattggatggatggataggtggaagaagtcatgtttagagttttgaatcacttttatctaagggttgaggatacttccagagtctttgagggctcaagtttccttgagcaatagtaatcctaactgtcttttcttatattacctttgagagtcagttccttctggcaacattgagaatctgcagaagggcaagcattctgtaaatatcattcacctatcattacccattttcttatgccaattttctggtcatatcgtggaaaaaggctgactattttgatgagacagaattagtaaaatatttagttatttcatagaaaaaagaaatattcctcttaactatgaaaacttcatattgcccaagttttgtggtgaatgaaaataaggagccacatatgtaatttagcaaagcacgaatttgaaacaatataaatttaaatctcagatttattaccaacacctgagtaacaacttccctatccttgctgaacgtaaagatcatcatgtataaatgctgacattttgtgaggtcctcaaaggtttatacctatttgtgatcccatcctcccaatgaggatatcccagtttgatcacagttggtgaggaggaggtccctccaggcctgctctattggagatttctcctgcaacattctctcttacaactgctgacaccctgtcaaggaggcctttgagccaggagatctagtagcatcaatgagcttctggtctgcatcactactaagtgctattttattttgttaaatgagtttatattgatgtttctatacaatcaagtctatttgtagttttatagctttaagtttgcatgctccaatggggagtaagtgtggaaactgttaaaagaagtcaagggttagacaattcatgacaagaatttgtttctgatgcacaattttttttcttattggactatagataaagacttagcaccaggcgctctggctcacgcctgtaatcccagcgctctgggaagctgaggcaggtggaccacctgaggtcaggagttttgagaccagcctggccaacatggtgaaaccccatctctacgaaaaatacaaaaattagccgagcacagtggtgcatgcctgtaatcccagctgctcaggaggctgaggcaggagaatcgcttgaacccaggaggcagaggttgcagtgaaccaagatggtgccacaagactccaggctgagcaagagagaaagccttcatctcaaaaaaaaagaaaaaaaaagaacacttaggttttcatgaaatatatctggtgtgaaccagtgaaccagttcttcttagatttcagcttttctgtctgttaaattagaaaaactaagctagacgacctctcaggtctattatttctaaaacccatctatgcagctaaggttgtttggaatctgaaattttagagatgtggagattttcaagcacactgacagaaaataaaggtgcaacagactaaaatgacaacatttagggaagaacaggcaaagcaagagggagtgcagaccattggcagaaacctcttgatgttttcagttcacttctgtaaagttctttcttcctgaattaatgcagagtgtaagacagttaatccaagaaaaacaacttgaaaagaaaaaaaaaattgacttcgggctttctatctttaggtgtgactgacttgacaaaaacctttgaacagaatgattgttctatgagtaaattgatactgagagtcacccaaaggtaaagacttggaagataggtaggatttgcttcactcttcttgccctatggcaccagctaatctttttcctctttttctctcaataatgtttcaacatatttatctataaaatggaaattaatactgagcatgaaaagaaaaggccatgaaaatcccctaacatagaccgttaatttttctttcctttttatttttaagaaacagacactttctttaactggacttttgttcagaaccctaatataccttagacaagaaaaagctgaacttcatggtgttaaggaggtgtgtatcaagtcccaccgacaatggctgtttctttacctctggtgaacacactgagtcaccaggaaactgaggatatctggaaacacaagctgaaaatgactgatctattccaactcccctccaccacccctgtcttttgtaataaagcccccttgaagccctgagaggagtaaagttgcctcatttaatgtagccagtctaagacaaaaatgatctagaagaaaatgagtggtgatgagggtattgttttgacccaaggttacagatggaagggagggataggtttcatataattactttatttttatgtgacactttaaaaactcaaacagaccattcaaacacactatctaatcagtttaattcagcaagtatgtcctggatgcaaacgatgtagcgcgttttgtggtagaaccaatgcattgactaccaggcgctgtatgacaattatgttgcacatttaaagaaagcctctcaaccaccttctgagggaagcatagttgaagaaactaaggttcaaaggcattgagtaacttggccatggcctcaaagcatgtcattagcagaactgagattgaacctaggtcagccccattccaaaacttgcaattcttcaactctatcctcaaggagctgtaaaaccacaagaaatacagagctgagagagagatgtttcacccacaaattacctaaaatcctctgcagcaggttaattgttgaacaagcaaagtaggacagagtagcattgatgagatgaaataaaagaacaaaattcaaaggagaaaaattatacttaaattaggaactaggaagtactaagtaaggaagagagcactgagggttgggtaggcatgggaaaggcagtggggtggagatcctggtctccatgctgtcacgtgcaaggaagctgaagtttgaggagtctggaggcttgttcaagttttcacagctgattatggtgacattagaaatacagggaaatgacttttaggagtaagaacctagggataaaagcaaaacaaaaaaaataacaaagtaattacagacaggaaccagaacttactatgtggaaataagggaaattatagaaatagatgatgagtatggaaccagtgctgtttttctctcttctgccttagagatgatgtcttccttctatgtaacactcttttctgaatctgccttggtctttattattgaagatgttggtcacattatctatcagtctctttagaaactaaatctacatttctgccaacttaaaaactcatactttttcgaatctcacacactaatatcattattgttgagagcctatttgtgtggtgatgtttaccttctagtgctcacctggctttcgagctatcaggcatcccgtttggatctttggatgttggggatgtccttatgggtccgtgtatatgaccactcatatgggagtttatctgcattttggttttggaataattcatgcctttgttcatttctgtttttgacatttgctatgattgcatttacttttattttttcctatatttcagttttatctgaagacaaattttagtgtaaatcaaacatattcaaaagtgtcatcttgagagtatttataagtttcacttcaacgttaaatctatcaacttttacttcttctctacttactatttggcagtaaataaaccaagtcagccacaatctcaaaagagaagtgaagaaaattaatatacccttttaatttaaagatacaggattatcagatggtcttctaattatagggacctccttaattctcataccccactctcccatttctaccaatttaactttgttaattccttccctatataactctgttttgacctcatagagacatagttttcttcctttctttcttttctttctttttctttctctctttctttttctttcttttctttctttctctctttctttactttctctttctttctctctctctctttctctctttccctccctccctccctccgtccctccctccctccctcccttctttttttttttttttttgagacagaatttcactcttgtcgcccaggctggcatgcagtggctcaatcttggcacactgccacctctgcctcttgggttcaagcgattctcctgcctcagcctctcgaatagctgggattacaggcaccggccgccaagcccagctaatttttgtatttttggaagagacagggtttccttgccctggaccctcttcctgccctctccagtctgaatccaaagctagtctttacaattcccttaattctctgatgtaacctattcagtgaaacaacagtagtattgtttttatctattttgtttgttcccttccccagtggtataagctggagataatcacttaactgtgtaggttgggagatgacaaattcatgttttctaaactgattcacatttctaaaccctcacccttttttcccagatagtcacttaatgtctgacccactcaattttcagcagatggccttgtcttcctcctgcttcatcaagaaaatcgaagtcatcagccttgacttctatttatcttctatgaaaacctttatatctgtacttaattttgccatctacttcatcctagagtgagggattaaggggttttagttcaagacagtcctctctacctatgccttgaccttttccaacctgcctattccaggatttcttaccatgccattccctttctttccaggatcttgaaattttctctctccacactagctccttcctctttaggcataattcaggttcttctaatccaattgtatccaaaaaaacatttcttttgcacacccccatttactcctcaaaacactaaaatattttgagggtgtcattaatctacagaaggttctaatgtcaaggttgcgaatgacctccttatgtcaaatctagtaggtatttttgaggtcttatcttcctagatcccattgccattgagtactgttgattacttttcattttgtttttaccttggcttctaaaataccataaacttctcagggtctgttagttctcaggttttctaagtggagccccacgtgccttttctcattgcacctattctgcacaggtcgttttatccacgctcacagattcatttttcccctatgaggaagatttctgtttctaaacttttggtctatttttcttcctagagtttaaggcttatttaagttggtttcacttttttcatatccctaggtacttaaaactcagcatgctaaaatgcagtttatcatctctctttcttcaagccagatcctccaactatacttactgatgtagttagtggaatcatcaaccacacggttcaatcaagctggaaacttaaagtcatctttcactcttcattctcccttcattagtaacacaaccaatatctgatttagcctttttactaataattgactttgtccctatcatctccattcccattgattttgcccttttgttgtcttaccttaactgatgcaggaacattctaaatagccgctttacccataaactgacatgctgtaaattcttccatcacacaacttccagatttaccaatataaagcatagtctgactgtgtctgtctcatgaatactgactgtggtgatagatacactactccacacgtgtgataaaattgtataaaatgaaatacacacacatatatatatacccacattcgaataagtacaatagaactgaggatttatgggtcaggtcactggattttatcaatgtcactatcccagttttgatattatatggtagttttacaagatgttgctatcaagggaactgggtaaagggtacatgggatctctctgtattattcattacaactgcatgtaaatctacaatttcctcaatttaaaatttatttaaaatattttgagatatatattatttaaaatatacatatcatttatgaatattttaaatgatatatatttatatcatttaaatatataaatatatctatattatttaatatattttgatatatgtaaatatacacacacactctttctctgtctctctcaccataagtacagacataggctttttaaaaacatagcatataagtttcttcttacctctctggcttaatctcccagcattctctgccccaaatttttcaaaatattaacacagagatgcttgtgattttctcacacataccaggctattttccattatagtgttttgtttatgctgttgtcatagagtgcccactgtgtaccattagctcttacctgaccttcctaattttcatcagcaaaggctctttccttgattcttcaaataaaattacattgttcatctttgtgttttcgtagtgctgtctatactgctaacacatttactgtaggtttgttttcctgtctttccttctataccatcaattcctagaagatgagacagtattatacactttttatttccagtttccattatgcttcctggcaaataagtcctctatgcatgtttaacttgagcaaatgaatgtgctattgcaggtagcttggaaatcagcattcataaatctaatagtattatcttctactgtattactagaccagaacacatatttgaaattttaagaagatgattgactatcctcatacagtatttttctaattctttataacaggaacagtaacacttaagaacttaactaattttatcctgggataaaattagtctactgattatcacaacaaatcacatattaagatgatctgcccggataatatttagacttggagaacgcatcatctgagaaagctgatgttttcctccaaatatataggaataaatgtttggaaaaaataagtaaagcaaacttcagggctcagcagcaaaatgaagcaaacagaaataggattcatttgcaaagtgttcagatgtttgcttattattaagtctaacatgcaattctacactttaattaagaaccacccacacatcaaggtaagcaactggcaataaaaaattaaaaaatattaggtccacaggtttgagtttattgtccctgagtgtgattctaagattgcggttatgggagggatgactaatctgaggaaaaaatttaaattttctgagttcatttctgtttcctggttctatttcttacatgctggtggcagaatgggcagataatcagttgagactattataaaatgggtttaatgataggtcaggcttgctatcaaatttaatgaggaaatgtttattttcttttcaaaatctacagaacacagatgtcggatagtggaggtatagagcataataatattattagttaggaaaggagagctttgatagaagacaagattgtctagcattggaggtctgcctcactttgtggcaaaattggattcattacactacctgaagaaatgccaattgtgcaacttgtaacatgtgctacatatatacctgcatggttttatagattcacttgatgttttcatgatagagtatgctttaatttaaatattcagtgtcataaatacagaaagtataatactagtttcatttttgtccttttaagtttcgtagaaaccccagctcatttctcttggaaagaaagttattaccgatccaccatgtcccagagcacacagacaaatgaattcctcagtccagaggttttccagcatatctgggattttctggaacagtaagtataaaacaagcaagaaatgttttgcttgagctaaataggtaaatgtgggtggtcaaaatattgcttactagggcatgttttttctagaatcagtagaagttatttaggaaaagttaatgactccaatgccatctctttgttcaaattcagtggtgatttttttccatttctaacaccaaaagatccttgctaatccaaggtgatgtaattttggagggcctaaggcctcctgcaccaaattcacttccccaatgtttctctgatactcagaatccattcctttggcttgaagacttatctacttttataatgcaggtactcactgagaagataaaacactaaattttgttgtttatttataccttgctgtgaaacgtattattatttctttattaaaacaggtttggataagtgagtaaattaagaaaaggtgaaaagagaatttcagcacactggagacccttaggaatcgagtataaaatactctatcacagatacatccgttatttcctgcatcctacccagtaattatctgaggagggcagaggtcatgatcctcatttaacaagtgggggttggatttgaactgcttgaaattacacatttgataagtgattgagccaggactcaaacctagagtttctaactccaagaaaccaatgagccttgctgactttgaagcagaaaatgcttgttgttaacaacagcatgagtatattttagtccctttccatgcctaactcacttttttctttcctatgtgttaggcctatatgttcagttcagcccattgacttgaactttgtggatgaaccatcagaagatggtgcgacaaacaagattgagattagcatggactgtatccgcatgcaggactcggacctgagtgaccccatgtgggtgagtggcacaggctttctcttcagtctttgggccatgctatctatagctctgttaaacctgtcttttcagtcatgtgtgaaaaggcaggtggctctgaatggccaaggcctttgggaagagagtctatgttgttagctgagagaagatttggtgtggattatgcattctgggtctgccgcaaatatctataatatatgtgtttccatccgtgtggggagggagattctttacatcttttatcttgattgttcctcatgtcaaccccaatttagaaaagatggtaccagctcaaggctttctagctggtagggacagcaaaagaatcagaaatttattttatttatatatttatttatttgacagaatcttactctgtcacccaggctggagtgcagtggcaggatctcagctcattgcaacctctgcttccctgattcaagtgattttgctgactcagtctcccaattagctgggattacagacatgcaccaccacacctggctaatttttgtatttttaggagaggcagggtttcgccatgttggccaagctggtctcgaactcttgccttcctgtgatctgcccacctcagcctcccaaagtgctgggattacaggtgtgagccactgtggctggcaaagaatcagatttttagatctgaatcctatccagggcacttcctactatgacaaacaacttctctatccttctttaatgcaggaggaatttatgcacatgaattctatgtgcatatgcaggtttaagtacctggtaacagaataagagggaggaaaaaaactaatacatgaaacaggcttttcttggctataccactgagtcactcgtgatcttaggccccagttcctcatttataaagtggtgagatcataggtgttacatacttcccaggtaagctaaggagtttaatgggttaatgatattaaaacaccttcctgagatgtttagatttcctgtgtttgtgcagtttcataatgctggtgggttttcttttttttttttttttaatcatttatttacggcacaagtcctgctatcttttctatcaaaaatttctagaaaactagtggggggaagctagacagcggggtgtcatagagtatctgttgacgagattaaggggaatgattttaaaatgccttaccttgtttgatatgttttactggaatttttgctatgtactttttggatatagaatgtactgcttaatattgggagaaagtcaatgggagaaagtcaattggagaaaggcaagaggaaacaaaaacagaaagttataactctgcagatacatagatgctttgtcactaatttgattagagaaaaatacactttttcattgactcttttcattccaatacagatatagttctcaatccttgagccaatgaaatgaaactatcaaataattccaaggggcaggtcattcaaggccttggactatatcataattcaacataaatatgtgtaaactctgatttgacagttacttaaaaattaggacattcccaattttcataaaaatatcatctcttaagttgatggataggatctgcctaggaaaacctgttattgtattctctccagggattttctgttctcagtcttggactcataaaagttggcaaaaagttaaagaagttaaaaaatgaagaattttctcttacacactgaagcacgtagttttttattgttgtttgttttttgatttttgtttttttatgagcagggtctccctctgtcgcccaggttggagtgcagtggcgcaatctaggctcactgcaacctccgcctcctgggttcaagcgattctcctgcctcagcctcctgagtagctgggattacaggcatgtgccaccacacccggctgatttttgtatttttagtagagacggggtttcaccatgttggccaggctggtctcgaactcctgacctcaggtgatccactcgcctttgcctctgaaagtgctgggattacaggcatgagccaccacacctgtttttagcatgtattgtcttaatgtgccatgttgtttcttacttccttgtattcttggaaatgttctccttgaggataccattcacattttttctcctctctggataattcttatttgtcccttaatgcctagtaattacttcttacacagtgtcatagttgtttatttttctctaaagtagaacagggctgtacttgccatgtccagtgcttgaaggtacatagtaggtccccatagtaggagattcggagagagctaaaagacaaaatgaaaacaaatgaggttttgccagtgaggtaaatgaaatagggcacttggaggcatctgtattgaaaggaaaataaaggtagagtgagaaagaatttaactgaataaacttgcctatctgtggctgctctgtctgtggaaaaaaaaaaaaaaccctgagatattcctaacaacgtagaaatcctggggcttctcttgccttatgactattccaacatttttatattctcatatatgtccatgtggaaggacacaaaaatggagttggataacaagaatggaaaaatggtaaacttacccaggatgttaatagctagtgttctggtttagaaagtagggagtaggatccttttagattcttagtctttctgaactgctacaacgggtgtgagagtcttttttcccattacttggtagcatattttcttttctcttttccacgtataggttaatagctaaataattcctaaagtctgcaaataaactactttcctcttaaatataatattcattaagtaaggattgtagccaagcattctctcaccatacaagaaatatgaacttatagacatgaaaaaacatgtcatattcttagggatagaaatctcgaaattgagaaatttaacccagttttactgattttttgatacaacctaaacatttataactagccattaaatggaatcaccatgttttgctctgattgttagcaaaggatatttgaattgcagagaatgtgtgccttcttaatttgaattgttttagtatcaatgaaaaatgaactccattgggttagtaagtaaaggtgagtggaggctctccaaaaaatttgacattttagtctgttttcaaggaacttctaggttcttgattctgttgtcaagtatattactttaggccaggtgcattggctcaggcctgtaatctcagcactttgggaggccgaggtgtgtggatcacctgaggtcaggagttcaagaccagcccggccaacatggtggatacccgtctctactaaaaatacaaaaattagctgagcatggtggcgggtgcctgtagtcccagctactcaggaggctgaggcaggagaatcgcttgagcctgggaggtggaggttgcagtgagctaagattgtgccattgtactccagcctgggcaacaagagcaaaactccatcccaaaaaaaaaaaaaaaaaaaaaaaaaaagttactttatatcccatctttgtattattcatagactgtgtaagcatgcctgtcatgtcttcatgaggtagataataatattaacacttaaaagttctcccagattgattgatgctaactacataactcttactttcgcaatttttttttttttattccttgtaaactttgaacccttttaacctgtattggatttttccctggggagttggtggtaattatttaaaactattcctttttgtaaatacttgttgaatcatcccagatatatgtgaagaggcttcagctctaagtatcaaaagaccaatatctatgtagcttatttgtgtctggaaaggcttaggcaacagcccttagcgtagtgccctacatcttatataatccaagattcatatatatttcaagcacatacagtaggtctagccataacaattttgcacctatgatctttgtgacacagaccatgatatccttgagaagacgataacacagcagaaaaggcaaatgtgtgtaaaattatctatgaaaagtagttagatatatgtgtttatgtgtttttataaagcacagaaaaaggaatgatttagtgtgcctgagattggcaacacattgcagagaaggtaatttttttatttaggccttaaaatatgagtcaaattgatcaaaacagggaaaggaaaaataatcaggtttgggtaactgttataaaaataattgattataaaaacataatgtgatgctcataagtattaaaagactaaaaaaattgactaaagtttatattaaaaagacataaactttaaaaattataattcataacaaaagcttaataaccccaataaactaaatattcaaaatttaataagagagataaatttccccaattggaaaaagatataggtaattcacaaatgattaatgtacaaatgtttaacagattcaaagtgttcaaattctccactaataaaaaattagggaattgaaataatgagattaattatatctttctgatcagcaaaaaatttaatgataataaccaatgctagtgagattgttgagaaacaggcaatcttttcatttcttatgagagtagaaatcgaaataatacattggaaggcaatttgtccattctaatttatttaattttaaagacactttccctttggcctgtaagttccagttttagatattccacaaaactattcaaatataaataagtacctacaaacacaaacacacacacacacacacaaacatacacacacacagaaatgaaggcttcattgcagcattgtttataataactaaaatggtaagtccaggtaaaattttatagcctttaaagttttagaaaggagtcttcaaaatggttgactggattcatcataggcacctactccatggagaggagccaaaatggcaagtagattgtcacattttgaatagattatctaagggaaaaaaccggaattcaacagagaagtgacaggaagcatcaaaaacaagaaacggatgtgagggatcagctggtagcctggagaggctccctaatgttgggcaagggtaagtgggagacccctcacggtccacattaccaccacagactcctattgtcctagccaaaggagagccctttgaccatcatgggccctgagactaacataaggagctgaagactactcaacagtattgctccagagagggagctcatgctgaatcccacaaacctctaagtcctaagcagctgcagcatgacaccatttcaaaaacccagcctccaccagactgcatcctaccctggtgcccaacggcccatgcatctccacatccttgaagcaccattgacattccctgcctggaatggctgccaccaaggctgaggcaagagccacagtcagtgaccccttcaccccccaacagagtagcagtgacacattttcatgtgcctcaggacaaatctcactgcccgcagctgctgtcactgtggtggggctgagatgcaagcaaagaacacactctcaaagcagctatttccttcccagtagaagagctatggtgtagctgctgtggcccttacctgaacattgttctggcctcccgggggatcaccctgcttctgcttaccacaaccagtgcccgcacacaccagcagggggcctaaggacaggttcgcccaacttggccctacccctcagtgcccaggaacaccatccaggggcctgaaaattgcccatttcagtgtgccaccattggcagctgagcattccttctggtcacgcccacccaaccactgctgctaccaccataactgccaccaacttacacacatcacctgcaggcctggggtctggcccacccaggctgtcacagctactgtcaataccagtgtggaacatttgggtcccagagggttgtcttgccactgctaatgccatcacccatgacatgccagctgcccaggggctcaagaacctgcctacccacctacctttccactgccattccaaccacctgagcaagccacctgggacttccaaaattggcttgcctggactcactaacaatggtaccagtgtacactgccctagggtccaaggacaggcacactcagcccactactgctactgcaggagtccaaaggctggcctaccgggtgtctaaaacccagcaaaattcactacagcctccactaacaaccacaccctaagccacaagggaaatcatagacaccgctgatgctgtttacaactgaagatattatacagaggctacaggacagtatatactgagaataaaagccaaaattgcctacccatctaatttcatagataatgtcttcaggaaattgtcctcttctatgaaagcaaattcaaaaaaaattgtaagaaatgactattctaccagatgtgcagatatcaatataaagacacaggaagcatgaaaaagcaggaaaatatgacaccatcaaaggaacacaataattctccagcaatagatcccagtaaaaattattaaattcttaaattcaaaatattgatactgagaagctcagtgagatataggagaataccaaaaagcaatagaagtcagaaagataattcaggatataaatgagacatttaccaaagagatagatatcattaatagaaccaaacaggctgggcatggtggctcatgcctgtaatcccagaacttcgggaggctgaggcgggcagatcacaaggtcaacagattgagaccatcctgatcaacatagtgaaaccccatctctcctaaaaatacaaaaattagctgggcgtgatggcgcatgcctgtaatcccagctactcgggaggctgagataggagaatcgcttgaacccaggaggcggaggttgcagtgagccaagattgcaccattgcactccagcctgggtgacaagagcagaaactccatctcaaaaaaaaaaaaaaaaaaaaaaagccaaacagaaattctgaaactgatgaatttactaagtgaaatccaaaatacatttgaaagcttcagcaatagactagatcaagcagaagaaaggatctcagaaattgaagacaggtttttaaaaaataacacagttagataaaaatgaaaacagaagaattaaaaaaaatcaaagcatacataacatataagatacctcaaagggacaaaacattagaatttttggtgtttccaaatcaaataaaaggattagaaaatctatttaacaaaataattcataaaaatatcccaagtctagcaagatatttatatatccagatatgagtttcggaactctccaaatagacacagttcagaaaggttttctctacagcacattacagtcaaactttcaaaaggcaaagaattctaaaagcagcaaaaataaataaataaataaaagttttgtcacttataaagagacccccatcagacaaagagtgggttactcagcagaaacccacaggccaggagtaaatagaatgatatattctaagtgctgaaagaaaaaaaaaatgtcagtcaaggatattatactcagcaaagttatccttcattaatgaagaagatataatatttccctataagccaaaggtgagagaatttattgctactagatgggcctacaagaaatgcttaagagaatcctataccccagaagcaaaggaaggatatttaccgtcaagaaaacacataaaaatataaacaacactgatacaacaaacataaaaacaaagaaaagtctcaaatgttaacactacagaaaacaaccaaatcacaattatgaaaaaaataaaaaagaataatcaaagcacatataacatataagataacataaagtgaccaactgttaaataagggaacaaagactacacaaaagtaccagcaattaataaaatggcaggtgtaagtcctcatatattaataacaaccttcaatctaaatggaatatactttccactcaaaagacatagactgaatagatttttaaaaagacccaactataatatctattaatatataaatatatatttcaatatattttatatacacacacacacacatatgaaactcatctcgcctggaaagacatacatagattgaaagatggaagaaaaaatggaagaaaaggaatgaaaaaaggcatttcatgcatatggaaaccaaacactagcaggactagctatacttccgtcagataaaacagattttaagggaaaaaaaaaaagaaacaaaggtcattatgtaataataaagtaatcaatttagcaaggggatataacaattctaaatatttatgtactcaacagcagagcacccatgtatataaagcatatattattagatctaaagggagagaaagacttcagtacagtaatagttgggaacttcaacactgcactcacagcattagagagatcatctagaaagttaagaaagaaacactggatttgaactgcacattagaccaaattgacctaatggacatttacagaacatgttatccaacagctacggaatacagattcttcttatcagcacaaggaacattcttaaggatagatcatatattaggacacaaaataagtctcaaaaattttttaaaaattgaaattacatcaagtttcttcatagacaacaatgggataaaactagaaaaacaatagcaagaggaactttgtaaattgtacagatatatgcaaataacatgtttctgaccattgggtcaagaaagaggaaattaaaaaatttcttgaaacaaatgaaaattgaaacacaatgtatcaaaaatctatgggatacaacaaaagcagtgttaacagggaagtttatagtaataaatgcctacaccaataaggtaaaaagatttcacataaacaatccaacaatgcaccttaaggaaatggaaacacaagaacaaaccagatagaaaattagcagaaggaaagaatagtaaaaatcagagcagaactaaacaaaatatagactaaaaaaattggaaaggaccagtaaaaccaaaagttggctttttgaaaagatacaccaaattgataaaccacttactagactaacccagataaaaatagagaagactcaaaatcagaaatgaaaaatatatcaccgacaaaagatcatcagagattattatgaacaactgtatactaacaagctggaaaactgacaagaaattgacacgttcctggacatattgcaacctactaaggttgaataaggaataaatagaagacctgaacagaccaatatagaaacatgcctctacataatgatggctatatatgactaatccacagctaacatcacactgaatggggagaagctaaaagcctttcctctaagaactggaacaagaaaaggccacttctagttctcctatttaacatcgtactgaaaagtcctagtcagagtaatcaagcaagagaaagaaataaaaggcatgcagactggaaaagaggaagtcaaattgtttgtctttgctgatgatgtatctaagaaaacctacgctcttcctgaaaactcttagatctgataaatgaattcaatatagttgcaggatacaaaaatcaaaatacaaaaatcagtagcatttctatacatcagtaacaaactagctgagaaagaaatcaagaaggcaatttcatttacaatggccacaaaagtaaaacacctgggagtaaatttaaccaagaaggcaaaatatctctacaaggaaaactacaaaaaaaaaaaaaaaaaaaaaaaaaggcgggggacagaaaaaaaatgaaagacattctatgctcatggattggaagaatgaaaattgttaaaatgaccatgctgcccaaagcaatctatagattcaaagcaattcctatcaaagtgccaatattatttttcacagaaaaaaaaaatcctaaaaatcatatggaataaaaaagagcccaaatatccaaagcattctagagcaaaaagagcaaaactggaggcatctcactacctggctttaaaatatgttagaagcctaaagtaaccaacagagcatgatattggtataaaaacagatacataggtcaatgagacataataggaaatccaaaattaaattcaatatttccagctaactgattttcaacaagggcacaaataacatacattggggaaaggacacactcttcaataagtggtactgggaaaattggatattcatatgcagaagaatgaaactagatccccaactctcatcacatacaaaaatcaacacagataaaatacttaaatgtaaggccttaaaactataaactactagaagaaaacatagaacacttcagaacattggtctaggcagagatttttatggctaagcccacaaaagaacagacaaaaaaaaatagacaaatgggactatttaaactaaaaatggggctattaaactaaaaagcttctgcacagcaaagaaagcaattaatagaacaaagaaacacctgttgaatggaagaaaatatttgaaattattcatccaacatgggactaatatccagaatatatgaggaactcaagtcaacagtaaaaaaataaataatcccgtaaaaatgagattactgacatcaaaagatatgaaaagacatttttcaaaaaaagatgtaaaaatggccaataactatatgaaaatgtcagcatcactaatcatcaggtaaatgcaaatcaaaaccaaaatgagatatcatcttatgccagttagtttatttttcaaatgacaaaaaataacagatgttattgaggatgcagagaaaaaggaactcgtattcactgttggtaggaatgtcaattaatacaaccactacagaaaatagtatggagattcctcaaaaaactaaaaactactgtaaaatccagaaatcccactaccaaatatttatccaaaggaaaaaaatcagtatatcaaaaaggatacatgcacttgcatgtttattgcaatattattcacctatgtgtccatcaattaataaagaaataaaatttggtgtatatatacacaatggaatactattcagctataaaaaaggaatgaaggccaggtgcggtggctcacacctgtaatcccagcactttgggagcccgaggcaggcagatcatgaggtcaggagatccagaccatcctggctaacaaggtgaaaccccgtctctactaaaaatacaaaaaaattagccaggcatggcggcaggcgcctatagtcccagctactcaggaggctgaggcaggagaatcgcttgagcctgggaggtggagcttgcagtgagctgagatcccaccactgcactacagcctgggtgacagggtgagactctgtctcagaaaaaaaaaaaaaaaaaaaggaatgaaatattttcatttgcagctacatggatggaactgggagtcattatgctaagtgaaataaggcacagaaagacaaatattgtaagttctcactcatatgtaggagcttaaaaaatttatctcatggaagtagagagtagaatgataaataccagaggctgggtaggatgtgttgttggaaaggggtgatgaaaagaggttggtcaatgtgtgcaaacatacattatagaaaacgtataagttctaatgttgaatagcagaatagggtggctataattagcaacattagattatatattttcaaagtacataaaggagaggacttgaaatgttctcaacacatagaaatgataaatactcaaggtatcgaatactccaaacatcctaacttgatcactgaacattctatgcatgtaacaaaatagcacatatatcccatgaacatgtaaaatattatgtatcaattaaaaaatattgaggatccaaaaaggtaataaaacgttggactctgataggaaggaaactataaagcaaataatagttaaccccaccattgagagacgatagtagtagttaggatgtgtagtcatttttatcttgatcgtattgtttatgatccttggtggaatttctgtatttgtttggtgtcaagtgccttttatttttattatttttattttttattatactttaagttctaaggtacgtgtgcaccacgtgtaggtttgttacataggtatacatgtgccatgttggtttgctgcacccatcaactaatcatttgtattaagtgtttctcctaatgctatccctcccccaaacccccaccctgctgacaggccctgatgtgtgatgttccctgccctgtgtccaagtgttctgattgttcagttcccacctatgagtgagaacatgcggtgtttggttttctgtctttgtgatagtttgctgagaatgattgtttccagcttcatccatgtccctgcaaaggacatgaacttatccttttttatggctgcatagtattccatggtgtatatgtgccacattttcttagtccagtctatcattgatggacctttgggttggttccaagtctttgctattgtgaatagtgccgcaataaacatacgtgtgcatgtgtctttatagtagcatgatttataatcctttgggtatatacccagtaatgggaccgctgggtcaaatggtatttccagttctagatccttgagggattgccacactgtcttccacaatggttgaactaatttacactcctaccaacagtgtgatagcattcctatttctccacatcctctccagcatctgttgtttcctgactttttaatgatcgccattctgactggtgtgagatggtatctcattgtggttttgatttgcatttctctgatggccagtgatggtgagcattttttcatgtgtcttctggctgcataaatgtcttcttttgagaagtgtctgttcatatccttcacccactttttgatggggttgtttgtttttttcttgtaaatttgtttgagttctttgtgggttttggatattagccctttgtcagatgggtagattgcaaaaattttctcccattctgtaggttgcctgttctctctgatgatagtttcttttgctgtgcagaagctctttagtttaattagatcctatttgtcaattttggcttttgttgccattgcttttggtgttttaatcatgaagtctttcccatgcctatgtcctcccttttatattctggggaaaattgtgtagaattgatatatcttattgtatatttgatataattcaacaatgaaaccatttgggcctaagatttttttctgggacactctaattatgaatttgattatctaatagttataggaatcctgagattatctattttatcttgggtaagtttggtaaattgtggtttttgaggatttggttaatttcatcaaaattgttgagttacatcaaattattgggaatattttttattttatttattttatctatttattttttgagacagtgtgtccctcttcacccaggctggagtgcagtggcatgatcttggctcactgcggcctcaacctcctaggctcacctgatcctcccatctcagcctcgcaagtagctgggattacaggcatgtgccaccatacccggctaactttttgtagtttttttgtagagatggggtttcaccgtgttcactgttcagactggtctcgaacttctgggctcaagcaatcctcccacctcagcctcccaaatttctaagattacaattgtgagccactgtgctggctattatcctttttaatgtaagtggaatctgtaatgatatcttccactttcatttatcatattgttaacttgtgtttcctctcttttctctcagtcttaccagaggtttatcaattttatttatcattcaaagaacttggtcagcttatcggtttccctgtttttctctctttccattttcaacttgattatttccggccttatttgctttctttttctttgggtttatgttttttcttctttttcgagttttttaaattagaagtttatattattgagttgagatatcttttctaatgttaccattcattgctataagttttctattagacactgctttagctgcatacaatacgttttgatatatttattttttattttgttcagttcaaaatattgtctagtttttcttgagacttcctctttgacccataagtatttcaaagcattttgtttaattgctaagttggacattttctgttacctttctatactaacttagcttaatttcattatggtcagaaaatatactttgtatgatttcaaaattttttaatttattaaggtttgtttctagagtcatgatattgtttatcttgatgactgttttatggcacttgaaaagactgtttaatgagcttctgttgggtggaatgttctataaatgtcaaatagatatagttgatttgtggtattgtgcagttcttttatatccattctgattttctgtctactagttctattaattgctgagaaaagagggttgaattcttcaactgtcattatgaatgtgtctttctctcctatcaaatatgtcaggttttactacatgtatactaaagctcccttgttgggtatgtcatatttaagattgttaagatgttgataaattgactcttctattaatatataatatttctttatttctgatatctgataattgcttttttccgaagtctactttagtctgtattaatattaatacagcaaatctagctttcttttgatttatgtttgcaaggcaaattttttctccttttacttttaacctacttttatcatttttaacctacttttatcattacatttgaaatgagtttcttctagacaatacagagttggctcattcttatgcattatgatagctcctgtcttttaattggtgtatttacatcatttacatataatgtaattatcaatatggtacttttaggactaccatttattagttttctattggttccctcctgtgctcctccctttctttttatactgacttcttttaaaattatttaacctatttttagtattcaattttaatttatctattttagttttggctatatcactcatatttttagtgatggctctataaatctcatagaaattcattatttcatagtctgctgagaatcactattttacaaattcaaatggaaggtagaaacattaccataatattggctttataaccctcacacctttatgtgatactcatatatatttctgtacattgaaaacttcatcagatgcttataatttttacttttgtcagagtaaagaactcaagagaaaaatagcctattttattgactataatatttattattgctgttgctctttatgccaaagctaccattttgcctggacatcagcaagaagaatagagaactgcatgcacctcttttttttatcagatgagttttttctaactgggaccataaaccaggtcaaagctctagtttgctaaattttgaattgatcaaagttttataaatatttccttaatacctctcttccttctttcctccatccttgcatctgcatgcatgtgcatgtacacgtacacaatcacccacatataactcaatttgaacaaattatattttctatatagaattggattataaaactttctgatatgccaattattttaaatcttcatttgataaattttgatctttaaatagatattaaacacgtattgtatgaacatatcagtggcctactgaaaaatacattgacccaactccagtcaggctgcaaggagctggttaacaatattactaggtgagtcacttaaacactctaaatcctccttgccgtgtgccttttcctggatcaagaaggttgaaaggatctgatttctgatatgtcatagaaacagcaatcattttctatgtgtcttggtctcctagacttctaggattcacaatgtcacttaactttaagtctgacaccaatatcaagctcactacaaagaaagcatctctattttccttctcttctcttcctacgttggtctctatcaggctcctagagccactctcacactgccattatcatcctccttttgttcttcctatacattctctttttccttttcaagttccctacttttcccccatgttgagtatccacttttttggttacccagaaaaccgctaaaattcagtgtaggcagatttgattaaaggctgctgcttttttttagggctttatgatgtatgatttactttagaattgtaacatgggatttgtactcagacacactagagttgaaattctgtctgcactaatttaggtgcgacctttacaatctttatgagctgcttcttcctcatttgtatagataaacagtgtttctcattgatctcagagaattgtggtgatacctttattggtgagtttcattcagagttactggtgcataaatatacagccgaatataaattgtcattcttgctggttgtctctctgtaccatttttcctcaaagctctgtgaggaaggtaaatatgtatttatttttataataaaatatcaatttatacatttctcacattatgaaagcaatacaaccaacataactttagaagtatcaaaaagacataaatcccaaaccagtgataataactatgaacatttttggggttttaaatttttttctagaaaagatttaataaaacatttgtgatcatgtcatactaaatgttataatatacttctttcattctatagcaaacattttatttactaatcttcaaaacttaaatttcctcattatgtattatattttattgtgtacatataccatggtttatttagctagtctactcacatgtttttaagaaaaaaatatttaaatattttcttgtgctatatgcttagaagtgtaattattgggtaaaattgtataaacatgagtctaaccaaacttcttttcatgaatcttgtttttttaatgtttgttatcagtttacattcccaccaactgtgcaaaagtgtggcctgaaatcaatttgattatagacttgaaatcaattggatgatacagtctcctctttgaaacatgcaagtacttttaggtgactgaaggcctgtctagatgtctgccaccaaattgcaatagtgtctctcgatatacctttgattgtggtctatggaagggatagtagttttggctggaggtgagtaagacatcttgaagaatggagtatccaggagtggggtgagcagacctagctgggatggaaataatatgagtgaagaggtggtaaaagagggctagacaaagtctatttcgagactttcacctaaggttaatcttgaacatgggaatggacataatattttccccttttccttcttaacccttgcttttagtatcccaaatgcttttatccctttggcttctactattaaaataatcatttaaacataatttgtgtcaaataggctttgggtatgagttctgtaaatattaattaaacaagtaagaaaatatatttcacatagcaaaaatcctctaatttttggaaagtggatttgtagctacctatgtggcttatagggtagctcaatattcactccgtttagactgaattccggtgtccccataagagcagactgtttctctgttctgttctttgtacagtatagccaatgggaaggcagcactttgttaaagagtgccaagtcggggactttaccttaaacacaagtatgcatttcaaaccctgaacaaacagccttcttaataaaataagggaaagagttttctttcttctattctctagaaattcacaaatatcacttgacaggtgacagttcttcccttacaaaaggggctgtttgccttttgctttggtgtttgggtaaactgcagtatgcactggcagagaatttattgcctaggggaaggtgtttgcagttgctgtgtttaatctgaaaagaaacccttttccttctgtctcctccctctctttttaaggagggagagttggaaatgatagccccagggaaatagttcccttaacacctgtctttggtgtaacctcagcaatgttacttaagacactgtgctcagactgtatgcattaggaatgacaaagttgaagagggcagataaacagaaagggatttcagcagaaacacaggagctgattctgaccttgcatcctcttaaaaactgatcaggtggaaatcctatcatgctggctaaaaagaatctgatttgtttgaagtaatactcatgctattagtcatctgtcctttcctttggcaaaatatgcatacatacatatatatatagtttcaatctgtaaaacgtgaaaaattctacaatgttatatttaggaactttagacctgctaattctagtccaacctttagtagatgagaaaactattaagatccaagttcatcagtggtgacttctccaacatttctgataagcatttttaagaaaaccagggctacacccaactttctggatttctggacccatttttccagctattatcagaggtggtgtgaagaggtcaggctccagagatagatggctgcctgtgtttgaatctagctcagttattcagtatttgggtgaccttgggtgaattacagaatgtttctaagcctcagttttctcatctgcaaaacaaggatcaggattgatattggtgacatcctataggagagctgttctgataactgagataaggcatgttagcataacacactgcctgtggccagtcctcagtggaaatggttgttgctgttagtctttagactgtgttaaatttggaaacagtgaattattaatcctaaatagagcaattactgatgcaggacaagaaaaaaatctacacagatttgtatttttgtttttccaaaaaatatgatattatttgaagatacactagtgttattgtaggtagctagtcagacatgagcaggacaggagagggctccaccccctacccccaaccctcaccagcaatctcagatgaccataaggtgatggtcaggcagttgttacactatttcactcaaataatattaataattgttcgtggttgcagccagcaccagggaaaggcagtctcccgatagatagaaaaaaaaccttaaactagtgatcagcagcttcccaaaaagacctcaggagttgggtgaatgggctcaagcatgtgtactaaggggcaaaatggcagagtttaactagtatatgaccttctaggaacattcagactagtaaagtgagaacacctcaagcaggggtcctcaatctttttggcaccaggaaccagttttgtagaagacaatttttcacagagagtgggtggaggtatggtttgggaatgaaactgttctacctcagatcatcaggtattagttagattctcataaggagcacacaacttagatccctcacgtgagcagttcacaacagggttcgtgctcctatgaggatctaatgcccccgctgatctgacaggaggtggggttccagtggtaatgctcactggcctgcctacctctcacctcctgctgtgtggtccagttcctaacaggtcacatattggtaccagtccatggaatggggccgggggcccctggtctcaagtgagcatgcatacaactcgagtaaacacattgcacatgcagcccctccttagtgcacatgtcgacagcccaccccaaggaataatcaggggagaagggatgcaagactccagaagtacaccaacatataaaaccctaagtcaaaggtcaaaccaggcacttgatctttcaagtcacctgcttggcttcttccaagtgtactttacttcctttcattcttgctctaaagctttttaataaactttcactcctgctctagaacttgtcttggtctctccctctgccttatgcccctcagttgcattctttattctgcggaggcaagagttgaggtctctgcagacccatacagtttggttgccactaacatactttggtgctgcatgccttggatatgttccactgctgacactggcaggctgtgaaatatgacttgaccatcatttcccatttgaaactagacaaggttgagttttcttcaaactaagatcaggattttgaaccagacagacttcttatgaaagccaacactcttttgtctgttcaggtttcagagaactcacaagaaaactttattttacttgctaattttgtttatttgggtgtcattcagtaatgataacataatgaaatattccctttgccagtctaatgattaagagcgtgggctttgcagttgagcacaccaatatacttgagtttaaatcttagcatgataatgaagtcagagctgaatgaactcctatatagtttaattccgtggttctcaccgtgtgttctcagggccagcagcatcagcatcatctaagaacttgttaagaaatgcaaattattggatatcactccagatctactgaatcagaaactggagggaaagtgagagtggtgatctttctataagccctccaggtgattcagatgtttgagaaccagtggtacaatcaagtgatttagtatatatttttatgggaggggacagaactcgggctttgggaagtgactaacctgtcaaggaagaggaaaactctgtaaaatatttgaagaggtttattgtgagccaaatatgagtgaccatggccctcaaatttcaagaggttttgagaacatgtgcccaaggttgttggttttcagcttgattttatacattttagggagatgtaagatatcagtcaatacatatgaggtatacattagtatgatctggaaaaatgggacaaattgaagctaagggctcacgggtcataggtggactcaaagattttctaattggcaactgtttattttaaaacatggaatcaatagaaaggagtgtctgcgttgagataaggagttgtggaggccacagttcttattatgtagatgaagtctcataggtgaccaccctcagagagagtagctgttgtattactccattttcatgctgctgataaagacatacccaagactgggcaatttacaaaagaaagaggtttattggacttacagttccacatggcctgagaggcctcacgatcatggtggaaggcaaggaggagcaagtcacatcttatgtggatggcagcaggcaaagagagagcttgtgtggagaaactcctgtttttaaaaccatcagatcttatgagacccattcactatcacaaaaacagcactggaaagacccgcccctatgattcaatcctctaccactgggtccctcccaaaacacaagggaattatgggagctacaaaatgagatttgggtggggatgcagaaccaaaccatttcattccacccctggcccctctcaaatctcatatcttcacatttcaaaaccaatcatgccttcccaacagtcccccaaagtctcaactcctttctgcattaactcagaagtccccagtctaaagtttcttctgagacaaggcaagtcccttctgcctatgagcctgtaaaatcaaaagcaagttagttccttcctagatacaatgggggtataggtattgggtaaatgtggccattccaaatgggagaaattggccaaaacaaaggggctactggccccatgtaagtccaaaatccagtggggcagtcaaatcttcaagctccaaaatggtctcctttgactgcatctctcacatccagatcacgctgatgcaaaaagtgggttcacatggccttgggcagctctgcctctgtggttttgcagggtatagcttccctcctggctgccttcatgggctggtgttgagtgtggtttttccaggcacacagtgcaagcagtcagtggatctaccactctggggtctggagaacactggccctcttcttacaactccactaggcagtgccccagtagggactctgtgtgggggctcccactccatatatcccttctgccctgccctaatagaggttctccatgaggaccctgccttgacagtaaacttcttcccaggcatccaggcatttccatacatgttctgaaatctaggtggaggttctcaaacctcagttcttgacttctgtgcacacacaggctcaacaccatgtagaagctgccaaagcttgaggcttgcaccctctgaggccatggtacaagctctacattgcccctctcagccacaggtagaatggctgggatgcagggcaccaagtccctaggctgcacacagcacagataccctgggcttgcctatgaaagcactttttcctcctaaacctccaggcctgtgatgggagaggttgccacataggtctctgacattccctggaaacattttccccattgtcttggtgattaacattaggctgcttgttacttatgcaaattgctgcagccaacttaaatttctcctcagaaaattggattttgttttctgttgcattgtcaggctgcaaattttccaaacttttgtgctgtttcccttttgaaactgaatgcatttaatagcacccaagtcacttcttaaatgctttactgattagaaatttcttccaccagataccctaaattatctcactcaagttcaaagttgtgcaaatctgtagggcaggggcaaaatgccaccagtaactttgctaaatcataacaagagtcatctttgctccaattcccaacaagttcctcatctccacctgtgaccacctcagcctggaccttattgttcatatcactatcagcatttttgtcaaagccattcaacaagtctctaggaagttccaaacttccctgcattatcttgtcttctgagccctccaaactgttcaacctctgcccgttacccagttccaaagttgcttccacgtttttgggtatcttttcagcaacaccacacttctggtactaatttactgtattagtccattttacactactgatatagacatatccgagactgggcaatttaaaaaagaaagaggtttattggacttacagttccacatggctggggaggcctcacaatcatggctgaaggcaaggaggagcaagtcacatcttatgtggatggcagcaggcagagagagcttgtgcagagaaacccccgtttttaaaaccatcagatctcctgagactcattcactatcacgagaacagcatgggaaagacctgctcccatgatttaattaccttccacagggtgtctcccacaacaggtgggaataggaaagctacaagatgagatctgggtgagaacacagagccaaaccatagcagatggcaaatgtttcctattcagaactttaaaatatactagactttcagttaatttcttcaggattgggaggacctggaagaggaaagatctagttaatgttaatagagattctttacagatgcaaatttccccccacaaaggctgcctgttagggccacttcaaaatatggcaaagaaacatattttggtataaaatattttgttggcttctttatctgttatttggtatgtcagagtcgtggtgtttaaggttcagggaaacccctgtgatgggattttatggtttgtagggcatgactcctcaggtcccttagatagcttttggggcaagagagaaaaaaggtcagagtttagtcctcaggcccaaaggtatacagctataatgacagagaagaaatttctagacccatctctaagataattatttctgactgtgactcattttaaaacatgtggaagggtctgctgggttttatcatttaaaaagttaaaaggtaaaatgtaatactttaaaatagtaattaaatatgattattcagtggttggctacatgtatctttataagtaagatgttaaatgcattctcatgaaaatctcttccttggcaaaagaactaaaatgtcaagcttgtgtacttattagttcaagaagcacttactgagtatctgctaagttcaacacactctgctaggagtgcagtgtttaaaagagctgagtctatcactgcctacaacttagagtgggtgaggagacagatatgaagtcaataaactagattattaatgatctaaattattgtacctgggaaaatatttgctgctgaaatattgagggatcgatagaaaagacaataaatgggcatccatcattgaacaacagaccagagttctgttattaacaaggactgcttgccaggtgtggtggctcattcccataatcccagcactttgggaggccgaggcaggaggatagcttgagcttgggagttcaagatcagccagggtaacctagtgagacccctgtctctataaacaaaatttaaaaattatctgggcatggtggtgcatgcctgtattcccaactactaaggaggctgagatgggagtgttgcttgagcctgggaggtcaaggctgcagtgatccgtgactgtgccactgcactctagcatgacagacagagcaaggccctgtctctaaaaaataataataaaaaaggagggtactgctgggctatattactttagagacagtattttataccaaactctatctgaataatgtagagcatgatatatttttcatcacgcagctcagtggtcctacattcagttacgtttgatgcttgctaaactggaggcaatgtggagaatgaattaataaacaaaaagcaaattctgcccctaaggatttcttagtttgttatggacaggagacaatacaagcaactcatgtcaaggtagagattgctaagtgccagaggaaagtaaagctgtaaagagcagaaattctgatcaccatttgtatttgaaagctcaggaaatagcctggtcacttgaaagaggtggggagaggttatactaggaagacgaactgtgtttaaggtagttaggaaataggctgccagcttaaatgtgtgaaacactcagtctgacatgaaatggtgatgcttagagctaaaaaatacttgactcatcggaagtatttaaattaatttttaaaagtgtactagacgtgcagaacatatatatggccatcagtgtgacaacccttacttaagtgtaaacatgactttgacagaatgtgcaatgggaggagagtcagcttggtttgatgtgaaccctacagcaagataaattatatgggaataaacaaacagctgagggtcaattaaagaaaaataggaatactctataacctggtgctcttgctgagctgactgtggtaattagaggatgggtggctggggatgtgcaggtccctgtgcatgcatatgacctcaaactctgcacccttgtatgctcattgtcaaaagaggtgggtgtcttgggattatgattaagtccctctggcacactgttctttgcagataaggccctatgaattgtctactttttctgtcccaatatccattcagaatagactacatgctatttcttggagtaagaatagaggaaaatgagagtctctttagttttcagtctaacgaggaatacaggtgcatatcccactacctaggaaacaagaaccatgttgataaaatgccagaatacaaacagagctgataaaaccaatagctggatggcttatttctgactgggaggattacaggtgtcttcatcaggtaaaaggtaaaaattgaaacacccacgcacacacacataggtcatactcttagtgtgtgcagtataagctttttactgggagctattttgaagatgttcccttggctgtctactttgtggacataggttggctgactggggtgctcatcaggagtatattgtctgcagtgatgtaagcttaattctagtctcttttgtctactaaagttatccattgtgtttaggaaagacatacaattcacttgtagattaaaaaaaatagttctaacttcattgtgtttacttatcatcctcccaagaagctgggagctcctaatggatattattcaagtcatttctcaccacacactcttgaagaggtagaaagagcccaggtattttaaaatctcatttttgtacttcggcggcacagcgtaatgaatcagaaaataaactagaaataagacccatgctttgtcctggaatggagcgcactttgttctagtaaatgttcctacctgcttttcttaaaattagaactagatggcttataaaatgtggcttttaaaaaagaactcttttagatgtctgggtggggtatcagatgatttttctgtaatcaaagctttattggagcgttgtggatttagtgatgttggctgccctggatgaaaggaatcagcagaaaccatctttgctattgaattaaatagatgcagccagtttcccatttaaccaagatattttattcactttttagcaataagcctgtttaggaaaagagacaactcagctgcttgatgagattttatggtttgatagaaaactaaggagaatatagagcagaaaaaaaaaatcagttttgtgactaattgatatgagaaacaaatgtatccccgtatattgtttttttcccccctgagatccaagaattaatctcatcaagtaacattaagttctttggaaatcctttgacataaaaaggaaaattggggttttcaatttggggctttgtaaatatcctgtcctctgctttttttttttttttttttttgagacagagtctcactctgttgcccaggcagagtgcagtggggggatcttggctcactgcaagctccgcctcccgggttcacgccattctgcctcagcctcccgagtagctgggactacaggtgcccaccaaacattcccagctaattttttgtatttttagtagagacagggtttcaccgttttagccaggatggtctcgatctcctgacctcatgatccgcccacctcggcctcccaaagtgctgggatttaaggcgtgagccaccgcgcccggcctgtcctctgcatttttaaaggaacagcagtttggtgaaaaagcactggcctaggagccaggagccttggcttctgttcttcatgctgctgccactaattgttttctgttcatgaacagataactccccctctgggcttagtttccttatgggtgaaagcacggagttgggctaggtgaatactcagtgttcttatagtctgtaatggataaatctccatgctcttgcttctgaattctatgttgctaggattcctcttgtgtctccatgtggctatggtgggcacccagcacatctaaataggtttttaagaaacattggtgcacaggtgcaatggtgaatgcctgtagtcccagctacttgggaggctgagtggggaggatcacttgaacccaggaatttgagactgcagtgtgctatggagccactgccctctagcctggccaacatagcaagacctcatctaaaaaaataataactagtgaaagcatatataaacaaatgtaaactgtatgaaatagtgtaaaacaacatttctttctaaataatagctgtagcgtggaatctaaagagtttgatggtgtctcttctttctttctgtccttggatcgggggtgagcattgcaaaaacccaaacacaaaagctacatttacatatctgaaaaaataaatacttcctaatcaggttttttttttctgtggaggtggggtgggtggtaaggtattacactaataaagaccagtcataaatgtgaatactgtctggagttggtgaaaggagaagttcctaactctttctgttactctcctgttcctttctctaacatgctgcctctgtcttcctcgcaagccctgcaggcagtgttctttccaaacaactacttgcctaaccagttcattggaatgtcttttctccagactgtctcctcattgagatttcttctgaaaattaacctcgctaaaaacataaatcatgtttaaaaaaaatacagtggtaaatattgcacataaaatcttttctctggtttaaaaaaatgcacaaacctacctaccactttgaaacagcaacagtaacaaaaacagaaacaattagggcaacagttgcttttctccttttaaagaaaatacttttcttggttgcaattgttctttggagtgacagggattaaactctttggatgaaatctttcctccttattgcacacctcctatccctcaccctgcagcctgggagtgattttaggaaatattaagtatatattttcttggctggcactttaaataaggtataaattgtggaacaaagtataaaaatcacgtatttccacaaatcttgccatataacaaatctttccccataactttttgtttgtttgctttcatacaaacaaaaggttcttcgtctatggtgaaaaatgtaatggttgtagagtatatacttcaaaatttatctttattatttattagcatcttaggcaatcacagatgtcagtggattcttttccttttttattttatttgaaccagtttctcatccagcagttctacatgaaagaaaaaaaaacatgaacagtaataactcacataacatgttcttgttgttgtgtataggtactattaaataaatagggatagtttgtggtttgaattcattgaaggggaaaaaccagtaaacatgtaccaatctttcaatttatgcagcggaatcaggatgcttttcatagtgttataaaaattcaatttcgctttctctggctaaaatctgaatggccaagaatggaatagtcattttctttgctagtttcgtatttgaagatatccccagaatttgaatcaatctgaagtttgattttcatttctaactcctctggaacaatatgatgaaacagccatactcatcaggaagttcagctaaacaggagctcatggttggaaaaccgtgagtctcaagttttaccatatagagtgtaggatactaaattgtctgatagacaatagaaataagtcatcatcttatggcttaattacaggagaaaagaatgttcagactcaaatatctcaataaacagactgttgtacagagacaaaagagctaccttagaagttttggaccctggattgtagtcatgaattctctaccatttagtgatgtgatctgacacatgtcactaaccctctctagtgtcagtttcgtcacttacaataatctaaatatttgatatttaatccaggattttagaataataatacatatgtgaaatcacatacaatatgtcagcacatcacgtaaaacaaatgaagtagcattttattgttagagatttattttaagaactaggtacttcaggctctgtgttcaaaccccccgcgtgtatgaataactaaccatctctaggttttaggggttttgttgctgctgttgctgttgctgtttttttgcaaaacgggattaatatgactatggtgaaaactaattgagatagtaaatataaagagcttaccacaatagcattggttcaataaacgtgggcttttctttactatttacttttttaggtcagtcattgaacacaaggggctgttttaaataaacacaatttaaggggtgattttgtatagaagttacaatattttaccagcatcaacatccaattcctcttgtattttggtagcgatgttattctcatgattatgtaattcttttaaaatatctcgaatcacaaacgtaggtagttgcatgttactttttaaaactgtttttgccacctccagataatcattactcaaactgctctaaaatcctgaaagacaaatagtaagaaaatattttaaagtcaacacactattattaaacaattgcttatttttccttcttataaacacttttgaccaaaaattccaaaacgtatgcactgcaatggcctatgatacaatatctcccgctgtacattgaggattgacttgtcattttatagttgacttaatattaggttgttataagagaatgtactgaaaacttatttgacagtggcaggtgggtgccatagtgagacttcatgtacagattaaatgaatgtaacggataaagcatggagctgaacaacagcaaaaaagcacagagttaaaacttcctagtaaatgacatttacaagaagtataggtatgttcacgaagatgaccagagaagattcaatctagggtcagaacaaaagcaaattaatctggctgcagaagacctctttgaagctcacgtctaaaactaactatttgtgtaacatcagccaagttatttcatctccctgtttcattacctcatttgtaaattgtggattataatagtaccttcctcataggctgatgtgagaattaaaacaaaccatgtatataaagtgctcagaatcatgtcttgccttaaaaagtgtttaacaaatggtcactgttgtcattctctgactctgtttatgcatatatgtattttttcaatgtttaatactgcattaaaggcactataaattctatcatcttccgataccttgattccatgtaaggatcaagttgaataatagagtagaagtttattctgggtaaaaatgaaagcacaattttatctcattaaatgttattctagtcagttcctttgagaatattggacagtaaaacactattacagatgttcctgtttatgtgtatacatttgtggttatttcagtctgacaagccagctctaccatgagtttggattagaaattgtgtatccactggatgtaagaactatgtttgatcttttcttggtattcttccacttaattggtattcctttaaaataattagaattaatccaattaataaaattaatatggtctgtgagtacaaatatgattataataaatatagccaataaatggtttatataccatataggatgtatcaaaagaaataaaactttcaaaatgactgtgcccatttagacattttaaaatgtttctaagtagccattgtaggcaattatgttgctggacttcctccttgtcactgaccttcaatgaaagattattcagagcataaaagtgtccctattttaatgctaatttgttttcagaattaaaattatcttatcctatttgactactcatgttacactctaaatttggctgaataaattttctaaaaagatgaacatttgttaccattgattatattccaataataagtcacagactggttcataacttacaacagattgtttaccagggttacaacttcatgaaatcagaaattatacgtttttgtgtgttaaacatattataaagcctggcacctgttcatttttagcaaatgtttgttgaatggtttgaggcggtagtagcctcatctcttgaactaaattgttagtgcctttagaaaagtggtacaatctgaatcttctaaatgctgcatattgccttgatctaagttttgaaaaccagacacaatccttatcattggggcaccatccttgttagaattttttatctgttgctttctattcatctggaatgtgtaaatattaaattaaaattattttgggccgggtatggtgactcatgcctgcaatcccagcactttgggaggccgaggcaggtggattacctgagatcagcctggccaacatggtgaaaccccgtctctactaaaaatacaaaaattagcctggcatggtggcacatgcccataatcccagctgctcggggggctgaggcaggaggattgctggagcccgggagacagaggttgcagtgagccgagatcgttccactgcactccagcctggccaacagagcaagactccgtctcaaaaaaaaaaaaattactttgacatctattaagaaatttgcagcaaagttaagcagcaacaatttacgcctttggggaattattgaatattattatgcctagaaggctgtcccttctttttcattttaaagaacatttttctctgaatttatgcaaatttgaggaggctaatccaagtcatctctacagatagttaggcaagacaaaatgtttgatactgcaaattttctcttgaaatgtatcagtcacttccactgtataaatcatgtaatatgtcagaggtttttgtttggatgaagtaaagctaattgcagtaaagatttgaagaatgatacttatccatcaaaaacaaacaaatatcttatgtttgagtaatgctctacagtttaaaaagtcatttcacatcttttattacccttgctcctcacaacaacaggcaatgtatatctactaccattctaagtgcattatctctggatttttggcttaattaactgttatgaaaagccacttaacttcattagtgaacaggttagtatgtatgactaattaaaaggtacccataatattttatactaacattaaacaagtaaaaatgtggctattgttcaggagctccaagttgaatgagctctcaaagataacgttttctttattattgtttcatgttattctacctgcaggtgacatttttgataaagctaagacaaatatatatataaatatatattatatttatatatataatatattatatatttatatataatatatatttatataatatattaaatatataatatattcaatatagactatattatatattaaatatataagtatattaaatatataattatatataaatctataatataaatgtattatattaaatatataatatttaatatataattaatttatataatatataaatatattaaatatataatatagctatgtgtggaggatgaaagcactgatcagctgattggccttgaagatactctcattttctttaattttcatgattgccttcctgttaataatgtgacagactcttttttagccctcctgagttgaatatttgggcacacgtggcagtataagtacaactcatgattgaatagtcttgtttggttgattgctcagttatctgagagtgagatcttggctctcatttggataaagcagtaaatgtctgagcagtgtctgctaatgtcgggtcagttcacatcaacattcagcaaatttgttgattgattcatttattcttaaaatatgttgaaagtttcctatgcatatgaccctgtttaatatttgtatgagaatctaatggctttagtgtagatatcattctcaatgggattcgatagcatttcggaaactgttgagcatggcagagtgataaattgtgcttttgtttacatgactaattgtaagggtttggaaacactcccttgatgtactaagagcagctaatgaagacagttaaataaacaaaccattatgatgaatctaggagttcatatagacattctgctaatttgcttcttgtccctttcccaaagttttatgtatatcttcccaagcataacaactattttacatttcatggagagctagtttgtttttcttcataacctaatgctctattcactcacttagaatgtcactgctcaaactggctttagagatcacgtactagctagctaatgctctttaccaataaggacactgaagctcctagaagtgaagtgataagccttagatcgcattgctaattggtgatggagccagtctagaatccaggtctcctaattgtttccactatactatgatgcttcctttagaaagctagatgctgtataaaatctcttgaaactagctctgtatttcaccaatcaatacataccaacttgagactagcaaacttttttagtatgttccatagttgctctcacactgtcattttgcctaacagcagctcatatctacttggagaaagtatcaaggattttcctctgatgagtttggtggctgtttagtgcctagactacatcatgtttaatggaaaagtagattgaatttctgtctcattttcaagaaatgtgctgtaagagcatgccaagcccaaccccttgataatcttgtctaacagcgttggtggtgtaatgaattagtcttgcacgagtctgctgcttctagagggctaagcaggggatcaaatcccccctttgtagtgagacaagctgccagagaagtgattgatattgcagacagacttcaaggaagaaataagcagataagtggggtaataagtagataatactactactttgcacttagtgtcttttatctgagcatctgaaggcagctgtatacttaaacatcaaggtcccttagtgtaaggagacaacggggtctttccttttattctgtggtcctcctccataatcaataaatcagcgaaaatgtttccaaagaaagatcagcggtaaagatttgtttttgccctttctctgtgaagctaagtgaccaggatgtgaagcaatcgctctaaaagttatcttgatcttgatgcaatgttttgtatgcactttctcctacaatgtttggatctgaaaaaagaaacttctactgtaccaagtaaggcatttactgtatttttaatcccttccgattgtgtcagactcattcctctgagtaattctcattcttgcatttattttactcctcaaaaatttcccttgtaaatcttattttcggtcaaagtccttagacagtaaatctttcagacagcttcaggccattgtggctccaagaaaccattgtgaagtaaagtcgtgtttaataaggtggatggaccctgttagagatctctctgagtatgcttccattaattttgtacacatcttgttaattcacacaaagagagtaagttgccaagccaaaattgtttccttttagcagaccatgactcaaaattcagaagctgattcctaggagagttaaagaacaatagtggctgccacattatttttttaggtaactttgctctttaacatagactagaataattttctagtcattaaatcaccaaatataaatacccagtgaccttacaaatattgtttaatcatcctctccatcaatggctttttttttctagtttatgtcatgtgagggtatttgttaaatcatagaaaactttgagatcatgaaggtcatcagatctaaccacccatgctgtctctggcctttcactccatcattataatatgcaagtgactggcttatagttcccttaggaggtaagagaacacatatccatgtattgtgtctcgtgcctttttttttttttttttttttttttgagacggagtctcgctctgtcacccaggctggagtgcagtggcacgatcttggctcactgcaagctccgcctcctgggttcatgccattctcctgcctcagcctcctgagtagctgggactacaggtatccaccaccacgcccagctaattttttgtatttttagtagagacggggtttcaccgtgttagccaggatggtctcgatctcctgatctcgtgatccgcccgcctcggcctcccaaagtgctgggattacaggcgtgagccaccacgcccggccgtattctgtcttttgaagatcagaaaatattgctgaatatgaaacaaaaacaaaaacaaaaaaaccaagttcttagcttcatatttatagtttgtctaaagaaaaaattgctttcttccaacgaactgcatttcctgtagaacacaaattttatacttggaagaattatgtgtagcgattttgcaaccatctttccttatgaccaaatacttttgtgagctgagaagtctcaggttgacataattaaagataaaatgtgacaggaattgtatgtgcacctgtgtttgaagggggccttgcagtaagtagaacataaagatatatgcatcgctgttttggtcatctcaatatagtattgactataatctcatatttttcccactttataatttataaacatttcaactcatttgacaacccttacagttacctgtaaatgagatgatgtaggtgttgttatccctatttaataattgtaaaaatagagtttccaattttccccactgctaccaacctagaaagtatcagaacccagaccttttgactcccggccaagtatgaagtgctttcaaatagggcatcagatacagcaaatcatctgttactatgaagtactgtacaaaatgttagtactgttattgaatatattctcaagacttaggtacgcggttggccattgaggtacaaatcttttcccatagaaaggaaattgacagccgggcatggtggctcacgcctgtaatcccagcactttgggaggcagaggcgggcagatcacgagttcaggagtttgagaccagcagcctggccaacatagtgaaacctcgtctctactacaaatacaaaaaattagccaggcgtgatggcaggcacctatagtcccagctccttgggaggctgaggcaggagaatcgctggaacctgggaggcggaggttgtggtgagccaagatcgtgccactgcactccagcctgggcaacaagagtaaaactctgtctcaaaaaaaaaaaaaaaaaaaaaagaaagaaagaaagaaaaaaattgacttgtaaactacatataaagaagtcatttgctgttactgagtccactgtgttaacttgtttacatcttcaaactcattctgcctcaagtcagtcttattttcttttcttcaccccaaacctagaggattctgccttcttgctgggttctaggttctaccctttcagtataagatgaaaaccaccttccacacagctacctagatcgtaatatgccatgttttctctctccttgttttcacttagttttgtctttctatttgattgcgggtgctctttggatcgagttttttgtaaagtaccttctaatatacttgggcaactattatacttctctgaatgttgtaagcatcttatcctcatttctttttactgatatctaaccttctatctctctttaattcacacatttttaagtatcttttttaaggcccaaacatagaagtgaaaacttttcacagagagaaacagaggttaccttttactattaccttagtatgtttattggaaacctgtaatagtcaccaacatttaactgaatttaaagcagaaattgaggcagctgaatgggatgattgagataaagttttggtaccctagtaatataagccttgggccacaaacaaaaatatacttagttctcatagttaaatgtaatgagtaatgtaattatttcaaatattggatgcaatactaagaatgaggagagaaggagagccacttgacacttacaaaatagttgcaaatttgggaggctgagacagaaggactgcttagcccaggaggttcagattagcctaggcaacatagcaagaccctgtctctgtaatttaacaaaatataaaaaatagttgcaaaacattgggacacttattttcaatctttggatttcatattgtctttctctaaaataaaaacgtgtggttatatgatttctaaagtctcttgatgtaatattctttagttttatttttatcattgcttgcaattactgctcatattatcattacaataagcccgacattcgttttcatcccttatctttggaacaccgtgtttccctccagagacggagacagagcgcttcctcctttctcttcctgtcttgctggggcctaagaagagaaaggggcactatctttatgggtgaatacatgtatagccctaggaaataatgaaaaaaggatttaggagtggatgcttaactgattgctttctattaaaggctcacaatcctacagaagagtagcaatgaagaaatggatctttatgtttgaattcctaaatttatcctgaaaacaaaagccagcccctgctgggttagagtcctccaaagctagggatctgttaggagcactggttttgccttacagacctaaatgtaaatgttagtctcagatgggcagagagttgaactctctaattagccctgcaggtcagtcttgaaagaaacaagagtgtagcatccagcaatttaaaaaggcatcctgtgcaattgtttgctgagggtcagagggtaaatgctgttgtgacagttgggtggacttggcacacttctctacgcaggataagagagagaagagaggttgatgttgatctttggtgatagcaatagcagaagacagttcccaaaattctagggtcttttaaatgtcctttcaattcacatgaaaggcttccgtttgcaatccaaggaattgaaatatcaagtcataggaaataagaggcctataccttttcttcagggaagttaaatcataaacctttctggaagcttaaagctgaagtatatttctcatatttacttcaagtatgagaaagatacagataattcaagtccaccacagtcttattccaacatgtctttcctactctatcttccatctcatgtcattccaggctcacctaactcaccctgttatttttttatgtttatttttattttattttgagacagagtcttgctctgtcatctagactggagagcaatggcacgatctcggctcactccaatctccgcctcccaggttcaagcaattttcctgcctcagcctcctgagtagctgggattacaggcacccgccaccatgctcagctaatttttgtatttttagtagagatgggatttcaccatgttggtcaggctggtctcaaactcctgacctcaggtgatccacccgcctccgtctcccaaaatgctgggattacaggtgtgagccaccatgcctggcctcaccctgttattctgaatgcataatttcatgtctctgtcttttgtcctatgctgtttcttaattagattcctaaatgtcgatttcctcttcctcttctatttcctttttaccttaaggattcaactccttatctcttcatgaagaattaatcactcctttctctctgttcccatagaactatgtctgtaactttacacttacttagtcttcactttagttactatttcacatgtatttcacccgactttgtaaacatattttttttttttcttttaagtgtatgtctcctatactagatgaggaagtctttggacagatgctgagtcttcttcttcttcttcttcttcttttttttttttttttttttttttttttgagtcagagtcttactctgtcacccaggctggagtacagtggctggatctcagctcactgcaacttccgtcttccgggttcaagtgattctggtgcgtcagcctcctgagtcgctgggattacaggcatgcgccatcacatctggctaatttctgtatttccagtagaggcagggtttcaccatgctggtgaactccagccatggctggtctcgaactcctggcctcaagtgatctgcctgccttggcctcccaaagtgctgggattacaggcatgagccactgcgcctggccgagtcttattcttctttaggtcttattgcaggataatgtacaataaagcattcagttagtgtttgaaaggaaatgtgtttgtctacaggtgtatgtgggagaaataaaatggcctctaactgatggcctctaacacacttctagtattaacatacactgaatgggtctatagtttgatgtatcaataaaatcaaatcaactaatttttaatcagctattatttactttagccttcattttttattgtcttgattccctgtaagaggatgaaaaactcaaatgtgacaatctttcctattatgtgaaccagtaaacatttttgaccttttccattctagagtcataatggaatcgaaagtagaacttgtctgatgggtgaggattgtgcatgagttttaatttgcttaagtagtcttctagctattgatcatgaccaagaacttattattgttgctaaataggaattgtaagaatgtggatattttgaggaatgagttaggagaaaagaagctgaatatatcttttaaagagatgcttagactgaagtatcagttcccttttttgtccacaatcttatagatctggtcacaccacttacgttgttatcaactcggccctttaactttgtagcttaaatcccttaccccatagagaaactatcacaaaacctcgtgaatcaaagaaatacttaaagaagagaatgtaagtaaatgattaagatcggtataatattaccatttcattcacttagcaaccaagttacaaataattccttagctttattttttattttgctgaagccagctttcccatagctcgtgtgtgtgtgtgtctttatatgacttataatgaagcctgactttgctatgcatttctttttgtgatttaaatacaacactcatactgaatccgtttgaagaaatgatttcatcattatcaggaggctacagtctatagtttccctttacttttaagcaacatatatattaacactaaagtagctttcaatctttgctggaaattacctatatttttaaaatgcatcactcctcgagtattttttaatccctttgtgacattattacaaaatcgtctagttcatgatcaatgcagataatgttttcttacaaaatcaaaccagcagcctccataggccagaagatctggcttaaccacccgggtcacagaggcacacctacttggttgcaccactttttaatcaacttgtgaatcaggcttgggaaggtggagttaagttagttcattgtgtctgtaacagtaggaagctcagaagaccaacatgtagggaaaaaagctgcaaagaaaatccatgggagccatttgtgtccacaggacctctcaatttcccttgcagagcatgcaaataaaaaaggtgatttgctctgatatggaattcctgcacaatgttcaggcatgcgtgcaagacagtaatctcttctgtgacagagtaacctgtgtagcacaggggagcatgaagtttggagccagcaaacctgagttccaagctccagccttaagtatagtttattgtatgaacttgagtatgacgtttaacccctctagagcctcatttccttatctgagaatcaaggacaataagacgctgccaacttcacagacttattatatggatcaaaccagaacagacatctcccaagcagaatgtgaatgcttactctgcatactttccaagctgcaggaaatatagaactaaattgggcatcgcccttgctctcaagcttctatttcagtgtgggattcatgaaaacataactaaaaggcaataagatcagatcaacagtaatataggtatcccaagaattgagtaaaatgttaacggagagagcaactgactgcctagaaaagacaagaaattacaaaaaaaagcaagaagacagatcctagcaagcacaagctaagtacatagaagacactcaaccagtgtggagtaaaatggaagtagcagttatgtgggtgttaaagaatgtgtttgagtttgcctgttggagataacagaggaactagggtctacagagctgccaaattgtgaaatataagagatgtatgctttgtaagctgcaatgcaggatacatatccttaagctcttattacccagccccaaatcactgtacccttctttgcccaccaataagacttttccaaaagaagtactcaagttagatcatcctagacagaaatgtagaatactttaaagctagaactgatcattaggttcttatcaaaatattttcttgcactcttgaagttggatttggtttttcactttggaaaacagtttcctccatagattacttataggcccctatttcctaattctatgtacacttcactctctcctgtactcagggtcactgggacaaaaatgacacaaggaaggcacttgtttttatgtctttattattgttttggaccaagatctcctacaccccacacttagagtgagtggaaattgttttcagagacaggtgctttttctcccatggcttagtgtcacagaaggaagatgacaccagcctggtgacatttgtgcctgggagagctgccagtccatgctgcttccccagttttaagaaacactatggtttgtcatacctaaattacttccacctctctgctggcggtgacagtgatgtcagttatcctgggtccagctaaggtttcagtctgtgtgttttccggatcatgttgattctcttcttcttcttaaaatgcaatttttctcattttgtgtttgtggtaagggctattttctgccaaaacagacattatcaaagcagttgcatagtgagggactggtgtcctttataagcgtagagaaaatccgagaacgtcaggcccagaaaggactttagaaatcccacaggatttggccaactctttgtcgtacttgcaagaggctgagaaacagacagactagatagctatgtcaaggccttgtagcaagtcacagcatgagaaaagtggaactttaaaaaatatagatagctacagataccacatttacatataccatttctgtatacttaggatttaagggtaatgtaatcctgaacagtgtagcagagaggattagtgaaaacggggttcttggagtgacttatccaccctcgtggttcatgatgcaaaggtggtgtgcatactggatgggagattcacaggtgggattatccacggattcctgatgtcacaaacctgtgacttctcctattttctaaaactgaactgtggctactagcggacacatatgctataactaaaggtgcagaccggcagcaattaaaaccagagacggacgctagaactctctaagagcaaaatgcaatccccgccccacctggagttcatctaggattccaaagtaaatacacctcctttctgttttgcctagggatttttttttttcctggaaagggtggagaagatttacgtaagaaagctgagttgcctcaaaatacagcctccagaaagaatgaggcatctcctgcccaacctattattcctgctgaggagagagaaattgaggaactaaaagtgaagcctaaaattgccagggctgaaatcttggtagaaatcaactagtctataaaattagctgcctcactggccctttagggtggaaataccataaggagcagacatctgatgtaaagttgagagggaagttgtctgtcttcatcaatagtaaatcaaatctaggttaaatagacaaatgccatctccaaggagagtaggatcacaattatataggatgccgaatatataatgacactaaatccagttaacaggttgaaaacctgaggcatgggcaggggaagtgtcttgcttcaagtaatgtaatgaatttactggcagatgcagaacttaacccaaaattcatgactcttagaacagtgccctttcatgcatgatcctgaaatgcaagaggggtttcatttttatggtttcaaggtagaatgaattatgaaaatctgggcttgtattataatatatcccagtgtggaatcagaaggaaaagtgatgtgttatgcagtgaacttgagtgaatacttattcattatccattcagcagaagagactaactcaaaatcaaagaggtgaaacccgaagcccaggtttcctgatgttgattccagagttctttccactattccttgctggcagttgactgcgtctatgaccatttgccatggtggcagctgtatggaggatatggcagtaagtaggggggccagggactggaatatatagttttaatccggctattcaaacataagacaatacagtgctttaaaaaataagaatttataggagatatttagtagccatcttcagaaatacatatattgataaatacaacaataaaagatactgaaatttatttggaatctatcataaactaaatagtgccatagggctgattagggaagttaaatattataatgtaaggtgatattttaccttttagagatgaaagttcaaagaaactaaacacatcactattcaaacacaatttagtttgatttaagaccttctctttccaaagtagaccagtcaatgggagtacagatgaatatgtttattttaatgaataacgtataatagcaataggaggaacttaattttgttgatgagtttttactctaagaaattttaaaaaatattttaaataatagtagctgctagtgcttgtactagtgttgtagtaaggtgagctctgtaatgcattgttggcctaaacataaacaggtatactgtttggaaattaatgtatctatcaggctttaaaatatttttgtcttttaattgaataatttgcttatatgatagtgtattttaataaatagtgtaataatttttgctgtatgattatagcggtaaagaaaaatcgaagcaaattgaattctcaactaattggaaatagctaaattaattcaataactatgtagcagtttaatttctttaattttaaaatttaacataatgcattcaatgaactgagaacgtactcattttagcagattaatttcaaaaagtaggtatatgcatctgtatacacagatacatatgtacatacttaacaaaatatatctttggtatttagtatgtgtacacctggtaaaacacatacttgtgtgtaatatgtatctctggaagagaataaaccaaaatgctaatggtgtctacgtgtagtttctaggataaatgactgcaatttattccatacattgtgtattttctatattttcaacaacatatttgtaatctaaacaaatacatgtatttttaaaaatcctaaagaagtgagttttgtataataaaataattagagtttttattttaatgtatataatactaaaaaggaaagcaatttggaaatacttgatgaatatgttaaaggtttaaacctttattaatgaagacactactccctcaacagagcagggattgggagtaaggcaaaatatattaatagatcatttaaaggagaaaggcagagggctaatgaacatattgaaacacatgtaatatcactagcactaaagggaattaatatcaaaatgaaatatttttttcatttataaagttggaaaagataatcctctcagtgctgtagtagttagcctcattcaaatgtaatttggtgcagtctttttggaaaataacttgatattatatccatgaagtgacttaaatccataacatttgacccagtacttttagttgtaggagtacttaacaggggaaaatactcaaaatataatgataactaaaaaaaaattatattgcatatgatctcaatcttgtttatatacataaacacgggaggaagaccatagaaacttttaatgtaattctgagagttgcgcttatagttgactttcattttttatttgtattttacttttttcttctaaatttcacactatttttgtaacctaaaatttttaaatccataatacaaaacaatatgaggagagattatcttatctctgtacctttgtatatctatttacttgaactgtaagtaaggcactatctaaatccaggtaagtggtaaaatactgttattacaatcatagcatgggctatatggtaaatgaactgtaggacatacatgacattgaagaaggataaatacaggagtagggggaaaagtaaatattaagatgtaattaaacaatgaagcagtgtttgtagattccagtctcaaaatacacagattcggatctcaattccaatgtttaatatctatctgcatttcagtgtcttcatctgtgcaataacaatgaacatagtatctaaggcataattttgtgagtattaaatgagtttgttatatgtaaagtgctttgagtaccttaaccataaaaagtgcagaatctaaattctgtctaccattttatcttttacttgaacatgtatacaaataaaaaattaaatctagaatacaactgtaagatttacgacagaactcgtctccctttctatgcctatgagacttacccatttttcagaacttagctggtcaccctaaaatgggtgagatctaatatcttgctttggaacttagcctcagactaaaaattgatttgttgaactaattcagtggccttcagtagcttcctcaaatgctaattcttatcacctatctgaggcaggagaggaaggtaaacacttaattcatgcaatattagaactttaaaagttactcagtgtgttctgttgatcatccttcaacttaatggtagctgataccaaaaagatctcattggttttgttctgcagcagcctggaaagccccaacatttcttagctttcacgcatgttctaaaaaccccaaccttttttgactattacaggtttttcatgctgacaactgtcccttttcacaaataattatcaagggcttgagatacggagcttgaattgaaagcgatattttttctctcttctattttagatactatactttgatttttacaagatcaaaaggcatctctctgtaaaatctctctgtaaaaaggcatctctctgtgtccgtctcataataaatgctttgggtaaatactcttctaattctagttctttcttatagaattatagaactgtttaattgagctgatactcaccgagcttttggagtactaaatgtgacatgatgaacataaatgtattctgacttcaaaaacttcacaatcttgttgaggagagcgttaagtatacaactttttgcattgaaagatagaattttattactgcttttatttatattcatataaaataagagaaggtttaacttcaactagggtttagagaaattctcacatcggtaggctttaaagaatctaaaagtatttgaatatatcgggaaagcaaatgaaggcattctaaactgagggaccggaatgaacagaaggacaaaaatagccagctggggtccacatttgctaagcaaagtggattataaggaaagtgaagctgaaatggtagtttggggccagattttaaagggccttgaatgccattctaagtaatttatctggtcctgttggcactgggacaccctgaggagtgacatgatcagagttgcactttaggaaagatgaagttatatagtgagggagctctagcagggaggaaagaaagtggagacattgctgtatgttccttttttgccctcattcagcattcaggtagatttgttattaaaacatagaaggattgattgtcagcccctgtacctgctagttctgtattcatggactcaaacaaccatggatcataaatattcagggaaaaaattaaaaataaaaatacaacaaaccaaaaaaatccagtataactatttaactttttcacatagggatgtcaaatggagccattgacatcggtattttatgaaaatggcatttcaaatctgagaaaaatatatattattcgataaataataaagatcagttttcgattgatgagagtggattttcctttgtttttcatacagacatacattctggaaagttaaaagacttgcatgtgaaaacattcaaaaatcctaatattgtaatatggttgcaaaattttacattgggctgggaaaggcctttcacgctgtgtctgaaacacagtaagtcataaaacaaaaaaggataagttgactatggaaaaattagaattttcctacaccaaaaagcaaaccataatactgtatgcaaatttgaaagaccagacatacctaaacacacacacacacacacacacacacacacacacacgcatgcacaaatacatatacaaacacaaacacaggaaaatatagcacttataataaaaagttggatgttaaaaaagatagtcaacaaaatgttagcattttgttatttctggaaagcatatgcttcgatctgacatcttggacttctattcccaaagctatggctttacagcgccgccatttttacccagggggcagcgtgacccctaattcagagaccgtggagctttacgaagtctgaggaaatgactgagaaaaggcaagagctctaaatagagttgttctaactactgaggacttgggacattgacgtaaaatccttgcatttctttatttatctgaaaaatgtagataataatactaacttacaccactaggtggttagaaaattaatgcatgttactaaacatttagtacatttgagatccacatataagcattgttgttgagtgcagagaattgttacttctttgtaacctgcttaaatcaatgcatgatatttacatcagctactcactaattctgaaaccaaacattatcaggtatactttaattagctcttttatggaaatgtttgtgctgagttcaaatctacatgaactattagcgaatttttcattgtgaggataccttaaagcaaaaaatatggattttccaccaatatgttccttttcctttatgtcatttaagtatcttaagtagctgtgcagcttgactacttcacttgtacaatatgaagatgagcaaactgagggacaaataaatatccgagtaaaatcagaggaatatcctctaaatcacttctctgattctggacaaaaacaggctcttatctttgtaattgtctttagaaatcatttagctctgccctcatttcacaaatgaggaatctgaatccagagtggttaagtaacttgccccaagggcacggagctcctgtctcctaactcccagtccagtgctcttttcttccaacatactcaaagttctcaagtagccatagtggatatattgtcttagattttgtccagaatctttgtagatatgttagacagagaccgtatttggattcatgctgatagctgaggtggcacatggaaggaatctgactttttcatctttcaaatcttgctgggaatcttttgacttcgtgaaaggtgaagtttgtttacatttttagtggatatcaatacttgggaccctgagccttagatttaggtgttcaaatggctacatgatcccattagtgtaaaaaacaatttaataatgactttggtaggcagttgtgctaacagcatttcctctagatcattgattcccaagcgtgactcatccagaaccgcctagcaggctgtataaaatccagttgttggggctgtaaccctgcagagtctgattcaggaggtctggggccacgtccagaaatctgtttttaaaaagcaccctggatgattttcaggatcatccaagtttttgggccacaggaattatgcatacctttaaggaagtaaccatctgctttctactgttgactcttaagctgtcagtaggtgtagaatttagacacattgtacaaaaaattatactgtattttgtaagtaggtttttttttttttgccttctaggcagtgctcatttggttaattataggtagaaagagagatcattcttcccaatatatgtgtgaagaaatgaatgttttgtctgatataaatttgtagtgttacagagtactgtcatattcttgcatactcaagatcaaattatattatgggagttttttggtttttgtgtataaaagaaggaagcattattaccagtaacctatgggtcttatatatcagccaatgaccacgtcatcctttaagtgcataaattttatggatgcaaaagtagaagtaaaggggaggcaaatccgaagtcgtgaacgtatttgcaaactttgtttctgaaatgtatgttctaatctcttctggcttccaattctcttctaaactttgtgtcttctaaattttagaagaaatcacaattttcacttatagttatcttggccacttacaacctttcaagcaaaatagaggaaattgggtccctgagtggggggtgggggtgtaggatgatgtcaagaaataaatctaactgaattacaaatactcagcagtaaagagagtattttaatgaatcagatgataaccatcagggtgcatttcatctccactaaatcttcgtaccaaggccagattctacatgaatgttggtacgtatttatgtaaatgtatttttaaaacaaaagccaattgatatcttatgctttaatacttattccactaatcatttacatagatgcatcacgtgcagtaatcatttttattacctattcacaagcaaaaatattagtataaactgggtacaataaaatagagaaaagaaatattcaaatagataagcgttttgttaaaaaaaaaaaaaagaagaaagaaaggacacatttatcaggattcctatttcccgtacataatatggatgtttgtttgtttttgtaagttaacgggaccggtggtttaacttgttattgaaacatgctcgaaaaaatcaggtagcttattttgtaattgcttgttatgaaaccactggcatttctctggggaaaataagttaaaaactctttagctatcaggcagtgggttttaattttttatattggttaaatgtaacagtggatttgcgtactctctcctaatttctaactttgtgtaatcattcttgaaaccccaaatctagattttaaaaaagaagccttctaaaagttttcctgaagtttacttttcagttacaaagagtaaaataactttctgaaatgccttctgtaaatcgtggtggtggtgcggtttgtttggggagatttgttttgtttttaaaagacagtgcactttcttatgaaagagacagggaaagttttacctgtctgtctcctgggtttgttttttttttctttctttctttttcttttaaagattggtgataaggaattctaactacttaatgagatgggagaggcctcactccattggagtggaggagtccaggtggaagttgatggattggacaggtaaagagaagagtcccgcctcctcatgcctatagttgggtatatattaggaaaccttaaattatgtacagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgaggtaaggattttagattttagcactccatttagagatgctttttaatttttatttttgtaaaaaaacttacgtatttgcggttctcggtcacccaatgtaatgttttgcaaattgtatataggaatctccttttcttggttaatgttttctgtggtggctgtaagatttttttttttttattaagtaggagatgaaacagtaggagaagatgaaaaagaaaatctgggtgacattatgtatttgaaaaaataatattcaggagtttataaaatcactttttagaaaaacagactcagagagcagatcacactctgctagatacattgcaatgaatcctctgatgggtattcatgtaccagtaagaaaaatcagttgactgtgtcttaacttcttagcatagttctatttccagacttcatcctaaaagcaaatgaagcttttttcaaaataatcaggtgagattttttaaagccatcttcgtttttaagtctgtcaatccagagacccacctaaatccagaaggggctgtgataacgtttctgtcgtctggagggtgacttgtactttcacgtgtgatgacaaataaagttattttggagggatgcattgttaaatatttatacatgcatacatgtaaatgtgtattatagcatacaggattttatttaagaaactgattatttgcatttctgatctcttctcagcaagtttgtcttaggtatttaaacctgtgcaaagggataaaaaaaaaaatcctgaagagactgtaaggctttgaggaagtttcctaaggttgagggaggtctaacaacaatattagtttacattcctcagaatggggcagctgtgttgacactaatcagattgggttgtggtggggagtgttgtggagagagagagttcggtgtttcagataaaaatgcttgcaggtgagtgcttggaaaagtggactagagtactcaaattgagctccttaaaaatcaaaacaaaatgcatagtattccggtgcagaccgcaagaggaagagtagagcagagggctgcgaagcagggcctgtgctatcgtattgaccacgctattgtctagactcctgaactgtgtaaatacaacaggggaaatatcgagttatctaaagaaggaaaaggaagtgcctatttttctttaaaacattcaagcaggcttgcttgtcctcagtagagaaacttgagtttcttgttttgcagttatattgaaagttagcttaaaatgttaccaatttgtttttaaataggattagcttttaagatcttcttgattctattggatccaattttgtccagttttaatcattcagaaaatgatctgtccatcatgtcatacctgagtttgtttgtctttattcatgaactatttcacacacagtatttataagccgcctaggatcttgtaagtcaaatgggagaagcaaaagtctgttcattgatatctctaagtgaagcacaaggttgatgtaaagtggcaagaaatgattaattttaggttaaatataatgtcgtgaaagaaagcaattgcattaatgttgtgattagaggatatttgtagaaattatttccttttatggaggcaaaagagtcatattgtatgtgagaatatggcatgcttatgaaagaaaatagttttatacacaggttttagtttttcacaactctaggtaaatatgtaatcaagagctacaaaaggcatcccttgtctgttttctattggaatgctgctaaggtcgacaaaaaatatctgtaaaaaacatggctgcacttccctacctttctatgtctttttgcatgttgcctgcatgactttcatatccttccaccagtgcatgtattaggttataatttcatggcttgacttccattctattacgtacgaacaactttctttctgtacaggattatgctttcatatctagtcctctgttaaaattcagtgctacatctgagtatatgaaatgcctggcaccacatggctctgagaaccatgaatttaatataaaagttataatgtatagggatttatgtttattagtaactgtcaatacagaaaaagcaatctactattattacacaagaattgttaaacattgggtagattaaaaatgaaaaaggcataaaactccctgtaagagtgaaaattatttaaaaactataatccattctttgacttcaaataaatttatagtttaatttgctagcaatttctttgagttgataactcaaaaactatataagaacactgttccttctctattccttttcccacaacttttgaattcttccccaacccttagcagatttggatttgggggagctgctaattaacaggaaatggtccggaagggaggagaacacaagcaggatataacaggcaaggctgaaggctctacccttgggtacagcggagaggccgcaagcaagctccactccccagtgccagactaggaaagacagagcctctgggaatggtctcagacttggagatagagagggtcaaaataaaggaacttcttcacagatcaagttttaacttcaactttctggcaaaacaaaacaaaacaaaactgggctgtgtgtgtggtgtaagtgtgtatgtgtgtgagtggggaggatctcaaactccttcttagaaagagatatttactaaaattcctcatccggggttttagatgatgaaggaaagacactttggtaaatgggttacagtattttcgaactaaatgggaaatcaaggttcatatatggaaacacctcattttacaaatcagggttaatgatttttctttctgtagttgagagagctatatgtatacgatcgtgttccctttactcagccactttctttttaataccaaggagagatgggatgattcatagtagatgctccaaaacagtttccatgaagaacagttgtacaaagccagttgaatgcaagaaaaaaagtgtggagacagcagtgtaaactccctgtagtccaggtcattctcacttaattgacttctttgtctgcttggtctagggaaaaaaatctgtcctgtcctagtactatttctactgactcaaccatttaaaagatatgggtgtgagttttctattgatagttaataaatgtattaagctgtcccatgttgtacttctgagctagttagcatcataggaaaaagcacagtgggtgagaagcagaagctgcatttttaattagtgtcagccaggtcgtattcctcactccatgctgttgccatagattgcactacttgttttacagttggttgtcctcgagcccagagggaactaggagaaagacatcttagatcacagatcacagatcataccttccttcactactactggaaaaaaaaagattttgagacaataaatcacttatcctttacctcgataaggaaaaccgtgtttggtttggtttgctttttagaagagcagtgattctcaacagcatgtcacacgtacagcagaaagcatcaatggatgtctacattttctagagcaaccaaaaaaatattggtttctttttcattatacgtacattttctgaatgcaaagttgctaaaacattcctcaatgactatggacagaatttagattctgcgttctgctataaagggagtatatatctaatgtcatgagattttaaaaagggatttggatcaaacagttgagaaatatgttaccacaaatacaccctggttttctttgatgtgcatatgattgctctgggtggaatctgagctggtagaatagaggggcacaggtaaaaatccttccttcctagtataacttttctctccccttgaatatttttaaatttctaattgttttatgtcaacaaatagaatgaatacaggtaacaaaaagatacttctgtgaaaaacaacttgatgatttccataatttataagttttactattttgaagataaaaaattgttaaacccaagtgggcgctcaattttctttagatgtatgttgaggaaaatgtcagttgactaatatagcattattgtccagtgccaatttagtggaacctacaaatggtatccaatagagtactacattttgggtctggaagagcatggattcaagtgtcaaggtgaaacatttgattcaaaagttaagttttaaatcttattcctaatcttaaggacacaatttgtgggcccaagaaaatagtgaaatgtggcttattaatgggccaccactctaaacattttataatttttacttatactttttgattaagttctatgttgacaatattcatgaaaagtagtattgagaaagagaaacaggttagaagaagaactgactgactcttaaaaaaatgtttactgagcatcaattatatgtaaaatggtatataggatctaaaaataattaagaaataattcctacactaagaagtttatagttctttgggggaatgagctaagtatgcatgcaattataatacaggagagattttaagtgtgtgagcaagataatataaagcatcaaagggaaagagagtccatgatgtaggaagatcaagaaagtctatatgcatatgtaagatgaagctgcacttggaaggacagatggaaatttccaagttctagaaatataagaaggaatgaggattttaggtgaagaaataagcatcagcaaagggaaggggggtgaggagtgaatgctggtacactcagaagcatcaaatagttcaaatgcaattgaaattatgagacgatcaggaaataaagttggaaatgcaagatagagtggctcagagatgaccataacactgagaggagagtacatttatcatagtgacaatgaaaagccatggaaggatttcgaacagaagaatggtgtaattgtgtaattggagctctactagagagcacagggagaataaatggctttgcttgagattgcctagaagtatgaaaatgcatctctctgcattgcacattggctgcctgttttgcagaaatatctatcagttctcttggatctttggaaggatacgcatggattgtttctaaagtctcatacaacctgtgtattttctgcccagtgctctttttaatagctatggtccctgccatagacaaattgggaactactggtcttggtttgtctttatttatgcctgctattctagcataattactaatagcacaccttttcactttcaaaactgtcccatttagaagataaattatatagtcactctgtaaagaccccattctttatttcattctcttccacacactaacactccaccccaaaatgaaaaagtagtataaatttggctgtaagccagacacaatgattttgaagtaccagccacaaatcattttgattatttcccccactaaaggaaacacttccttccaacccaacagttactgaaaacttataatagtcactgttatatgcactgtgaggaaagaagaaattagtaattcacagcttctagcctccgtgaattcataatctgagggagttatgaggggttcgtaaatgactccagtataaaacagaattggtaaaagatatcccaagttttgaaagagtgaaatcgagttcaaactgtttatgataaaggtaatattttatatggtttgagaactgaaattcagatgtggcgtgaggggaggaaagacattctatgtagaggggataaaatttataaaaatacaagggaggactgtgccagacaacgtgaaggaacatagtatattgatttaaaaagaaaatgtgttggtttaaacactgatatgtatttactatttatgtcaaaatggaacgcttttgtagaaatagcaacaaaagttaattggaatattgatctcactaagagcggaaacctatatgtgttttaaaagtgtgaccagtgttcagaattcgagattcaaaacttcacatactctagggatgatgagtgacatcttgcaggaaggaaaagaaaattagcccgaatgattccttaggctgaaaagttgaggattaccttttcccgttccttagacttctacagagccagatatggtgtcctatcatttatagggacttagtaatgacattttaaaacttatcaaagctaggaacaaaattcaaactgactctctgtgtttattatgagttaattttatttattaaatagtcgtcttagaaataggaccagaagtcttttctctggtcactgctctaaatgcaaatagtaatcctgaagctgaatataagacatttattcagaatgagaatcccagctgggaaataaataacagagcagagggaaatatgaatatcccatttaaaagccaaccccaccaaataaaaaatttaagatattatctttgccataaaatttttaaatttgactttgggacaaggatacatgtgtaagatgtaatatgtaaagataaatattgggagaagacatgtcttttcccacatcaatatcctccctttccacagcctccttcatcacttccatctcacccaagaagaccacgtgggcaattgaagagataataacagggcaggggagggtaggccatggtgggaggaaggagtgaaccagtgacttgatttaaagccaaagggagtggataagagaactgggcttcaagataaataaggagacatctaagctagtactcatttctttctcttttttttaccaacctaatcctccactttcaaaaagtagattttgaaagcatcaaatgttaacatatgattgtcctacagacattaggggaaacagtgaggttccactaaatacaacctccttaaaagaaataagtagttcaatgaagtgtctgtaaaatcttttcaaaagtcttactttatacttccccacagttgatttccttagttggtctgagaatatagcacctatactattcaaaaactattcttttccattttctgcaaaaaaaattataaatttcttatttctaagttgattgattgcatgtttgatatggactaactttattctgattttgaagttgttcaagcttctttttcaaagacaaagtacaaatggatcattgtatggattcgagctgagatggcttcaccagataatgttcacctgtcaatttaaaattcagtcactggggttaagatagagcacatgttggttctaggtgagggaataactggcaagaataaaacatttttggaatgttagtgaatgtgtgtgtaacgtaaattgatatttcatgcaaaacttgtaatctgaattgcatcttgtctgtatttcttaaatggcaaaaagatttccttataaaagctgaaagagggaattttgagtcaagctgtggtgtgttgccagaggcggaaatttatgaaacactcttgtcagctatgctggaaacactacaaaagaaatagttctactttcttattggtgctaaagccactaataggtgcagtttagtataatacccctatgagaattaccacccccgaagtgagcttgccttggaaggaactctgtacaggcattttctttttccttttaagcttgcgcaaaacacccaaaggggccatttcccacccagccagtgatctttctcaagtttattctttctcagatcacagagacaatggggaatatgccctgtttactcaaatcagtctggattagtgtcactctattgatggagtcagaattaaaaggaaaaccattaccctctcaaagggcaacatcagatgtttggggaatggcgtgattacttttaaatagaccgtgtgagactctgtcaccagactgaggttgaggactccacaagacacacttgaagagaaacagtaacactgggtgaggcaggaagctcttcataagccttaggcctgggaaattatttcaacagacaatcccaaaatgcttgaaaggctgaaaatcagaatggtgagacttcagagaagagggcttttctgccttctttctttgctccaacacctcacccccatatatttatctccaggtcaaatcctttccagtcattaagccctgctggggagaaacttaaccctgaaaaagctctcagattcccccattcaggataacacttccatcctctgaactcttttactctgtttcttcctcattgctctctgtgtacaccagatccttcctccctatcctttgactgaagaccctgggagggtagaggatgtgttatgcttatctctgtatcccctacagggccactcagtaatgttccctgaatgtgatgaggacatgcatctgttgctgttgcttgaagggatatcttcacctaggaatatatggtgtattgtatatacttaaaaggctgtttgtaattgacttgtgcacaaaaataaataaagcgagccgacatattatacaagcctcttctatctatatgttctgcaggtaaaccaaattgtgtcattttccttcacatcttgcaggtcatttgtttttgctgtttgtttgttttaataagcccaatattatttccattatcttttaaatagcaagaaagtttttgaaagacagggcagatgatttgtttggtatcaagtaattagtgtaaagtatgtgctgctttcacataattgattactcacaaggacagagaatgtgtttgattaaaaaaaagtcttagatttttatcttgctttgcaggccctttttaaaagtgtttacctgtgtctgcactgttcccttgattcagtttatcccctgcagttctctctgtcctcaccagagatgggggaagtttgatctgggtgaataagcttgatgatttgcaaacgctctctccttttaattctctatagtgttatcactaaaggatgtctgagaaacctcaaagcaatttttctcttaaacgtggtattccaacttttggttttgctcatatcttttataataggacaaatagaataaaatgaataagacgagtgtcttttcaaaagtaaggcatgtcttctgcatagctcaaaacttgagttttattttgcagttaaagtgacagctgagaggaacactccaatgttatataggtcaccatatctaattgcaaagtaatcactaaaaactttaattatctcaaatataacttaaaaagtagcaatcagcaaagaatttgacaaacaaaagcaaattagaactcatgaaacagtgttccccgcttgaatgcctatagtctaacaagattgagtagtacactccttgtttcaagcctcagttttccagttgcaaataaaaactagtgtttcaacctttaagtgtttgttatattggagcataaatttatatcatttgcaagaaaggatttataagtctgataaactataatctcagttccttaaacatacaatcacaaactgttaattatggctttattctaaactgaattctggctaactgggcataaaatcatggaaattaggcagggagggaccaattttgtggcctatctaccagaaactaaatgtctttctctaagcttgtttctgggtggtttcttttcaaagcaacctgcatttggccatgtgctccatcagtaggaagtgaataattatatgaccacaaagatataggttcttattgctgacctaggtgcattcgaaacaaaacctagaccatcaggttaaaaaacactgccttggcacaaaagtgtgtatgtgtttgttttaaggaagtagaagctcattaataaacttcccagctaggtgtgagctaccaagtattactcattgtattgtgagtgacaggactggctattctgctactagttcccataaaagctgaagctaaaagcacaattcccacctaccaagacaaagctaaacaaaaagtaaagatcatagagattatttagggatgcactataacatttgtctgacagtagcatataaagaaatgaatcaaatttggacacagactcaggataaaataaatgatcagttgtattagaataaaagagatactttctgcaagtaattttcatgttgaagtgttttgcatttattcttttaagaactgtctcctgagcatctattatgtttcagccattatcccaggtattggggattcagtactaaacaggccagatatattctctcattaacttattgcctagcagagaagaccaacatttttaaaagtttatacatatagttaatttctattatgattatatgatacaaatggaaagtgctatgaaaatgtggaacaaaagagaataatctgtctgaacagtcaaagaagacttctgggagatgacatctgagctaaaggttgaacaaggaattggaaaacagctggcatgtgcaaaagacttgaagactgaaggagttagcctttaaaaaaatgaagaaagttctatttggccagagcagagtttcaaatagtgcctcacaggccacgttaaagacctgaggcctttattctaggagaatagggagctgctcaaggaatttaagcttgagagtgacaagatcagatttgcaatgcctttcaagtggtagttacaaggagttgggtctctgaccctttgcaattatacccattctaactaagaatggggaaacttttatatcctgtctttaatgagtaaaaaaaaaaaaaagaaaaaaaaagcaaataaaagaggtgcgcttttcttgattgtaactttcagataaaaattccaggcagaaatgtgagtgattcctatttacatgcagtcggaatgaaagctacttaggaaagcgggttccggagccagatttactggttcgacatccaggctcttctcactaccttgggcgagttacttaaccttgtggagcttcagtttcctcatctataaaacatggataaaacatggatattaatgccatgtgtctcatgagaaataagtaaaaccatgcaaagcacttgaacactctaagacacatacttagaactccgtaagagaattaataatagtagaagtaattgctcattttcttttatagaggggatggaagatggatgataagtagatttcagagttttaaaatttatttttatttttattttttgctcctgatagtcaccattactttattgaaactgatatgtcttcagtttcatgtcatggtaacgaaagcttattttctgtgataaaatgttaatcacatttaatcacccgttgttttaagtcacaatttaggatatgaactagacaaatatactaccaacattatttaaaaaatatttttaaactcactttccaaaccaaggatgcattactgctgggcttctaaaggcagtatggtatgcttaacataaagatggcttaacattcattgaagaattttattactatgtactttcttcttttaatattaccatatctgctatatagagctatgaaaacatattgattgctatagattgaaaatctcttcaaacatattttgattcacttggaataaactgaaattctgaatatttcccctaataccagaattaaaaattattaaatattaaaattctatcctgctttctgcttagtttgatacttctttgatataaaatgataataattccttcagaattgggatgccttctgattttcattttgttgagttgttatgattattataggagtatgtactaaaataatataattttaaaatttatttttcttaattgagttctacacattttaatttagctgcatttggatcaagttttaattttaatacctttcccacttcctgtcttttcaaatgttgtgtcaaatgtttgttgacattgttgtccacctgatcagacaactttgtatttatttctctcacctgccgttggggcttctagagctctttctcctaaattatggaatcttggcactcaaaggaatcttgacactttgtgtcagaacacaggacatctagtgaactctctgcttacagtcttgatagttttgggtgcgtttaaatactttattcttatattttgttctttgtatgagtatatattaagtattcactttttatataattttagaaaacaaaatgagtgacatattttatacctaataaaatctggttttgagaaaaatgtgatgctacataaattcttcggttggaaagatggtgttttaacttgacgtttgaataccaatatattttcttaacctggagtagaacactgtaagtcaattgtgtttaattctagcataaaagaaaccatcattctctgaggtggggcaggtggcagaagacgaaaaaatgacaagtatgtctcccttaggcagtgcttgttgaaaagtcactatcctgctgatatttggggatggaaatgtagtactctctgctaaagcataattgaatgaatgcttttaaagccagggtcatcaagtaaagctgttttctttacccatgagggactgtagaatgttcataaaagcacctccgtgaagcctcaggtgaaaggtggttatcagctgaggaaactgtatgtgctgcctaaaatgttttagatttctaagtttggtcagggacatctgtatagagagagaacagttaccttagaaaactgttttgaatgtggtcttatagcattgttttaacgtagcttcacagatgaggatggccataagtcacagaatgttagaactggagatccctctcattgaatcctcaaattcagtctcctcaattttacacagactttggattatggtaaactaaggtccacaagttgttcagctaccttgcccagaggtacacagcacactagtggcagtgttgggacttagactccatgtaaagaagtttaagttcagaattcttttgcatcactaggatccatacaggagtgtaaggagtactgaagcgtgttcaatcccctagcctcatccaccagtcactcatggattataaatacaatttcttccaagtgaaatttgggaatactgttgtatcttgtaacaaaggtctggttgaatcgagataagttatgattatatatcccaacagtaatctcttctacccctgatttggtccctatcccatttttttaataacctcttactatatattgttgactattgttgctatagtgtcataaatttactattatagatagtaatatctgaaaaaggggacattttaaaaaattctcttggccaggtgtggtgtctcacacctttaatcccaacactttgggaggctgaggcaggtggatcacctgaggtcgggagtttgagaccagcccgaccaacatggagaaaccacatctctactaaaaatacaaaatcagccgggcatggtggcacctgcctgtaatcctagctactcaggaggctgagggaggagaatctcttgaacctgggaggcagaggttgtggtgacccaagatcgtgccattgcactccagcctgggcaacaagagtgaaactccatctcaaagaaaaaaaattatcttttacagataaattggtggagagagattttcaaaaacacaaattataggtaaatacctatttctattgcattggtcaaatagcttcattggaatctctttttgatgttaaatacttttataggaaaataattacgtcatcaactttaagtaaatataaatccaattatttaatattgagttatagcaatatatattgacacagttttgtttcttcatggtgaaaacagtttgagattcagctcctgggtatctttatacctaccatgcaagctgtatgtttcagaatgccctcagggtgttctatgattgcagggaatatgtcgagtccatgtgaccaaggcgtacttcatcctttctgtgatcagatcagctagtttgtgaggaacctgaatatatcacaactacaaataaattttccagggtccaaacagtgattcttctatttcaaagttattttatagaaaatgaagcatctgtttggaatcacaggaaattattttactttataagtttcacagtagatatcacagaagttgtgttcatttttgcctttatgttttgtggaaagaatactgcctcttttttcagacatgctgagatagatatataatgtttccattcactcattatttgggtgtctgcagggtatgttaaggttattccaaaatcaagatgccttgtgtttagaaagggagaacctgcttcctatttcatttcagatacgccaataacttttgttacctaagaaatacatgcatatgggacatgggggctctatggagttcttccaaaggccgtttttatggctgatctgaaagtatagtgttctaatctctgagactgactctttgacttgtcattgtcagtaagcattgcattaacatcccagcatattacacatttctctcctctgttatggaattattggctgtaaataaggcaagaggtactgctccctttaccccgccagatttgctgtgatagaaaataagggatagatattattcacttgacctgggacagcttcatgggcataaaaactgcaattggtcacacagggccctatcttagaaaagcaccattctttgtttaatgctttgctatcatcattttgaaattcttaatctatgaacaagaggttctgcattttcatcttgcactgagcactacaaattgtacaaattgttttgctggacctgtctgggtgacacttgttcttcttgactataatggccagcccttggcttccaattgtaccctgttaacacacgcgatctttctttaaatcaaaggaataagtgaataagaatattttctttaaactagatattttaaaaattaacttctgaagaatgaatttattgatttttaataaactaagaaaatatgtaaatggatttccagtcattcagttctgactttggtgggtttgttgttgtttctgttcattttaagctaacattcaaagttagtagtgtcagttttacgctttccaggaaaagacaacggagtatactacttggcttatatttctgtaaagtatcacttgagaagcgtttcaactgaaatgtgttttcccactttgattgtgtgtagtaggctgatttctcatcaatcctaagaaatatacctttatgttatattaattgaggatttagcattggtaacaaatcttgtttttcttacgtacaaaatctcccttgggactggatataatttaaaactatgacgcctaaaagtagatccatcagtacccacattgctattcatgacttttgaaatacagtttctgcttctttgttgcttctcaatggttcagtctttctatcattccaaaggactcttgtgactcctcagtaaatggaattttccctttcttttccttaatatccataaaatcagtttactcaagaaattatatagcagtatacagcctaaaccctttctcaaaattgtcactagcttttcttattcattaaaacattttcatctcattacaaatgatttcttcctttaaaatttcccagaaagtatggcctctgtattttctgctgctcagtttaaacacatcatcaaagacagataattattaatgtcatatgagcataacaggagatttataaatcagaaatgtattttctgggaaccaactttcaagttagtcaggtaagttttattaacttcactggtgaagtcctaggataaagcagtgcctagatcaggcttgtttacccttggccttatatggcaccaaacactgtttcaggacagtggaagaacagcctgggaggccttcggccttggccagccttgccgaggcccgctcaccaggagaaataggaaggaaggccagtgagtgtgcaaaggagcatggcttattttgaggtcctgaaggccagtgagtgtgcaaaggagcatggcttattttgaggtcctgctgattgcaggccaacaaaacaatggcaggatttgaaggaagaaagtattgcaacagagtcaccgtatactttgaactgcaaagggagactgaggaaatgttgcctcaaggccaaaaaccctggctcaaaacacaggttcctcaggtgactcagaggcagaccaagttcaccaagtcaaggacattttcctgctacccccctggggagaggggccttcaccaaaccaccctggacatggatctcctgctgttcagaacccacccaataaacaacagaagcaaacactttttttttttttttttttttttttttgccccttacacggaattgtccctttttgtaagtccttgttgaattgaagagtgtttgctcactggcttttaaagtgtggtcccaaaacttttttcttcgtttatattgggttaaaaaaaaaatcaaggggcccatgcgtctttgttctcatccaagcccacaattagttagctggggttccttctgtgtagctagaagcaggagggaagggggtggcccagcaggcattttactgcctgcgagaaagtgctgtgagtttctttgtcctttttgtcagggacggctgcctccctaattgtactgctgtagggaggcacgtgcctttgggagcattatctgattcctacaggacgttcaagagtgctttgtatactgacccttaacttgaacacaaagaatatcttttcaatccccttccgaggctgttgcctcaggcttggatacctaagagctttagttcagccggggtatggaccatttatatgggctcaggttttatttttttgtcccctagttgtcttacctgcagtttggccacacctgccgggagagaaagctgaagatggtgggtaagtggtggatagcagctatagaagtcagaagggagagaaagcgagacaaacagctgctcttgtcagcatggggataagtgtaaagagattaatagttatttgaagagcaaatggggacatggcattcggcagtggaatgcgaatgcatgaatgtaatggaatgagcatgtgactattaacatttagacaaatgcttcctggactgaatggaatggcaaagcccacttctcctccccctgtggaaaaaaaaaagttcaataaaataattaaaagtttgaaatttttaaaaagataagcctagctcctatttctttgtaagtttgttcttctctatagttttacttaatctgggactctcagttacatttcaactgaagagctaggcctatttcctttataaaatatgtacgaataggactgccttaatcttgcttttgatttttttttctcattcattaggttgatgaaacaagatttctatgtgtcggaaggttttacaaaggaaaagcaactgtaccataagctggttgcccctttgttcattttggctcaggtttagaaatgatgataggctgatttgcctactcaggctgacagttttgatggcatggacagagccctgaagtcagaaccagaagattcagcaccgaaagccccagtcattgtgttagcggatgctagggcaaatgctctacctctccgatagtaatatagtcaagttttttgtagagtaaatgaggcaaaattaatttattctttcataaatatgttcttgagtacttttactctgtgcttgggcccattcacatagaagacataaaaacgtttggcagaaggaaatacatgagctaatgtatttttgaattatattgaccatagaattttcttcataagtagttggtatttctcttacaaatgttctactctagaaaagaataaatttctattaagaaaatgaaagaacaaataaaaaagaattagaccagtttggatgatttactagcatgttactttttaaaatacatagttgggtgtccctaaccccgctacccatgatcctccagtctttgtgaaaccagtccttagggggctgggtggtacactcttggtactctgggacagaatgcagaattgcaagattaagagaaaattcgaaggtcatttgattttgccccctatgcaacaatttaacacttaaatcccctctggaacatacctatcaagtggtctttctcattttgtgtaacacgccccaacccccaccaacaacctcaaaatggaatagcaggcagtatttatttaaagacttcctaagcagctactgagcactgggaacgttttgcctagtttgtgaataagcatatactctactttcaaatgctctgtaggaagtcagtctccagaggtggcacatagagctgagtgatctggaaaagccgttacaaacacacacatgctcagacttctcttgttttctctgtttaccaaaaatcaacggttttactttgaatgtgaagtgcttccgacgtgaggtccatctctgtagaatgcattcacccatggatgcctttttttggagcaatgatccgtggcttcagcggctaatattggggtttctgggtgtccttgcagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacggtaagagcagcgggcacgcacatacctgaccccccaagtccaaggatgggcttcaccacgtcccagggatttctcccccttcccagtttagcgattccatgttcatggtggaaaatttgtctttgaatatttaatactgaaccagagagagagaaagtgccagttagtgggaaaagtcccaatttaggaaccaaacgtctgcgttctagccagctcctggcaacttcagtcagtgtgttcctgcctgcttcacactgttgtatgtgaaagttcatggcaaggtaaagagcgctgtgccaacaagaagtatcataatcatgggatatgtgtttacagtctccagaacgtgaacgtgtttaccagtctcattcttgtaaagaagtaagtgtcacattaagttgtgattttaaaaactgagtaaaataataaatatagtgttataaaaattaagaaaataaaatcccatttatgaaggaaggatgaatatgtttatacatgtaggtatcaataaattataatttatcagtaaattgtataatgtcttataaattactatttataatttatcagtgaattataatttattgatatgtatatatttatttaatttggaaacattcttttcgaaaagaaagcctttaaatagacatatcagagccctgaattagtccaaagaaattgttaaagaaaaatctttctgcatataagttttctaaggaagcatggaattttcttttcataaattaggaagatacaagaattagtccaaagaaattgttttaaaaaatctttctgtatataacttttctaaggaagcatggaattttctttttcataactagatccaagaatattttattttgaagtgtattttgaaatgtattataacaagaataaagctcaagtataaaagaggacacctacaaagttggttttaactggttgatcaaagaatgttcaagaccaaagtggtatgtttgtcaaacaacttaatcaagaccaaagtggtatgtttgtcaaacaacttaatgtttacatggattatagaaatgcttccaaatatcatcatcttaataaaaagtagctttagaattgttttgacagttttttccctctttgacaaatggatttctttggaaagcatttctatgtttatgttatatatagtatctagttcattccagcctttagtttgtatagtttataaaatgatcggcatgcctaagacctattacactctaacatcatttcacatccatttcctctttttcacctcatttctttgtgaagtacccaggacaagttttataacttccactgtgctagtgaggaaagctgaagaagttggaggttaagttaagaggcatgcctaaacttacagaaacttgtgtgtagctgggcctgtttttcatttctgcttccctctcactggattgtatcctttctttcaaccattttatatcaggatctcccaaaattgtctaaaaattaatgttattttagttctttcctcttgtggtttgagaagtaattctccggtggctcatatttcaactgtagagcatgaacatcagcttaaaacttgatctctcctccacgtgttacttatcaatggagtcataatccttagtttcctttacttttataattctggaggcgatggatactgcaggtgagtaaacttagagtttataggcttcaaatagttggttgattgatctaagtagtatcttgctaaagagccactagaataaccattttataaatggagcactgatatctcttaggtcaccaaccggacatttacagtcaccagtcttcaaagctaacagttactaattcagtttactccgccaggtctccattatattaggagtcagcatgtctgatgagatgatgggcatattagggctgctaaatgaataatcgctttttttccctgtaaaatttttagaaaaccatggggatgaatcttgatgtaagttcaacatcaaattagttatccttccctgtcccttcctcactacctcctcatatagaaatcttaaaagccgggcgtggtggctcacacctataatcccagcactttgggaggctgaggcaggcagatcacgaggtcaggagttcaagaccagcctggccaacatagtgaaaccctgtctgtactaaaaatacaaaaattagccagacgtggtggtgggtgcctgtagtctcagctactggggagactgagaaaggagaatcacttgaacctgggagacagaggttgtggcgagctgagatcgcaccactacatgtgatctgcctgcacaatagaacaagagtccgtctccaaaaaaaaaaaaaaaattaaagttattttcaggtttagcataatcctaaaccatcactcaaagcccctctctcagagaagtcaattgtcttactcaaaaagttggagatctctaccaaaatgttaggtttaaaagaaaagaaaatattctggtacactggtaaaatttccttacatgtgacagcagtaatatcagtgccctgacaaaagggatacactgtggtgatgagaaaaaggcactgactgagagacagaaaacctggattatggtcttgatcatttatgcaaacttagccaagtcacttgatctttctaaaattcagtctgtgcctcagatgagaaagaggatgagaatggagaaacctactctgttttcttaaggtgagatgatagtattaataattaacgtagaaagtttttagaagggctttggttcgcatcgatatattgtctgccattcatgagtgtccttggttaagtgattttgcttctcttggatttttgttcacttttctgcattctacctataaattttacaatcaggtttctactcacatatcacatggtaattatatttttattaaatttctttcttgttcacaaccaggcttatttcaggcccagttcatttcttctaaattagggcacttgaacccttatctgagcagctactgagatcacctaaaaagatgtaagttcttcgtcatggatacctgcatcttagcttctaattctttgagccaaattatatatcctcatgtttatacacagacttcccattttaaaaagtattttttcatatatttatcttagttgagcctcataaccaagtttgtaatccccagttttatagatgaggaaacttgaagatgtaaaggtcacatggctaataaccagccaaggatggggaagaatccaggcctccctcaccctaattcaagtctctccaccatcctagttagactgtttctcctctggtttgagaccagggaggggcatacaggagcaggcagtgcctgtgtagtttggagcttgcctcttatgtcccagagtccaactggtaaagaaattttttgtgccttattatacaacacctatttcttaggcatttgtgcattttagagcaatttttcaaaataaaatgctgcattttagaactgcccacaaactgaaagaaacagaagctgctgtcattagggggagatcatgcttatcgcatagtcttctggtaattctttaataaaaatatttttagtaccattttatcacttgcaatccttttatgtcaagttttcttttttaacttttctggttttaccctcaggattactgtcaaaatatagctaatatatttaaagtatatgtgcatttttcctttgcgtttctgtgttttaaataacaaatgtgattatgtttccagttctacaaaaatatggtatttattttaaacttctttcaatgaaatgaagtaaaataagacaacatttttcatcttctctgtttcacacacacatacatacacgacaaaccaacgtttactttagtttcagattttcttatttccacaatttaattgatactagttacagaggcctatcatttaatataatgtagtgctggtctagcattgtagttgggaatcgttaatcataggacagttgaaagaatggtagtgtggagatggcaagaaacttaaattcagatttcaactcggaaacttactaacagcatatggggctttcaccaaaaattcaatctctctaaacctcacttttctcacctacaaatgggaacaaatgggaacattaatactttccttatcatgaggattacttcatgtaaacatacctattagcacctagctactcatatgctcccaagtgtttattgggtctgaatttgaatttcttcggttcgtgagttcattgtagttttgttgaggcttcgacaaaactttagtacctttagttgtactaaaggtactcatttgagagaatgaaaaataaaatttcaactaatgttttttcttaaagcttttgggctattaacatgcatactttatagagggactgtgatactatccactatccaaatatatgaatagatggtatagggtgataacagcctctcctgcatgcagacttctgcaggctggctctgctgctttccgaagcctgcccaagcagatgtaggctctccttgccagtgcaaggagaggccctttccagatttaagaacctgttgatttttgacattcgttcctcatttttaatctgatgcttcatgatgggaatgcctttttgtattctttgtgttaaggaataacagtgggccttacttatggcagactcaagatattaatgtataatgacaaactactggaagcaacctgatcagtcacccgtgaaaaactagatggcatgttataagcaataaccatacggccattagaaagaattctctgtactgataaggaaagctttgggagttgctggtgagggaaaaagaaagctttctgtggcacctgcttgagaattgagagtcctggtaaggaaccccacttgtaggggcggtgtttctttgtgctcccctctagtgatgaggcttcttggtgaacatagttcagtctgtcttgattattggcctcacacacctttgccagttggagagctatttttcaccgctcatgacacgagagtactctctgtgtgcatacgccatgaaaatcctcaggttgtttttttttttgcattgttttgttttttaaattgtgttcagactgaagtaaggaccctacccttgggacataggatcactttttgctgttgtatctttctcctgtcattgacctcaaggtcttgtatggcagactccctgatctagtgcccagcacaatgtccagcacacagtaaacctttaataaatgggaaggaactttttttctctcataattaaaggaaacaattgtagttcccagcaggagccctcaattctgactctgattgttaactgcccgtgaatttgttccctgtagccttcacccatgatttatagagagtgttcttcctttgcctttcttaaccatgccagcttcgtgtcatgttcagagctgtggagaatttgacttgagcaagtggagagattagggaggtggcgtttgaaaggggaacagccagttcccgggagagttccattgatcccagcatatgggtcttggtctcgcaagctcactccctttggctccgcaggcaggctgagatgcgcgcctgcggcccaccctccctgtcatcaggttacctgtaatgtaagacttttagaaaaaggctgccagctctgcagaaatctaatgcaacccagccaattgcgtggccctctggaatttagagactcttaagaatagcccatcaaaggacaagatgtacagacaaactcttcgatggtaaataggatttatcagttttctttcacagtggaagcacttcccccattaaagtctgagtctcatctggggcttgatctaatcttacaattcagtggctgttagattttattggtgaggggcagaagtcagtagctcgtgccactggtacatgtgttcgtgtttatcataacaagataatttttacttcttgccatagctgtttcataaattatgtgagatgtgtatcaggtgcctttttgtgccactcccatgatgaagaaaataatagcattgagcatattaatctgttatctaaactatttcttagttcacagagtattgaggaagaatgtactaaataaagtgcttagagatttttggtgatggttcaagtaacttacctctaggttttggatttaaaatgaatattcattgtaaggcatgcttccgaagagttgttccctcatccagagcagaataactgaatcagcgttcttgcctgagttttagattgactctaggttaacgtattcgtgatgagccagtttaatctaatctaaggcttatcagcctcccatactattttgagtgatttgttcactgcaccgtggagtgtctatttaacattaaactgatcttgatttattgcatgtgaacattataaaaactattgattttaaaaatgaataatttaaataaagcttatatttcttttcctactacaaagagtaacagcaaaaatcctctgcttttcccttttcttctttctccctattcttctcctcttcccgcatttcttctcccccttctttctactccctccttctcttttttccttcatttatgttattattgttagttaatttggttttgtaggtatcatcagctacatggtatctttctttatttttttttactatagcttcactcttctccataaattaatatggagaacatgatatatatcaatcaccgtggaaatttttatcaggattaaattatcacaaccttttcatgtaacaaatcactttggtgaataataatgggctgctttagaggtagcaaacccaaatgtcattggagtcagggaggtagcataaatgagccgaatgataagtacagaaactgtggcaaaagagcttatatactgtatctacaaggacatctgctttacaatcccagactgttgtcacaggggaaagtagacctagtattaaaatatttaaaatattaaattaattatcacaatattaactcttaaatattaatttttaaaagagtaactagaaacctgggtttgcatgtaatatcttcatatcttaaaatgatgatactaattcaaaaaaaagttgtaaaacactacaggccaaacaaaacagtacacaggctgcatgccatcctgtgcaaggtgttaatggtaacaaggggagattactaaatgtttaaataaattaattggaagttagttattaaaataactaaaataactggaatcagcatctaagagaaaggttactagtgggtatattttattcacaagtaataattctttattcctttacaaagtcatatagattaatctcttgctgcatttaactaagcaatacattatcagaacatatttttctcaacttgttttcttacagcaaatgacctttctgcttctcatttttatatcattttatattttaaaaatctaatggcatgcaggattggatacttggaagtttattgtttgtttgttcctgtgcttatcattagagaattatggaactctgtaacttaactccttaaaattggccaaagttgcactcagaaaagagctttgagatttaaagggcttctaatcaattttctcagcttactaacagatagcttacttttaattggcacatagtgtgccagaacaaaaatcatctgataattgaagtataaagagaaaataatgtcataagaacttttaatgactctggaaaactatatcattaagctcaaaagagatcccttaaaatgaatgcaaacttaaaatcggccctgagtgatgtgtaccatttattgtgggattgtcgctcttggtacatttccatacatgagctttgcacattctcctgttcgcattccccaaattaggttatttccataacgtgaccaagtctatgcaattgttcctacccgctttggtaaagggccgatgtatgtttctcatgaaaagtcctcagcagttacagctgtcatatcgcgagtaaaaccatataactatatataaaaaccccctggttttatattagcagcaattggtatgtctagtcaggtcactgtgactgaaaggagacttgagataatgtagctttccaacaacttccaattcttcaaaattaaagaagagtttattgtagaatagaaagatagaaagataattcttcagttctttgaagccctgcagacattttgtagatatggaatggtttttagaatgatggatcctgtaatgaggcacacagaggcgtaaaggtaatgatcttagtagatttctctcttgtggtttttagtaatgatcatgaccttatcattaagccccccacgtgaaatttaaaagaaaatttgatagtagtcagagaccctagatctaatttattgtgaggtaaattagggagggattctgactttacagatagaatgagacttctcattttagtctgaatttaataatgaagattcatgtgggggaaaaaaaaaaccctacaacttgccaccttgttattgtatcagaaaggcctgaaaacagagcagggaccttaattgctaattgtgttagtaccaacctttcaagttcattgattaaataggagttccttcttggattaatgcctaagtttttatttttgttttgcttcatgtgctgttcagccagtatcatctgcattgaatcttataaaaactataatgaataagttgaggagactatttctaaagacttttcctttgagtggtttccaagttgtattaaataagaagactaatgattacttaagggttctcatttgaatttgagaagacatctgacaggctcctgaggagtgtgactcattaagtagaatacgggactcagaaggacaactttggggtactaacaagctatatgaactggggcaggtcttttgtctctgtctgtatgttaaatgagtattataatttttacttggcaagattgctgtgaggcttaattaaagtttataaagtgctttgggagcctgagagatgaagctctaaaaacataatatgttattatctcatcctggatttttgtttttagatttacttgcttgaatctgtatcataacgatgcttacaattcaggcagttttctgaggttttttatttctacaaagacatgaaataaaataacataaatatataagtccctagacattcatatgggatgaaaaaattacacataatttttttctgatgtaaaagagtttcttcttaaaaaatgtttaattgaatcttatatctgttaaccagctttatttttttaaaagcatttcagtgttttattcgtaacatttttgcagaaccagtaaaaagttttaaaatgcagtcatctttactgggtcatgagaagaaaaatttactccatttaaaaaatgtaaatacttatttaaatgtaaataaatatgcgcatttagatatatataaatataaatatattactccaattgaataacaatggaattaatttacagtaattagaatttgataatttgggcttgaaagatattcctttcttctatctttctgccttacttttttcttctactgtgtgttcatttgagattttcatatttataaaatataaaaatgtatatagagccctggagttaatataaattgccttgaaaattctttttattcctactttgtattcttgaaagaaaaatcatgttttcccataagaacagtgtcataattatggataaaatttctgaccaagctattgtcatcaagtaagtaatagatatgtttaactctatgtcataaaagcaaagctattaccaccataagccagtataattattggaaataacaaaatgattctcattgtcatataaactttgcttaaatattttatatgccttgacatatatgtattaagtttacttataaaatgttatttttataaacttatctagaactgactgctattataataaatacttttaacattttgacatgccataattttgatccatttcatggggaataatttgagaagcctatgtttctcaaaattttcgtaggaaaattagaatggatacttgtataatatattcctgttactaggaatgatgcttaaaaaaattctatagtgtaggtcagtcttcattttaagcaattgaatccatttttaatgatattacttaagaattttgcttgtaagaaaaaaaactgtatctgattgaatttgaaaatgtagttttggagtgtatttactcttcctgcctgataccccactccccaaaacagagtagtcttgaggaaataaaaggtcctcaaaggcagctagatatgagaagagtttgaattgctaatggggaaacttctagacctttgccttgatgttagaaaaggaatttgagaacatgatttatgtgttagacccagagtttgtctttaaacacaattcaagtttatcacctttcttataacctttctatacaaaaccatggatttagtgaataaagcatttggaagacggtggatagttgatagataaagcagattgaccaacatgtaaaaatagaaagtgttttcatagtaggaatttggaataactttttctatattcccatagttagaatggatgcctagaaaatgtatccttattgtgatgattaaaaatctctttttgaactaagacacgtaagatagtaacctctttctgctttgcttattctcccacccaggctgtgttgaagttatataagtataagcaaatgtgcactttttttttaaattttattattattatactttaagttctagggtacatgtgcacaatgtgcaggtttgttacatatgtatacgtgtgccatgttggtgtgctgcacccattaacttgtcatttagcattaggtatatctcctaatgctatccctccccccttccctcaccccacaacagtccccagtgtgtgatgttccccttcctgtgtccaggtgttctcattgttcaattcctacctatgagtgagaacatgcggtgtttacactgttttataaaatgcttttgtctaattttgttacctttaagtttagctacttggcaaataaacatttttaatactgcttaagtcaagtcttttacaaatagaattgtcaacatccaagagttaccaaaagatacttcattctttagatttttattgttctttcacagtactcactggtaatggattatattttaccttttttttttttttttttttttgagacagtctctcactctgtcactcaggctggagtgcagtggtgccacctgagctcactgcaacctccccctcccaggttcaagcaactctctgcctcagcctcctgaacagctgggattacaggcgcgtgactccatgcccagctaatttttgtatttttagtagagatggagtttcaccatcttggccaggctggtcttgaactcctgaccttgtgatccacccgcctcggcctcccaaagtgctgggattacaggcatgagccaccacgcccagccctattttacttttatctattgtcaatgactacattgaatacttttgtatgcaaatgtaacaaaggcatattttgcagttatttatactttatgtctgagaattatcacataatttagcaaacattaactcatctgtttaccttttgctgtaaaagctagagcaagtgatgtagatggggacaagaaaatgactcactcagcctcagaaccacaaggaactatagacttcttgcagtctggttttctcttcaaaaagcaattaaatatacgaccatttgtataagtttccacaatgcattcatatttcagaactgatttcttacctagcacggcatggatttcagttataatgtttctccttgcacaagcatggtagacatggggttagtaggtataagaatgcctctgggaacaatcttttaaggttttatagactcttttctctcaccactcccccaacctaagtgtaattgtcatcttagacactttgagtttaggggtggagatagggagagcatcatcagaagggacaaaaggagaaaggggaagtgaaatggtttgttggatactagtgagtggagccttttacagaagtacaatgcacgcattttacatttgttagttagatgttttctaagatggttttgtagctctgatggtatatttttatggatataaacttctaatatgaggaagagacccaaaccaattcaaatagcatgttaaaattcaatctatctacaatcttcacgtccttgattattacattctgtaatctcatgggtatttttgcttccaaatataaggacatacctattatttccttcagttttctttttaggagagttgactgaactatttcaggaaagaagatgtcttactttcctttgcctagtaagccttgctgctttttgaacacagtgcattttcttcaaaatatacccactactttaggtggtcttaatgaatgaataatatgtaattgtgtatacttttctaaaattctttgaaacttccaggaaggaaggtctcattaaatatctatttgaattttagtgaaaagaacaaaaaaaagcaataacaaattaagacctttgattcatgtgtactagcagtggttttattttggtagctagtgctgtgatgtaattgaagcagtattttcatatagaagcattttttacttttatgttctttctacttgttagaagtattcttttattatggttacttttgaatgtatgtttcccttgcactaactcagaatacagcctcacttcacagcgcttagatttgattcctgcattcatactgtttgcatttgagggtcctggtgactgcagtaatctccacctcctccagagccagagagaaagaaatggccacagctactttgtcatcttttgtcactggtctcaatagagggtcaagcgtgcttaccacatggaggatgcttcagaacaacaagggaaagaattagagtgttgcctgggtactgcccacgctgctatatgaacagtgagagaggttatattttcctaagcctcgcttaaagcattcccaactaacagattttctgtttctaatggtttgaacttttgtttttaagttgttatttgggcatgtggttgtagggcatagattatctcctaatttattgctttcttaatttgacattggaatttagacttcagaaacaaaaaatgcaatactttgaattatcttctttccataagttcctgatttaaaatgaaaatgtccccttaactgctaattacgagatatcgtataaagcatatgatacttacagtatatcttttttggttgttttataagatgaagattacaaatatgatatttagcacatcctggctcttcttgaaagcagggactatggctcttttactaaaggacaaatagtgcctaaggaaacaggagggtgtaggagaaagaattcagctttgtggtcagatagacctggggggttgaatttcacttctctctagctgtatggtgttgggctaaacactgtctctagagcggcttcctcacctttcaaatagggatgatactcctttaggtaacgatgttattggtaggatttgatataataagtataaagtgcctaaaacaatgcctgtaaatggtaatttctattaggatggatcatagatttaggattagaatttacactaaacctaccttattcatagatttgtccagaatcatagcaggaaatctactccataaagtagctctagcctctggtgcctagtagaggtgatgtattaggatagtactttaaaacttttaccccaattaagagcagaggaaaatgaatggctagattagccatcctgagggtttaatctgaaatggtccatagaagacatatcattttctttctgaaaaacttatttcaactttgcattcaaatataaatatatatttcaatataggtatttcttcccctcattaaaaagtctttaaaattgttgttccaggaagatgagtagtatttatcttgtaacattgagttattatacccaggcgcactaccaggaacacttctgatgtacaagtgccttcaataattgtttcagaagcacaattttgagataagttaaagtgccctgggaaagagcattgtttatttttggagccttagcccaaaatgactcggactcatgctacaaaatgataacgctcttcatcagttgtatagagctccttctttatggccagctttcctagagatattttagacttctttagatgtccccaaaggcacaataaccacgtaagaagggaagccacaggaaggcagattgcagcagaaaatgaatggtcagggttctctaggggtggctgcactgcctccagtggtggtgagttctccacctccagagagtgagacacccttgactcaagttttagatgagagaaacaatcaagcagcctctgaagttccccttgaattcaaattctttgcatccagaagagaagtattttgtgaccagaaagatacagattgactgcaattgaccttttctatgccagaccattggttaactgaagagagtagactctccagacaggcagtggactcagcctacaccaaaacacacagcaagccttctgtgcctttccccaggacagtgactcttcttttctctctgaagctgtggttctatgtaggaaactacatagggtgaagctaaaaggtaggatgggccagcctatgtagggtaaggctttttaactctatcgcatgggcagtgtgctgacattgcatactttttcagcacctcttcagatcggtatataaagtagattaacctgacagcagatggcggttggttggaggggcctgcagtaaaggagagcagtttggagaatgccacggcatgcagacgcacactgtggagctgagcactcagtcggtgatgtggctcactcaccaggggaaggacagaggtgagatagggcaagagtcagttgctgaagtcactactccaaagggctagatagaaaggtagggaggaggaatggagagccagaaaaggagccaaaatgattagctattttactagagcaggtctgtcctaaaggcttggctgccattctctagctgggaccttgacgaatcacttcctccctagtgcctcagttttcttgtcttcaaaatgaggatgatgctacctatcctgaagggttattgtgaggattaaatgagatgatggggtgaaagtgatttgtaaactaggaagtctatcatgcaaaccgcatgatagacttcggatagaggcagcaggtatacctttcagctttctgtcttgccaaatgaacatttgtatcctctcacctggtgtccaagatgaaggtgctggttcagtgagataactcttatccagcctaatctcaagacttcctttcatgctctctctctcacacctagcaataaatgccaaaagcctaatagccccccaaaccttgatcgtttcaagaggatcctttcaaaggaaacctgcctttcctctctccttgaggagaaaccaaagcagtccagtgaataaaattcatatttttctcccaggctgattgaaatggctggccgtgggagcccagggcctttttgtaggactgttttatttatttattttattattattattattttttttttgagacagagtctcgctccgtcacccaggctggagtgcagtggcacaatcttggctcactgcaacctctgcctcctgggttcgagccattccggattcgagccattctcctgcctcagcctccccagtagctaggactacaggtgcctgccaccatgcctggctaatttttgtatttttagtagagttggggtttcaccatgttggccaggctggtcttgaactcctgacctcaggtgatccacctgcctcagcctcccaaagtgctgggattacaggagtgagccaccgtgcctagcctggacttttccaattaggctgtgccggggctgctgtgaaactgttttcctgtgaagacagtgattttctccttagggtggctgctgtcacacggcactgcccctttccttataatacttgatcacagacacagtaacatctgtgcctagatcacaagccatacttactcaggacgattttcctcttaaagcaccagggagggagaggcccttgtcagaattctcacgactgaatcattgccatgagctaatgtctccagttttatgagtcagtgctggcccaggcatcggttttgtaggtttaaaaaaaaaaaaaaaaagacatgggttagactcccctaatatcagtagcttgttcagggggaaagcaaactgagctatcatcagacagcagcattttagaaatcagatgtttggttcctctcctctgtaaggatatagaataagtggaagaatttcagaattaaaaataatagtaataaaagctctctgatttgtgcgtgtgttttgttttgcttctggcaaagaaggtaaaatggtgtgtttgggagatgaatgttcttgtaataggcaagatgtagcttgcaggagaacatctgcaacaaacccttattctgcatgagatacagccaagacctgtttgtgtgttagtgcctgttcaaacatgtctaatttttaaaatgatttataaagttttggaggaatcaccttaaaatgttatttcctcatataataggcatatacattcacagcgtggtggctaaactatacaccctgttggagtttgagcagtgccaatattgagctaagtgatataaaaatggttatcaatatgaagtagatagaaaagtattaggaatatctgcaatcattcgtgagtctaccgattaatccagcagcaggcaaaaataaattatgctttccacgtttttaaatgttcttggtagagaatttatgcaaagaataaaagggaaatacatggatatttgcttcaaaatacccagaggtattgctcaaaacttgattaaaaataaaataacagaattggggatggacgtcaataagaaagaataagcttaaataatatcagtatctattaaacaacatgatttttaattgtgtcttctctattctttccctttatcatatatttacacataataggaaatgccttttaggaaagatagtggaagccttctcttttgtttttaacagccattgcttatgtagtgctaatgcatcttcttaaatccacgtgctttaaaaaaaataatattttatggtagtcatgtacttctcaacacatcatttggaaagaaagttaggggtatgcgctgtaatttgtacccagtattcagagtttacaagaaagattgctcttccctgcagcctctccacccttccccctccttctctctctcccccacttgcttcttgctccttgtttctttctctgaagaaggacgtgagctacatggaggacagggcagaaaagggaagaaaaaaataggaaatggtgagaaaaatattaaggacatttaaaacttaaagttttatggttctttttagctaaatgaatcttttgagcttccatgggggaaattagtgtaattaaaattttctagttcataaaaccaaatctttacatactgactgagcccactgtaagtattgactaaggcaaggacaaatgttatcctctgacttggaaaattcaaaagaagcattttgtctcttaaatgaaggtaggttgattatatttgatgagcttcttggaaaaggcattgattagtccacatccagaaatttaacttcccttttgcttatactacttgaaaaatgattttatggacaccgtgatgtaaacaatgagtctctctaggaagggatactgtgtatattttttgttttatttttaactttctggcattccaagacacatacagtttttatttgagggaaatattcgtaaaatagaatacgaaggaactattccaaagtcaggagttgagtgaaatatcccaattaaaaaactgaaaggattgtttatcagtaagttgcaggatatgtgtagagctccacaacatgaaaattcagtattaataattttggcttgaaatattttcagttctatctccttataagcttcagaattactaaccaccgaaactggtgtaactaagaggacgcatagcatgagtctcataggatctctccaactggtgccttgtaattttgtatggtatgcatgtgcacacatgtcccaagatgcgtttgttgaggcttagttgaaggccccatactatgaggtctcaaatgttagagttcactgaacagcacctttagtttcaacatgcattttctaagcactggaaggtacacattgaagaaaaacagatataactccacagttgactagctgggttgactaggcaagtgacctgatgcttctgagactcaattttctcttctgtgaggtgaaaataatctccattgaaggcttttgaaagttcaatatatgaagcccataatatagttcctgccactgagcagggccttgataaattgtgctagttattattaaggctagacactattgggtaattatattaatagataagttagccctttctcaaagagctcacagtcaagaagggcaaactgataaacctagttgtaatttagtgtgacaggtgctataatctgtctggaatgttcccctagccaccaccacctctgtctgccatgcagactcctacttattctttaaaactcattggaagcattaattgtagatgaacacttgccttgtgatacccaccccccaccagctcccccttacagacacgtactcaggagttcagaggcagtagctttgacctttcatctctgggtcttagtgctggcacatataatgggtcttaacaaatatttttcaggtaatacctattacctaaacaaagtggaatgtagtacagaaaactgattttgctagtttcacagaaaactttgcatttaaagttgggccttcaaggataagcaaagtcttgggaaaaataagaatagatattccaggtagagggaccagggtaagtaaaggcatggagacatgaatgtgttatgtaagtctaggagtgggaagcagtttggtatacctggaccatagaaagtttgcaggaacaggagtagcaggaaatgaggctagagagaagtccacagagccagattgagatgggctgtgaataccaccctaaggagtttggctctagtcctgcaagtgttaagaaaacatggaagggctgtgagttgggagatgacatcatgttctgttggaggaagctaactggcagcagtttggaggtagggagactaaaagcagggaggctaattggaaaggtgttgcaatattttagataagagatatgggggccaggtgcaatggctcatgcctgtaatcccagcactttgggaggccgaggctggtggatcacctgaggtctggagttcaagaccagcctggctgatatgatgaaaccctttctctactaaaaatacaaaaattagctgggctaggtggtgggcgcctgtagtcccagctactcgggaagccgaggcaggataattgcttgaacccaggaggcagaggttgcagtgagctgagatcgtgccgctgtgctccagcctgggcaacagagcgagactccatctcaaaacaagcaaaaaaaaaaaaaagagagagagatacggagatatgggcaggcaaaggggaaaggaggtgagtgtggggtttggggtggttttgcagtatatattttagagatagaaacctattttccgtaattgggattattttgactcctaccattgtaacattttctagacattggttttagaggtacttcttataaggactgtaccaagaaactagttgaatgatatattcctcaaggtttggggcctttttggtgccatgctttgctttctttagttaggattagtcttggctatttatccttctgctttgactatgagaagaaccacatacctgtaattggtcagacaaaagaacattttatattctctatgtctctgccttgcactagaaatgtttgggtaaaaaatttattggtttaagaaggaagaaatgtgcccaaatagccaatgattggcttgatggctttggctaggccgttttgctgctttgagcttcagttttcttatctgtaaaagaaacatattgagctaaatcttgatatctttttcctatttcttaacgtggtatggaagttaacactttcgtccttttactgaatgaaaataatctaatagtagcttaaagaaaacggaagcatctttcacttcagtgttttgagcgtaatgaaatgaatgctattattataaatagcagtaccattttacaaaatcagaagctaggaaaatgtatttggcctttgactcgtggttggtcctcagtgaatgttcagtgaatagaattataaaatctctttgttcttttttgctgagtactaaagaccataaatttattacagatgatatttactgataataaagtacttttatttttactggtacccaaagaaggattcaaaaatcttggcagataccatattaccaaatctaactataggagctggaccaagagagaagactctgtaaatcacctgtctacagacccaagacccaaccatcttaaaagaggattcaggaaatcatttaaatgtttcttcctgctttcatgccttgaacatgctgtttctgagcaatacactacagagattgccctaattgacactaaatatgagttttaagcatttattctgaaaactagacccatgtaaacaagttagcatccaactatcaattcttagaaaatctactttccctatatgtctactggattatttgtctcagatcttaggggaggaagtggaagagctggagaacagcacgtgttattttagagttataactggaagtatttggaatggcttctatgaaagtttatttcactgaaaatgtggaaacagctttggaactaaggaatgggcagagactagatttggaggagcagggtactaaaagcctagagtctggcgaggacttagaagagaaaaagattctggaaagtttggagctcttaaagaaaaataaaaatttacttcacttctaactatttggttggtgcaaaaataattgcaggttttgccattactttttcaccaactaacaaattcagtttcaaagatttctatactgctgacagtttttttcaaatattagcccttttaattatttcattaccagaccaatataaccttaatttttttcaaccaagataaacaatttttctgcagtaaatttgtatttatgttccagacacatctcatctgatatacaatattttcttaaattgtataaagagaaattattgtacatcggatgagctgtgtctgggattaagtattagctccactgtaaccttcattttcttgaacactggaaagaaaggccaacggtcatttagtagggttggaataggatggggaatggggctttggtgagagagcattggactgttggttatagaaacacagttcaagtatatctggagttcagatttgagatctgactaggagaatctgtctagtgaaaaaagctagacctttacaaattgtagtcaggagctaccgttgtaacagtctgccagagttcctgatacaaaagattgataatttgtgtgtttgaaaaacaaaacaaaacaaaacacatctaccttcaatttgacttactgcaactctgattttcatggcaagggatagagacaaaattcattctataaaatttgaaaaaaaatgtatatcctgaaaccattggaaattggatatcagcattaattttattggactgaaaaacctccagtttactaacaggagttgaaagtcatcacttttcctttcatcatagtgagttttcatcacaaaccacaatgatatgcttatctcaaatatattcatttacttgttttacacaagtatcatttctgtttacataacacgcaattttgttgctgctgctgttgttttattatgcctgtcacttgagtaaaagatggataaggtaaggtctccatttagaaatgtatagtctcttggcagggaagacaaataaaggcccataattatcataacagaaaaattaatatgtgacgcaagaaaaaataaagatactattaaatttctttgggactttgaaggaggaagggagcatatagacacttagtaaatattgtttgaagaagggaatgaatatgtaaagggagaataaacctcacctataaggtctagggcaatttaaacacaaaggagttgtgtaggattatttaaggtttgcaaatgtgtaaaattatctcactacaatactagggaaatggaaaaacaccaaagttcctctaccagcttttgctggatgagatgggccagaagtagtaactgcgagggcagcctgtatttctgttgttggtgtggtttatcttcccagtgccaatgctgccaacttcccctcaaataaaaacccataggggttcagagtctcatgaggtgagaacagacttgcactatctgtgacaacaacaaaagcacttataattttgatgtggaggatcctaattgaaatctgctgtttgaggttccttgggtcctgcattctttcttaaatatttctacttgagttggttattgatccttatttattttccgtctaatcgattgactttataaatctattgcagagggcagattaaataggcagacagttttctaatttgctgtgagggtatttcttaatttactttttaaatactgattttatttatacatttatatgcacaggtcattttcatttccatgatatcattcgagcttcacaaccacactccaagttcagtgttgttatcttcatcttcatgttgaggatgaggacacggaagctcacaggtaaagtgacaaaccccagtctttaggctactagatggtggagttcagactctgattttctggccaggtgctcatttgatgatagcagcatgaagctcttcccattctgcaccgtttgagctcctacccttcctaatcttctttctctaatacgagaacactgtaattaaagtggtatttggctgataagtagtaggttttgatttataacacatagagctggcagtgtaatttttgtcccagaacttgatgtgccatgaaagctattatgctctttttttttttttttttttttttttttttgagacggagtctcactctgtcacccaggctggagggcggtggcgtgatatctcggctcactgcaacctccgcctccagggttcaagtgattctcctgccccaacctcctgagtagctgggattataggcatgcaccaccactcccgcctaatttttgtatttgtagtagagacagggtttcaccatgttggtcaggctggtcttgaacgcctgacctcatcatccacctgccttggcctcccaaagtgctaggattacaggcatgatccaccacgcccagcactataatgcttttaatagagggaaatgaatcttcagatgatgtcagcatcctaattttttttctcctcttggggtttttctaaatgactggcaaatggaaaacctgaaagttacctgagacttctctgcatcgggcttgttggggtatactgttcttcttataatcaaccccagggactgacagatggacagttgttagagacaaagtcctcaatccaaggaggtcactcagggccaactttccttagtatatatcgttcattacattagttggttatattacctgtagtacaactcaagtacaatagctgcaggaggagacagctcgccagctaaacctaaaagttacaacagtgacatagcaagcaagggtaaaataaaaggctcttgacttattccttcattttttaataaagcatgaagtttgacataaattttaacctctggccgcatagtcagttatgcttattatcttgtgtgtattattatgctgtcaggagttggccactgatgaccaactccaaaatttagatgatagagataaaactggtagttaatatatgttgagtaccaggtcaaaaactccataagacactttacactgtgggaactggttcatgtaacagttctccaggatggaggattaatattcccatttcacagatgcagagttatgtgtctttctagacctgacaacacctgtcacctaccaaatgaatagagagctatgctataagtctagggatgagtgatccttggatgcagagcacttcctactagtattctgacttttactattatgcgtctgttactatttgacagctctcatttttgcctgtccaaatttaagcacgtttaatgagataaagagagcagaggcaaaggtgagactggatcttcccttgtatcttattgatagagagtaaatcgaatccaatttgctaaggccttctctctcctttcatgtttcctcactttgcctccaccaccatgaggttgaaaaatgagtttccatttagtttaagccttttgttattcattacttaattttgcttctatttccctcttctatctatgacaaattcagcacagtgaggggaagaaacagtgatgatagtgatggcctcaagaagaaaacagggtgactgagtaggagcaaataagtatctcagaccagcatataaacaagttcatttgtagtgtaaaagaacattatgcctttggcttgaaaactgcctttccaatttatgagcatgtttaggattatgtaagtacagtgtcttcataacaagcccaacacctcttacccaaagaatgcaaaacgctttgcaaacagtagaactcacaattcccctgtgacctggggacttatatgtattttcatgcattattttttatagattgagaagtgaacttgagacctaccaatctgtccacgttgacaaaatagatccaatactaaactcttaattccagcttcctgtcttcttagaagcagatcacactgaaagaggaatcttatgtcaagggtagcaattttctctctctcttttttttttttttaaagaaaacacaaattacatagtagatatatttgcataaaggtagatcttgaaaacatttaattaagacagcggtatctatttccaggaaaaaatagaaaagccagatctctactccactgaatttaaaaattagagcagcattttgcagttaaaaacgattattattttgcattctgccatttgtctttacatgaagaatgcctgaattcagaatggaaaatattttcttttgaaaagtgcataggaaagaattgttataaagcaaatgtgttcagaatgtatgtagatattaattataagtaaaagtaaaagaagtaggatgtatgtgagcgtatgtgcatttgtgttgcagataaaccgattttgaaggttgagagacatgacgatacttgttaggtatgagggagacaagaccagaggcgccgggaagcttgactaccgtggagagctcagttgagacttgtctttgcccatggcctgcagcgcttatgtagaaattggggatgcttttactcgttccaaagcctaacctgatcagacctgcccaggttggagtttgggaaaaaaagtgtttgaagtaaacaggaaaattactcaccttaatgatgtgtcttactggcactgacagtgctttgatagtctgacagtctttttttttaagttttgggaggaaagacaggggaaattattaatatgatttttggaaaacatagattcttatgcttatgcacttgctaataaggtggaaaaagtgggctttgcaccatttacagttatggactcgcgtttcctcctaataaagtctatatcaggaattttccattaggaatttctaccaaaaagaaaagaaaatacgttactgtttattttgtgtacttgtgccatgtatctccacaattgcgctgtggctgttcacacagaacagattcttcctagcacttgggctgtgggttcccaaacttgcaggtcgctttcatctgtctggtgattaagaccataaaccaagtggtgtgatgagagagtttggtgctctagacagagcaagcacacccttttttcataagaagcacaattcttaaatctctgcacctaaatctttccttaggatgggtcagttttttggaaaaagcaattatatatgttttgatattttgttgaaacataatagatgttgatttcatatggtttttttcctttttttttttttgtctttgctaaatgtcaaacggtacattttttctaagcttgaagacagagaactgggtcatatgtctctaaacatttaaatcttcactgagatagggaagagtgacctgatcttatggatcgtccgagtcctgtgagacaaaaatgctgggtttttcatgcagtccctaattcactttgaccttggtggagggagtcaaatctcctagtttgagatcccacacatataaagctctagagtttcaggattaaaatcttcttaactttatattctcagattctgtatagcttattaaactagatggagggtctagttatactgtctagaaggacatagatgaatagttatattttataaaaattaaactcctaatgataaaaggctaaatggggagagaataaattatagtttatgaaggcatgtaaaacaaaagatgtctgccaatttcctctctttggttctctgactgggaataactgtatcgtttttactttttttgtcctaactgtgtcctaattgtaaatgaatctggtgcccagtaaaatcaaatgaatagaaatacttaccatggtgtgtatataccagcctcctggtgtctcagatataattaacataatgaaagcattgcaatacattcttaccgaaggctcagttcctgtcctgtcagcaactgtttgcctacaactaaagcaagtctgggttcaaagcattttaaaatgttccaaaaaagtggggaaggcggctgggtgcagtggctcacacctgtaatcccagcactttgggagaccgaggcaggtggtcaggagttcgagaacagcctggccaacatagtgaaaccccatctctactaaaaatacaaaaaattaactggccatggtggcaggtgcctgtaatcccagctacttaggaggctgaggtaggagaatcacttgaactcaggaggcagaggttgcagtgagccaagatcgtgccattgcactccagcctgggccacagtgcgagactccatctcaaaataataataataataataataataataataataataataataataataataatgtaaagtggggaaggcaagatttggctcacgcgtcagacttcctatcaatgggtctatctttgaagcaagtgctcagagtgtctattcctttgatcacacgggtagtggtttatttccatgagtatttgctgttttcaggagatttcactttgggttttgtccatattccacattcaggaaactgttaattttggaagaagagattgtttttacttggttcttctaaggaaattaatcaaatgtacacgtgcaacttaaaatcaaagaatccctgttttaagaggagtttttcttatttcaactggcaaacaatatgaaactgaatgtacccaaagtgttggaggtttacaaacatgatcagcacttgttaatgacaattttctcctaagaaaatggaatgctaccttctagcatggggacttgtaggcagtatttctgtgtttgctagccttggaaagtataactcttatagggttgggcaaagcaaagcgtttttgctttgtaacctgtagaaatgattacgtagtgtaatttggttatttaatataatttgttaataattctcattcatctaccagaaacttaaaacttggtactatcctgctaatttggttttggtaatgtctcttttccctaattttaatatccctgttccttggcaaacccatccatacacctacctgttgttcaactggtgtgataagccccatcagtgctcctagacattttcttttcctactcttcctcttcagtgtcaggcagaaggatctttctaacactcgcctcagttcatggattgctgatggtccattgttggtgactgcatgatgacctgtaagcatgtcacactctgaccaaagtgtttgtatttggcccaattccccacggctaataataatccctttctgtttggaaaatgtcttatatttttcaaaacacacacatatatgtattatcacatttaatcctcataacaaacctgtcacattggcaggtgttattctcacttctcacatgcaaagttatgtaacctttcttgagattatacctcagtttggaaagtaggggaatgagccttctgcctctgtgagtaccgtgttcttcacggtgtacgatgcttccaaatatatactcttcccaacaggcagaggtggtgtttcgcagtcaacaaaagatgatttttgttttgttttcccttctgcatgccctgtctcctgctacttcctctgttcaaaacattttttttttctctctctctctctcctctcactgctgcctaccaaaattatgtcacataatttggctatttaatgtaatttggttaataatcctcatctatctaccagaaacttaagagttgttatcatcctggcaatctaccttgaagattggcaaaatgttagttaactattgaatatagatgatgagcatatggaattaaatttgaaatttccaatttcaggttccaaaaatccaatttcaaattaagaaattttaaatttaaatcttaaattaagaaatttaagaaacttcttaaaatttttacttatcctttctagctagagttgccagatttagcaaataaaaaccaaggatgtcagttaaatgtgaatttcaaataaaccatgaaaaaatgtttagcataagggaatcccatgcaatagttattacttttgttttattttgttttgttttcttgagacagagtctccttctgtcacccaggctgaagtgcagtggtgcaatcatggctcactgtggccactacctctcaggctcaatcagtcctcccacttcagcttcctgatggctaatttatgtattttttttttctttagggacaggggttttgccatgtttcccaggctggtctggaactcctgggcttaagcaatcctcccgtcttggcctcccaaagtgctgggactacatgcatgagccattgtgcctggccaatattccttacttatgctgaaaaatttcattgcttttacaattaaattttaattaggctggagattatctggtaaccccattcccagctcaatcaccaactctctaagcagaaggaaatttttcatctctcttgccatagtgaggtcaggattagtgaggtgacaagattaaatatgagctaagctatgacacttgttttccacagtttcctgagcccccctccctccttttctctttcttccttcttacctcccttcctctctcctatttattcttcctacctttttgttgttgctgtgagtgtcttcacctgtttccttccttcctttatattcctggtaatgtttcaaatttattggcatgggcagcttctcataataggtttgtttttattatttttcttgttattactaaaacatgttaatagatagattctaactctatggcacaactaagacagttgtgttacattcttttccgtgttggggctaattagaatattaagtttacaaagaatgcagaaaaagcgaacaagatgaagcacgtttccgtcttaaacaaatgaactctaaagaaataggaagtaacatgatgacaagcttttaagagatgttgcaagtagaggaaagggtttgtttaaatctctccccaagcaccccctacacctacccccagccaacacagatgcttatgtattagtggcccacacggtacctaattatcaacgatggaaatagatgtctcaaaattgtttcaattatccaggggttcccttaaaaaaggagaggagagcaaaagtttaaaacttggcttgaaggtattaaagagcaaatctgatctaattgattaagttacacctttcctttttggcagtatcttaatacccctaggatctcagtatttcagcatattggtttcctgtacttatctagaataaagaaactcagcaatttgcctataggatagtagagccttgaactaaatttatctcattattgttcacttgaaaccttggggacagctgtagttgaagggaccttaaagtcccttaaacttctcagcatttgcaggttcacttttaaggtgcactaaaaagcaactagtatcctaagctaaaaaaaaaaaaaaaaaaaaaaaagaaaaagaaaaagtagatttaagtataccaatgagcatggactctgtttatgttttgaaatccatttgctactcattttcctcgtttttaaatcctattatatttacacctgggcatccatttctctgaagagagaagaatgaaggatctaaaatgtcagaataacagtgattctcaacaattattgtcggcactctttcatgaagagatttaaagctctttgcttatctgacttaattcctgccggaaggacagtacagagggattacggtttaaatattgcagttagaagcacaaagtggaacctggacttccccgaccttggaagaaaaatagtaaagtgtggttcctataaaatattataggaacttcagacatagaatggagcatccatttatagtgatttaagttccagtattgaaacaggccttctatttttatttcaatctccctcccctttattttctttgttttgtgattcaccccaaaacgtatcttcttatacggtaatattaactagtaccttagtcaaagattgatctccagaagtttgtttaggaaattccttgtgttacttgtctagcagttaaactgcctagtggaaacaacagctcagctaaatagtgtgatgcaatcgtgatagctgctgttcatcaggcatttaccctggaccaagcactgtaccctgaatatcatgtggctttttctccacactcaggacaagcttgcagtgggcagtagtattatctcagccttgaaatgagtcacacaaggttttgcagcagagagaactgtcctctttttcagccctgtacaggggaggagcaagggtgctgcagtgaggggatctggagttgaatctggcttagtagctgtgaaagattgggcaacttatttcacgtttaggagtttcaatttacttaactggcaaatggaataacaatgtctacttcacagcttactgcgatgatcatataagacataaagaacttagcgaagtgcctagactgtagatcacagtacgtgttagctttttgtgttttatacatcaagcgtaagtcttattttttacatctgtcatattaccctttccccagtattcagagtatttgagtgtatacgtacgggtggtaagtgttgtttttcattgaaagtgcagatcctaactttttttttcatgcagtaatcctcaaaaaggtagacgtctaccataattcagtctattgctccaattggaggatgtacagttgttttaggagttaaggaattgagttttttcttttttgcttttcgtcttttttttttttttttttttttttttttacaaattcttttattcttttcttctccaaattcaggcaaacagtattaaacactttgttttaaaaatagattgtgtacgtgtgtgtgtgtgtttatgagagagacagagagagagatgggagagggtgagaatacacagtaaggacttggaacatattctttgtgtgaaatgttaaaaaattgttcacggtggctgggtgcggtggctcacgcctataattccagcactttgggaggctgaggtgggtggatcacgaggtcagaagttcaagaccagcctggctaagatggtgaaacccgtgtctactaaaaatacaaaaattagccgggtgtagtggcaggcacctgtaatcccagctactcgggagcctgaggcagagaattgcttgaacccgggaggcagaggttgcagtgagccgagatcatgccactgcactccagcctgggcgacagagcaagactcagtctccaaaaaaaaaaaaaaaaaaaaacaactattcaaggtttcccaataaccttcttgggctttgaagctagagagcgctttggaattcatgctccattatatgtgtgtcttaatgctatatactgttgtaggtcagcaatatttatatacataagtttatatatatgtatatatagatcttttgtaaatagagggtggatactttgtccccaccttttcccatcctagcatgcagtataatgatttgaacacggcaaggacaccacaaaggcacaggaagacatcctgcaatgtacatatagtatgtgccttatgtacagtaagggccctgaatttaaagttaaaacctagattggagaattctaactttgtgttatcgtgagcaaagtagtttacttaagtctctgattctgattcttccttgacagaaagggaatacaggtgactttcttatagagttagctgaggattaaattaatagctgtatgaaaatgctctataaactgttaaggactatacagatgggtgagtgatggtgtcatttatggaaatcagtagatgccattactctccatactgtcgatacatagtctcccatttcttcttatcagactggcctacctagtcttccggtaaaaagaatatcccgcagatacaaattaccattactggaacagaggactcacttttagagcagatgtacaaatgaaactccaaaacaagccacaaatctaccaggaaagagaaccaatatgtgtggtattatatcgccaaggatacctgagtcatttcatagaaattgagctgtgagtgcctcccagaatgaatggtttctgaacgtgtttctgttaggaatgatgcaaccttcagtagagaccagagatttaagaattctatactgtgagtcattttaaaagacaatcaaagagtatgtgtggaagcatagacaataactttcacctctagcgtccaggtgttgaaggaggtcagctaccagggaaggactcctacgactttgggtgccactgcgtgaggctttgtcttggaccagggggtaaaacatatctcaggcaggacgctgagctctaggtagggctatcgtttttgtagaagcgtgacttcttgatacaacaaagtaagagctgaggaaggaacagggaaaaccagtttgggcccagaggggaaagaaatgatagtgtagtagcccgcggttttgcaggcagttgggagtagcaagccacccttagggggaggataatgttttctctaccttaagggaaaatgatagctgacttgcagagcagtgtgctgagacagacatgctgctactgcagtggaagggggttgcaacgtattgtcttctgtctggagagagagagagagagagcgcgtgtatgtcacgtctgtgtccataaagctctccgatctgcccaccaaccctgtcccccaccaataacatcttaaagagaagaggtacaggaatgttttacagtgaaaagattacagggctggaaattagaagccacaagttctaattatgtctcattgctaacttctggtgtgatattttctctgggtctctcatttatcggggagttaaactaggtatgtccagtaggggtgaggggtaagagttctctgcccatccagggtttctactagaagaattttgactctacagataattgtgtcttcctgtattgctgaggaatgtccaggtttgttttattgaggggcaggggagcacatagatgtccagtagtcaggaaggtggtttgcaggcctttaatcagcactgagaagagggaaaactaactgcagttcagttctcagttccaccattcactggagtgctgctttcaacttttgagctcctgtttctacacctctaacgtatcagtgtcatctcaccctggcctttttctcatgatggtcgtgactttaggaaacatgtaagagtaagccgaccttaacacgagtacctgctgtatgacagtcactctgacaaatgcctcccagtgtctgctctgtgaaggtaactgtgaatgatattactggtcaggtggggttgacagaggtggccctggcaggagacactaaatgaaaggtcattttaccctcctggggagataaagttgcaaaattaccgatcaagtctgtcaaatctttttagactgggtttccaaatccataccctcaggcaactagaacaaggctggcgagctccacccccgccccttcccaaggtgggtgccaacatgctgcccttcagcagggaggacacagctgcctctggggccagtgcccagggctagccacaaagctggctatggcctccccaagaagacccaggacacattactccctgcagaggttttgctgctttgtggcacggtctaagtgtcgccccactcccaccacctgccaggcccagtgggctcctggctggtcctcacggtaagtgagtagcagacagcccacctgcttgatgtcaacatttgtgggcgcggcccgggaagaatgtgccgctcccagcctccttggctcaggtaattaatccccgcaactgacaggtggcaacaggcggccctttggctggagccatcaggaaaagtgcttggaggaaggatttttttaaaaaaatgatcaagagcacaattcgtacatgtctggcagctagacggctgtggcaggaagggaggcagggagaagtaaataccttgccaagacgactgtggggccaatgttgggatctgcgtctgcctgatcattgtgatagatccaaaaggatatggtggccttggacttgtttgcaagctcactttgcagaattccccttcctttgatgtggatacagtcttaaaatggaatgcctcatttgtgaatcaaaaaatccggggccaaagttggagccccagaggagaaataatttgcccaagatgatgcagtaagtcagtgggcaggtagaggactagaagccaaactcaatgcctcttggctttgtttccatgattcactgggcaatatttactgccccattatacacatgtagtttagaaatagaatgacaaaactggggtcctagtcaaaggaaggatgatcagttgcctcttgaaagatattagtgttttcaatctaaccacttaaagctgacttctcaagagaatgcccccaccccaaccccagaccacctgtacccattcaccccccctactttttatttttggtagttcgggacactgactatcagaacacattgacctgatgtttattaggatggatatattaaaagccattgaaatgaacacttttcctttttcttttttttttttctttgagacagagtctcgccttgtctcccaggctggagtgcaatggcatgatctcagctcactgcaacctccacctcctgggttcaagtggttctcctttctcagcctcccaagtaggtgggattacaggcacgcgccaccacgcccagctaatttttggcacgacctcagctcactgcaacctccgccttctggattcaagcgattctcctttctcagcctcccaagtaggtgggattacagacatgtgacaccacacccagctaatttttgtatttttagtagagatggggtttcactatgttgtccaggctggtctcaaactcctgacctgaggtgatctgactcggcctcctgaaatgctgggattacgggggtgaaccactgcacccggccaacactttttaaacattacattttttaaaaaataatatctttctcgatatgaaatttaaaatgtttttcaagtgagtttttttgtagaggacaaatccaaagtatagtatataattagcccatataacttcatgtgataatcagtgtctttgaagcagaccaaactgaagctgtgtctcagcgctaagggtctttttacattttactgaattggatctttagaattaatttttcaaaccctccttatcaaaagttattgttggaccctcaaatttttattttcatgtatctcatttctcttccctaaatcttgcctcccaccagattagctgccagaactttatctggttctctggcaaccctccatctgttttgtatgatttttcattcccagcagttctaattattgatttcatcaccctcttacccttataaaaggacatttttaatttggcagtcccaaggaatatagcttataaaaagaaaaaaaattaagtcactgaatgttttaggagagcactaagttaagacagactttgtacttgattaacggaattgttctgagagctttagagcttgacttttttttcttcctgtcaagtattttgggttatttgagatagtacagacaacactttacctcttaagttttttgaactagaagccataaattagaagtgcacctggcatttcctgtttgtgactagtggctatcttttagataacagtgaagtcctcaatgtccttgataggttcttggtaaactgcgaccttaaacaaaatgatgtgcaggagatcttcgagtaattgtttcatacaatgttattttcttataacagtgatgagaaaaacaaattgttttgttatatgtgttttgcttaaagttacagttcccaaaaatctatcaaaaatgttaaatgaggattcattgtatttgtaaatctcattatttttctctcttttttaaagaaactaaattcaaattcattcagaaagccaggcataaagtgagactaatatgttcgttggtgtatttaagcctttcttagagttttcttttttttaagacctcagtataagaacatgccagacgtgaattgatctggaattgcagactcgggagggctttgatgctactctatctagttgccttccttgaagagggattgagaagagaggtaggttatagaattaatgatttttttttgttccgtgagagtttatttcatccatagtctctaagatttagggctcaagatagccatgtgatttgagatttgcatgtagtatggcatttcttctgggagaggatgaaagagctaaagttcttgttttttggttttggtgtagtaggcagggagggttttgattctacctttaggaaagggaggtgttgaaaaattacgcaggtgtgtgctgatattacctggcacctctatgcattgtgatactgaattaccagtctgccagccaaaagcgtgtaatatagtatgtctactgaggcaggtggtaaaggtagggtcctagtcactggaattctttttttttcccccttctctttgcaacatattattagtaaaggagctgaatttacttgttttccaaaatcccctggagttgttttatttgaacatgatatttggctttaagcagctcacccctcgatattccaaacttcctcccctccctcccaaagcaaaacaaaatttaggcaaagcttacttatccattttgacaaggatattttataaaaagaaggagtttagttcatttgttagttttcaggaacttcttttccatgtcattgttgaaatatttagttcatgtggatggccaaaactgtcatgtcagtatacaaggaaatttggttgaagatcagtacaatattaggctcatcattcttgcccatgggctggtgcttcctgggaatgaacaaactattgaatatatgtacagtatgtatacagaagaacatatattaagttctactttatatatttatacatatatgatcagaaatggccagtagggtgtgtgtgtgtgtgtgtgtgtgtgtgtgtgtgtcatcagaaagattaccaacactttgttttccacattcttttttttttttttttttttttttgagacagtctcactctattgcccaggctgtagtgcaatggtgtgatcttgactcactgcaacctctgcctcctgggttcaagcaattctcctgcctcagacttctgagtagcagagattacaggtgtgcatcaccacacctaatttttatatttttagtagagatggggtttcaccatgttgtccaggctggtctcgaactgctgaccttgtgatccacccacctcggcctcccaaaatgctgggattacaggcatgagccaccacgcttggccttccacattctttattaaagagtcactttgccagtgcaaatctggtaactgcgttctctaagagatttgcaccaaattataaaataatcaaatgaggccggacacagtgtctcacgcctataatcccagcacttctggagattgaggcgggcggatcacctgaggtcaggagtttgagaccagcctggtcaacatggtgaaaccccgtctttacccaaaatacaaaaattagctaggtgtggtggcgggcgcctgtaatcccagctactcaggaggctgaggcaggagagtcgctagaaccttggaggcagaggttgcagtgagctgagattgcaccattgcactccagcctgggtgacagagcgaagctcagtcttagaataacaaaaataatcatcatcatcatcatcattatcatcaaatggaagtaacactatacattatctattttcccctctatgaatgattagctcaagatttggggggatcatgtaagttgccagttatttctcagtgagtgtcagatatttatgacttctttgaagaggccaatcgtttttgaaaattatttcagatgtgctttatttccccccacccatcacagtattttatttctgatttcacttagatttgcataatgcaaagagccacagttgcactgggggtcctttctaaataggcaacgaggttagtgcaacccactgctgacttattgaacccaggacctgatggagtagagttgattcttaaagcaatgagtgggcattttgtgttgtttttatgttcaagctcccattgtgagaatatggttacactttagggaagaaaacctcaactcttagacaaacttctttgcttaactaaaaataagtatatatactcctgtaagaatttggtgatcatatttttatttttgttagtaagatggcctctgagctttacacttgattgtctaatcatatattttctaatcatgtgtttattcactcaaattcactctggcacgaatacaccagttccactttggcctcatactataactgttaaaactgtgtgggacgtggggaagaacactggtctgtatgtcaagatggtcccagttactgagaacttttgagcaaatctcttctcctttctggggcttagattcctcatcggcgaataaagtggctgaaccaaatgatctttaactttgaattttcctgatctaacttttccttttccttttcctccctctgcctcctcctcctcctcctccttctctctctctctctctctctctctctctctgttgcctaggctggagtgcactggtctgaggatggctcactgtaacctcaacctgctgcactcaagtgatcctctgcacctcagcctcctacagatgcccccatacctggcttttttttttttaattttgtataggcagagtcttcttgtattgcccagactggtctcaaattcttgggttcaagcaatactcctgcctagacctcccaaaatgctgggatgacaggcatgagccactgaacttggcccctgatctaatgttctaaaaaaatcttagcaaatgtgtgttaaactaaaaatgctttgaaatgggatgactcagtaatagaaacatagaaccaagcccttgctttaagatgtcaagttggatttctacagaaattctgtaattagaatataatattgtagtaaaagcattatcttcatagaactaaggaaatctgagttcacttcttcattacccaaatttagttgtgcaacctttagaaatcattttatcagggatgcactcctgaccctctgtgatatcatgaaatacgtatttggactttgtccaagtttcttggcatataactcctaaaatccttggaatttccaaaatgctgccttttttgtatgctaatgctggctcatgggttcagaatgggggtctggtcactggaaaggcaaaggcacaattagagagtcagccccaccccccagcctccaggaaggagagagaggctgaaggttaagttgatcaccacttgccaatggtttaatcaatcatggctagataatgaaaccttcataaaaacccaaaaggacaggtttcagcaaggttcaagatagtaaaacatgtggagagttttagaggttgaagcccagggagggcatggaaactctgcacctctccccccataccactccctagatgtctcttcatcttcatcctctgcaacatcctttataataaaccagtaaatgtgtttccttgaattctgtaagctgctccagcaaattaatcaaacccaaattggggtcatggaaaacccaatttgaagctggttggtcagaagttccagaggtctggatttgctcctggttgtgtgtggagtcttgggaactgagtcttcaacctgtgcgatatgacagatctccgggtagacagtgtcacagttgaattggaggacacccagcttggtgtctgctgcttggtgagtggtgaaaaactcccacacatttggccacagaagtcatcttctgtgttgatgattgttgctgtggtaatgtgagaggagaggaaaaaacacagtttgagcatttcccaaaacatcctccaagctaaatagacccccatgttttaccttctctccttttgcttttttttcaagacatgtgtcacaattttagaaattattttttttaatgtcagtacttcctttggatcaactcccttagtgtaaggtttaccgttggttccctaatagccaggacaaggactggcatgaagcgcgtgctcaataaatatttgctgaattaataagcttcacctctttaagtctcagttttatatcagaaaattaggagaagaaggtttggacaagaggtgctataatgttccttctgagttctaacatcttctgtattctctgtcttctaaaatcataggtctgtaacaagtttacaggttggtgctactcataataatttatgtattaaacattttaagtgagaaatatttcaaggtcaggtgtggtggctcatgccctataatccgagtactttgacaggctgaggtgggtggatcacacttgaggtcaggagtttgagaccagcctgaccaacatggcagaacgctgtctctactaaaaatacaaaaattagccagaagtggtggcactcgcctgtagtcccagctgtttgggaggctgaggcaggtgaattgcttgaacccaggaggtgggtgttgcagggagccaagatcataccacttccctccagcctgggcaacagagtgagactccatccccccgtaccccttcccccaccgccaccaccaaaaaaagaattatttctaacgtaaaaaaagtaagtaaattaagacatctgagtataagacaaaatgttaacatttttccatattgcttcaaatcttttccttaaataaaatataaagcaaaaagtactcctccattctatctcatttcccttctttcagccattaaaatgaataaaatatacctgtatataagaacatggataaatctgggaagcatgggaattgaaaatagattactaaggctaaatgtaggatgatgtaaattaaattttaaggacacggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaaataaaaaaaattttaaggacacgcaaaattatattacatatatttatggatgtgtattaaaaatgtatgggagtaaataaaattctttttttataaatgaatctagtaatttgaaatggttaagaacttaatgattattaatagataaatatgaattgtgtgatttattttaaatggttaacattcaaactttagcagacttttactatgtcaacaaacactttctcaccaggttgagatacagttttcacagtgctgtcttaaaattacttaagctatgttaaacactttatgtggagaatcttagaaatatgaggcttcagtcataattgttatacatgacttttattttgatctttgcagttgagtaagaattttttaatctattttttctttcaccttaagagatgtgaactataattttttccattttatatgtgtaatggtgaagtggccaaaatgtgggttagatgttattgtatttcaaagcgagcttgggaaggggcgcaaagcagtctgcctttaaatgtgttatttccagccaggcgcggtggctcacactcgtaatcccagcactttgggaggccgaggcaggtagatcgcttgagcccaaagagtgagagaccagcctgggcaacatgggggaaaccccgtctctgctgaagaaaaagaaaaatagaaaaaaaaattaaccgggcgtagtggtgggcgcctgtaatcccagctactctggaggctgaggcaggagaatcacttgaacctgggaggcagaggttgccgtgagacaggatcgcgccactgcactccagcctgggtgacagagcgagactctgcctcaaaaataaataaataaaataaaatgtgttagttcccctttggagcagaaagaagtggacacttttataaggtaaggagggaagtgaacaagggcaggcggtccccctgctagcttggtgcctcatctacctgatagttgagttggcaccaacccgggcagaaataagttgtgaaaatggccaagcaggcagacttaagatatgcccttctgatgggtgaaagtcccaaggccaccccgtgaaggtgaaagttccatggcaggtgttctctggtttgcaaatggactatcagctctccaggagagatttgtcttggagcacacagttagaacttaccctgcagggagtatctggtgaggaggacgtgaagggttatatttgcatttctgaagggctaagtaggaaacagggaacgggaggaaaggggacaggataagagaaaataataaaaataatagtaactcattcctcttttcttagaagaaatgggagtactcagttaagactacatgaaggcagagggagggaataaaaagaggaggcagaatttaaataggattttttaactcctagtccaataaataaatgatgcccacagttgttggtgttggacaagagtctgttttctgttgcttttagatctgagaactgagccctctccttcacaacaaaattggcctattaattccagtgttacttcatgtaatttttttatttgtccagaactaaaactatcctttctctattgtcgacaattccattggctaagccaggtttcaattgtctgctgaatatcaggagctctgtgttaaaattaactcattcattctgctttgattttagaaaacagataaacaactgatagtatttttgcaagcatcttttgttctaaagcataatatgtattggtctgttttggtacttccatgtatgtatttcatgttaaaaccaagaaggctgaatttagtaaatccaaagagtttcccccatcattttcccttttcattcatttctactgccctaggttgggccttcctcatttcttgtctgaatagctcctgatgggtttccccaattttactttgcttgttcccaccacctttgtatttctgaatacaaagaactgattaggtctttcccctaccttataatcctcagtgacacctctttgcctgctcatagtagttaacggtatcttgtgacatccaaggctcctcagaatctggtaagtgcctttctagctcagcctcattgacttctgctcggctactcctcctccttcccccatcccatctatatttcatccacagttaacatccccttgcttttactgatgatattctgtcttcatggaaagcctactgttgtctcctggctttttcttcctttctttcttgggtgcacaatccaattggtgaataataacttcttttttaaggcctagtttaaatatcactacctctatgaaaattgtcttttctattttaattttctctttcttatcccagccagttcatcagctaatctggtgacttctcatcacctctactgctggtctaagccactctcatcttacacttggattattggcaggagccccctgactggtcttcctgcttccgtctttgttccacaaagtctgtccttcacataacagctacagtagtcttatagaaataaaaatcagaccacatcagttgctcaagcccctctagtggcttcctatctcacacgaaaaaagctcaagacccgtcctgctctacaaggccttgcgtgatctgggctccctattatctctgatcttggatcttaactcctaccactgcaggctttgcttacttttctgcaggtgcactggcctccatggcaagcatacccagccaggactttagcacttgctgtctctagtacttggaacactatctctccaggtatatatatggcccagctcattatttcctccagacttttttctttaatatcatcttattgaagaattctttcctaacaatcttggaaaaaataatatcctcttcacactcactcccctgactcttggctttttatactctatcccctttgaatttaccctgatttactttttcttatagcacttatcactatctgacatagtagttatttgtttattctagaattctagcatttttagggcatagactttgtctttgtttaatgctgaatttccaaaactaaaacagagccttggtaatagtatatgctcaataaaaatcaaatgtattacctagtagttaattgttctatctctgtaatcccataacacttgcagatggttcctttatacccagtgtattttggttgtttttgctgtactctgcctctagactgtgagcaacttgaggataaagatcgatttttttctttcaatttattttatatttcaagtaccatcctaggcagcatggatacataaaattctgcattccaggattttaaagtcttacttctatctgttcccagtacagaataaggacctagcattgtgcaatacatgctcagtaagagttggctagattaagtattgaatgttgtacaaatgagaagagctagctctcatttgtggtttatgatggcaactgactagcagcttttagtgtagtctctcctatgttgttgtttttatgtttgtttgtttgagatggacttttgcttttgttgtccaggccggagtgcaatggcgcaatctcagctcacggcgacccccgcctcctgagttcaagcaattctcctgcttcatcctcccgagtagctgggattacagacatgtgccaccacgcccagctaatttttttgtatttttagtagagacatggtttctccatgttggtcaggctggtctcaaactcctaacctcaggtggtccacccgtcttggcctcccaaagtgctgggatcacagatgtgagccactgcgcccggcctctcctaagtttgtattaaaatattaatattacaaattccagaaaaaattaaactaaattggacactcaagccattggcagaattttataataattttatgccctaaaagcctgataggatagaactgaaaaatgtcaaaatgaaatgaaagctgcaaacactagctgtggctatatcttgctatgttcatggaaaagtaaaaaagcgagaaagggcttatattaaaaacaaacaaaatcctatctataggggaacatcgttttaaatactcaagaaaatcaacttaggaactggaagaaatatttagaagattactttggtgcaaattaataagacagtaacactgtaaagttgggaagacatggcaaacctaaaattgcaggctgagatgtaaagaggactagtaaaaagggatgaagattaaataaggaaggacatttgaaatgcagcagaagaagtgaaagtattatttgtagtagaatagagcagaattaagtgtagaaaaccatacacatactgaagacaaatttaagaagctttcccaaaatgcaaacaataggaaaaactgcataaaatatatggcggatagaaagtggagatcctaaagtaagacttaacgtgtttctggaaactgatacgagcagaagaaacaaaaatacaattgaagaacaaaatgtattgaggtcaagcatgaaagttaaaaggacccaccaatttccaagtaacttccattttaaaaatcacatttagagacagtgccactttattttttaaaaaagataaacaaaattctacaagaaactatggaaaaataagcagcttacttaatttaaagaaataaaattcagattgaccttggacttttctacactgaaatgtacattgactcaattactctgttttaagagatctatctaaagccaatttatatactaaactgtgctatatggtgttatttttaactggagtaaaatttatacagaagtatactaaattatactattctactaaaaagttacaattaaataaataatggtatatccctttttaatactgtgacagccaccacttaaaatcatgttttaaaattagaacatgctcatgatatattaaattataaaaagaataccgtctttgtattatatgcccctagtttgtgtgtatatatgtgtgtgtgtgtgtatgtatgtatgtgtgtgtgtatgcacagaaaacggtcaacaatgttaataatggtatgtatctcttgagtaagcaagaaatcatttttttccagaattctgtgtgcacatgttttgacaatgatgaaatattaataaaaggcagattgtagaaaaagagaagttggggagacgttgacaaaagttttaaattttctgtaacggcttctcatagtgacaacactacagggcaaggtactttataccttcacatagaaggtttgaaatatttgctatccacccaaagagctgctggaaatttaatacaatgggctggcataatcaaaaaagttcttagctatagaagatattttttcaggtataaaatcaactgagtacttaatttaatgcctataagtaggagaaacctacatagagatataaggtaaccctgggaatagcaattaaaaaatctgtttagaatggtaaagaaatgtgtaaaggagaaaataagtttgagctagaaatggaacccgtgaaacaagcagaagacctagagaattaattttcttaggaatgtgagtaagtgttgtatttgatatactggttatgaggactgataaaagatttaaaagaaatgcttcacatatgactcagtattaagaattagatatatcaaaactttgtggacatagctaagaagtacctagaagaaacttggtagaattaaatgtttatattagaaaaaaacgtgaaagtctaaaatgaatgatatatgattctagttcaaaaaaatagcaaactcaaccctggtttgattattgcagtcacataaaaataaaaatttaaaggtatgcagatttgaaaggaagaagtaaaactgtccctgttcatagttgacatgatcatctatgtagatcgtaaggaaggcatctacaaaaagctacaagaactagtaagtttaccaaggtcataggctacatggtcattatacatgaattaattaggtataaatacatgacatagtataaaacgcattagaaacaaaaagaaattttcatttttaaaagtactgtttataacaattattttaaaataaaatactgaaggataaatctaacaaaataggtacagtatttatacactgaaaactataaaacatttctgagtaaaattaaagatactctgtttaaatggagagatatcatatgctcatggtttaaaagacaccacattgctaaggtatcagttctcccctaaaagaccttacatatttaacacaatctcatgcaaaaatcttaccaggcatttttatggaaattgtaaactgcatgtaaattttgtatggaaaaatcaaaggatataaaatagccagaacaatttttaaaaagaacaaaattgcaagaatcagactacctgatttcaagacttactataaagtagattaacccaaacaatttgaaattgatatatggatagacaaatagatcaataggaaagagggaagtattcagatacagacatgaacacatatgaccaattgattttcaataaagagtccaaggcagctcaacaagggaaaatatgcaggtaatcttttcaacaaatggtgttagaacaattggatatctgttaaaaagagaagaattataaacccttaactcacaccatatacaacaattgactgaaaatatagttctaaatggaagagctaagacaataaatctacttgaagaaaacatagaaaatcctcctaatgtcaggccaagatttcttaggatataaaaagcaagagctttcaagggaaaatattgataattaagtattttgggaaagcaggaaaaaagccaagctacaggctgggagaaagtatatttttaaatgtatatctgataaaagacttgtagccaaaatacataagggactcctaaaactcacattaaaaacaaaagcaacctaactgacaaattaccccaaatcgccaaaataacccaattaaaaaatggccaaaagaccggaatggatatttgtcaaaataggataagcatatgaaaaatgcccaatatcactaatcagggaaatgcaaatcaaactacaatgaaatactacttcatttagaatggctattaacaacaagataactgttagcgaggatgtggagagaagagaacctttacatactttcagtgggaatgtaaattagtacagccattatggaaaatagtatagaagttccttgaaaaattaaaaatataactaccatgtgatccagcaatctcactactaggcatttatccaaagggaataaaatcagtatgtcagagggatatcttcactcctgtttattgcagcactatttgcaatagccaagatatgcaatcaacctaagtgtccatcaaaggataaatggataagaaaatgttgtgtataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaagaaaatgttgtgtatatgcacagtagaatactattcagtcagaaaaacataatgaaatcctgaggttgggcatagtggctcatgcctgtaatcccagtactttgggaggctgagacaggaggatcacttaagcctaagagtttgagacaagcttgggcaaaatagtgagaccccatctctacaaaaaacatacaccaaaattagctgggcatagtagtgcgcacctgtagccctagctactcaggaggctgaaatgggagaattgcttgagtctgggaggtcgaggatgcagtgagccgtgatggtgccactgtactgcagcctgagtgacagagcaagaacctgtctcaaaaaataaaaaaagaaatcctgatcctgtcatttgcaacaacatggataaatctgaggacattatattaagtgaaataagccaggcacagaaagatgtaaccacaagatctcactcaaatggaatctaaaaatgttaatctcatagaagttgagagtagaataggggttaccagaggctgagaaggggacacggggtgaggggaaatggggaaaagatgggtcaatgggtacaatattacagttagacagaaggaataagttctgttctattgcacagtaggatgactatagttaacagtaatgtattgcatatttcaaaatagctagaagggaggattttgaatgttcttactacaaagaaatgataaatgtttaaggcgatggatatactacatatcctaatttgatcattatacaatatagacatgtatcaaaacatcacattttacctataaatatgtacaattcttttgtatcaatcataaaataaaacctaaaaagtgaaatttctgtgttacaaagggggagaacacagtctgtattacaatttttttaactcaaaaggtacaaaatatttgaacagatgcttcaaaaaatatcaaatagttgtatagaattacataagtttgtttttatttttattatatataaatatgaatgaaataagtacatgaaaagatgttaaacattattaatcatcagaggaatgttaatttaaaccacaatgagatctgcatacataccagaatgacatcaattaaaataacagctgacaataccaaatgctgacaaggatatgaagtcctcatatattgcaagtgacaatgtaaaatggcacaaccactttgtaaaactatttgggagtttgttagtaagcatacacttacccagcaatcatattcctaggtattcaagaaaaatggaaatgtacatcctcacaaaaatttgtacatgaacgttcataatagttttatacacaatagaaaaaaatggaaataattggtgagttgacaaataatgaagtgctattcaaaaatacaatggaatgctgatacgtgcaaaaaccacagataaatctcaaaagccttatcacataagattatatactatatttttccatttacataaaattctggaaaggtaaaactagtggaggaaacaggtacatgattgttgaggccaggagctagggaggggatgaactgcaaagaagcaaaagataattggaacaggaatggaaatattctatatcttgattgtagtagtagttgcacaacggtgtacatttgtcaagccatcagcttttgcacttaaaaactggtatactttgcggaaaagtataccacataaaacaaaacccccatacaaaaaagaataaattaggccttagaatgaaaagaatctcaagtcaatgttgaggagcaatttagacgtgaattttttaaattccacagagaaagaaagatagtaaaataagccatgtgtgttcaaatttacaatttctgctgacttgaatcatcagggtattttaaaatcttgctgtaaatcagattcccatgttccaatcttgcagaagccgggaaaattggagatgatggtgctattttgtaagggatacggaagtgggcaagtctaaggacttgtttatacacatagaccagggagactgaacttagtactgggtaaaaaaaataaaggtcatcatggaacagatttgcaaacaatgaagtaaacagaatagcagagatttggctttgtaaaaagaaaaaaaagcgattgtgccagaccacttcagcgcctctagttgctgaattgcaggactggtagttgaaccaaaagcaataaacataatgcatcttggctgtggtcagatattttgatttagtcaaatatgaagccctcaccactaaaattggaaaatatggtttgcagtacagatacagtactagctgaaaagtgatatctgaattgtcctggcatgacgtggagagcagaggaaaaagagaagtgtaccacactgggaatatcacttttgttgttgtagttgttgttgcttgcttgttgcttttaatttttttaggtttcagattcagtaggtacatgttcagtattgttacatgaatatattgtataatggtgaggtttgggtttctagtgtacctgtcacccaaacagtgaacattgtacccaataggtattttttaacccgcatcccctcctaccttcctcatttttggagtcctcagtgtccattatttccatctttatgtccatgtgtatccttttggggtttttgtggttttttttcgtatgtttagtagagactggatttctccatgttggccaggcatgtcttgagctcctgcctgcctcggcctcccaaagtgctgggattacaggcatgagccactgtgcccgaccacatgtgtcttcactacttatctcccacatataagtgaggacacatgatacttgattttctttttctgagttgtttcacttaggataatggccttcagctcaatccatgttgctgcaaaggacatgatttcagggaatagcattttgaattttgggtgatgatcctatggtgtgtttgaagcattaaaacgtttgtatgggtagaacatggggtgagaaatgtgtgtgggtgggggtggaggggtagggggaattagagatagataaggccataatacagagggcctcataaagtcctcaataaaccatgttaaagagcaagactgtatccttgaattcccagaagcagctggtgtaatcgtccaggctgtcttccacctagcccaaagttttttcaactctatcacttgctgcctctccctaccattaaatgagtaagcaatatactgagaaattaataaaactatgttaaatagaccacttttgagctccattttaatgcttggagaagagtcggtaagcattgtaattgattcagaaaagaaccacaatgttggaaactagaaaaaggtaaacatttgcatggctgagttaagagaacagagacataagaaactgttattacaggactaggatagactcatataccagttactaagcaggttcttgggcaagtcctttctgtacatttattttcttatttataaaatagggatgataattcaagtcaattatctgttatctacaattctgaagttccaagagctctgaaaatcagaagttggttcagttttattttgatttcttaagtttgtggcacactcatttgatggtgaaacccaggtttcgtagtcatttatcagttagtgtgaatatttatgaattctgcagaaataatgtttgatcttatggtgctaccctaaattctgctggatacattcatatgttatgcaaactactatttttctaaaatctaaacaattctggattctgaaaattctggcccctgtggtttcagataagagacagtatgcttgtaataccttcctcttagggttgtatcaggataaaatttcttaaggcagaactcagtaaacgatgaagctattattatttatcattaattaagcttaaaaattagattcccacccccatccccgagaatgaacaagaattagcacttgacgatccttaattttattcttaatgcttttatactgtactctctcgagcttgatttatagtatatcagttattaaaatggaatgttttccttaagaaacttctacgctgaacacttaaccttcatttctgcaatctttacatacttggaaggataccttatttgcctttaggtattagttgacagacttatttttcagtcatctttcctaagggtcatcttacgaaattcatggttagattatgcgttatatacctcctaacgaaaacacgaatggatatgcttattttcttcaagttctcaataaaaggaagttcttaacatgtcataaaacaagttctgtgtaagtctttagttaaaagcactagagcaaaaatacccatctagatttcattcagtgtttcccaagtagaattttatttttgtggttgaagtttggcatgtttcctatttcttcaagctatataaaacccttttgctgcgtctaatccatggcctgcggacatggaggactgattttgcaatacttttctagcattgggaaacttctaactaaaaattttgtgtgctggaatacttggaagaaaaggaaaggtcatttaaacaaatactatattttaaaatgaagaaataaagcaacattttaaatgtgtgatttttgttaagatacttgccattagtgagagttagggtgggacatatcagtaacgaatccgattgccactatggctctgcccccccaccatctttcctctgggaggatgttggggccaacttacgattgcaacctgtgtgtgtgtttatcctttgtttggatacatgttactaggtgccccactcttggccagcaattccagtgcctgggtggtttgcctgagcaaagtgcctgagtggctaggaatgtagagatagggctttgacccagagcacagggatgataaggtttactatagtgtaaggattagaatgaaggttctcttctgcttcagaagtgggaagaggaagcaacacaggatgggatctctatctggttctaggtctcaggctttctccagcccgttttgccaacttacaagcaactaaccaccactaaacttcctctccctggagaaggaaaaatttcactcacttgtgagtgagaagatctgcatccagatcctttctgtgccatgattagctgtgctacatcaggcccggtgttttcaggagtttaggaccaaacagcccctttcagctcttgcattctcctagtctttgacatcagaaggaaagtgcaggcgttcaagggagttcttgttttacagtttcaagcgatctgacgtcaggcgaaatctcttcactctctaacagatattccatcttaaaaaaaatcccatgaaccctaattcctgtgagtgtctctaaagtatattaaagactggattaattgtaatctaggcagaaatctgtctttgtggttgttgtttaatatcactcagtacatgccaatactcttctttcacttagcttctggtaatctatgaagctactcgtggtttcattcatttaaacccctctgagcctcagcttcttcatgctaaaggaaaataacaggaaataatggcataaatgtgttttgataaacataaaaccttttgtaaacatggggttttatttatgatagcacaaaatattaatataacttcctctaataacattgacatacgtcacatctatagtagccagtagtaaacaggcagcatgcagctctaaaaagtggacagattttcattgttctgatttggaatgtaacaatatctcctgttggttctctccttcctttctccactggccccaactctaagcagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggtaagcagaatttgaatctctaactgttcaacctccttgaaggtcaagattctgtgggcatttttgtttgagacccacctacctgattcagacttctgcactccgatggcagatcagtctgccttttttttttttttttttttttttggctgacagtatctaagaataatgataaataaattcatggctttcacagtggttgaactatttaatattagtaattactagatgacctgaactactggttatctttactccttcctgcttccttctttttatttttcttgcctttaaaataaaataagaggctgggtacggtggctcatgcccgtaatcccagcactttgcgaggccgaggtgggcagatcatgaggtcaggagatcgagaccatcctggctaacacagtgaaactccatctctactaaaaatacaaaaaaattagctgggcatggtggcgggcacctgtagtcccagctactcgggaggctgaggcaggagaatggtgtgaacccaggaggccaagcttgcagtgaaccaagatggcaccactgcactccagtctgggcgacagagcgagactccatctcaaaaataaaaaataaatgaaaaaaaaataagagggtgccaggagactacatggtagctattctacttggcccaggctacagtttcttcagatttagtgttttcccagaaagattctcaagtctagaccagttgagacctggaagggtaagagaaaggagcaccaaatgaaagaaataatgaaaaaaccagaagaagaaaaaggaaaaaaagatgagaaggcaagtaatgggtaaggggaataaatagaaggcctagagcatactgtggccaatcaaataaaggactgggagtggagggatgaggtatcatgaaggccacctttagacgctatatccatgaataagtcatgcctcatattctacatctcagatcctacaacaatttagcagaaaaggtcagcaatgccaagagttcccttagatctgatattatagttccatgaagggagactaaacagagagtgctgaaaagtggaaggtaagagcaggataaagcataagcaatcctcaaagagtattgagggtgccaaaggtgttgggggttaggatactttatagaaaaaatattaaaatataaggattgataaatatagagagtataattgtagagaaaatcaatggaagaagaaagagaatggatcggaatttaaaagaagaaaataaagtcaaaattctctttaaaaaactattttttacacattaatttcaagtccttgcccacatggccacattatccgtacatttatctcttgcttttcacttaacaatctgccataaagaatattgcaatatagatagacttcattatcagcctccctaacttggtatttcaccaagataacatactatttgtaagcgttttcccattttttaaacataaaaattgtttttagttttaaccataatagatgatgcagcagagaacattttgatatgcttcactttttacttttattgaatggtttttgtagactgggactataggacctaagagctgttaaaaacagctttacgggtcccagttcttggagcatcttcttttttttggagctctgctaaatatcacaattttatgaaactttactcagtctcttttttaaaattgcatcccttttcttacacccaacttgggactccttcaacacacaaacaccagaacgtttcttatctttataatcaacacaatgtttaaaagttgaggaggaggaaagaagaagaagtggaagtcatatccttgctatcttctgcttctcagtgtatttgctggtcagacttttgggcagcattttctcagttaaactgatttttttttaaattaatttgcttatttccctttcattttccaggaagctggcaaaatttcctccacgatgaggtcagagatgtagttatagagttccataaagcttgaatcattaatcttaaactccaaattataggactgttcccttaactgtagatgtgcattccagccctttctgttgctataaaggttatgacaccttcatgtatttgatatctggctatgggatctgttcgtttcttcaaggatgcacattttctttattatacagactatttcttttgccaccaacatcctgttcatgcaatttcattttattttctttatttttaaggtaaagaactaactcttttattgttttctgctctgcaggacagattgcccctcctagtcatttgattcgagtagaggggaacagccatgcccagtatgtagaagatcccatcacaggaagacagagtgtgctggtaccttatgagccaccccaggtaaaaagcaaaaaaccaaaccaaaaaacaacacctctatggactgagtagacttgagagaacatctgtttcagcaacagggatgtttctagcatctatcactgtcttagttcttgtcatcaaatatataatatttttgtatttttttctacctgttctccacatgctttcccttcagaatacctaaatatgcactgaatcaacttggtaacatggctctgtgtccatattcccatcttaagggcagataacaattgaactggcaattgggtgtatacatgagattgttttatccaactggcagttggacgggtagtggataagcaatagtagtggatgcaagtgttaccataagtgggaaagcctaagagggatctcttagctgaagtttgaatgaacagatgatagatttgtaaatctgttgcatgaagcagagtagtgtggttgaaagtacactggtgtaacaggacccaagttctttggtttgctggcttgctgtgtggaccttcggcaactctctctctctaggcttcagttgccttacccgtacgtatgtactttggactagattatgtttaattctgagaacattttgagctctaagatgttattaatggaagtatatattcaaatctatattgtactgttttatccacacagggaaaatattcttggagcattgctactgtttttggcaattatccccagttttcccttttcagtgatattcatgaaggtggtatagcctatttgaattacatgatgtggatcagcttacaaacgaacaggatcaaagatcacaaaatgttaaagcctgtctcacctaaggtagtgttcagtgttgcaaacattagctttaagcttccccgcaggcaagatgaagaaaaatctacaacagggttcagagtttgcccttttaggaggaagcgtatcacttcatcagaagtggaattccttaaatagagggaagaactgagaaggaacaacgtcagtttaaacccttgttaacacagattatttaccccttgttttcaggttggcactgaattcacgacagtcttgtacaatttcatgtgtaacagcagttgtgttggagggatgaaccgccgtccaattttaatcattgttactctggaaaccagagagtaagtggcgtatgtaaaattgtcattctacacaaaaaatcacgagcagagggcaaagtgaaatcgtggctgctttatcattaattttgcatgtgcagcggagagcttgtcctttgtgctctaaatccttgctacaaacggttacataaaagatctaagaaagtggagacaaaggaaggtgggtaaagttagaaggaaaaaaagagctagaaaagtgtgcaagtcacttcatacctgaattcttgacatttgactggaattgttctgattagaccatggtcctcaaggcatttcacagttttttttaagtctgcgctgccttaggggattttatccttgagacatccactggcttaactcaagtttccttcaaaatatgtagctaaatacagctgttcagctaatagctcagaggttctttggagaacaaatggaatgttatttactaatattacttgtggcatgttagcacttttgtgttctgccaagtgcttttgggtccattctcaaagccgccatggctaagctggtagtacgttggcgatggcccatatgggaagtggaagtggtagatcttcaggggactttcaaaatgctttgaatttaactctttcttcccctttattctaattcctagtgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgccgtaagtagatgtagtggccaaatggggtagggttgaatcttctccagatgttggagaatggggtgatattggagaagctgcatgataagacctgtgaccttcagcagcaagtgggacgtcagccctcagagccagtgagaataggtatagcattgaagtggactccaggcatgtactacagctttacaaaaacaagtagtcattgtgacaatttctcagtccagggattctcaaaatgtgacttccacaccagtagcataaacatcatctattcacagacacacaccagcaagatacgggctttcctgcaacattacttaagccaaaggctatttcccagcatactgaatttcttttatgtattcttccctaccatccttccacctccttattgctaggatcacaatcaatgtaaaaacaattgtccccagttaaatggacgcttagggctagagcctctaatcttacatgtgttgctggtactactgtctttttaatatgtatattaaatctgattaacattaatatttaattattaagtatatttaatatgcattagtgctttagaagtgttcccaggatgaaacttgcatttttcctccaccagcgtttcgtcagaacacacatggtatccagatgacatccatcaagaaacgaagatccccagatgatgaactgttatacttaccagtaggtcttccttgggtgttcatggttgcttcattttaaccttctttgaatgggcttttacagtatgatcatcatctcattatctgtgacaatgggaaaggaggtgtcttagtcagttgaagctgctacaacaaactaccgtagactagatggcttataaacaacagaagtttattttctagagtctggaagtctgagatcaaggtgcccctatggtcgggttctggtgagagttctcttctgagttgcaaactgccattttctccttgtattctcatatagtggagagggctagagagctctctagggtgttttttttttttttataagggcaaaatcccatttatgaaggctccactctcattacctaaattacttcccaaaggactcaccttctaatgtcatcacaatggggttaaaatttccatctgtgaactttggaaggacagaaaccttcagtccataatggggaagaggggagacggttgagagctggtgatacaaaggagagaaaatatgtgttttttaaaattagaatattattctttctctccacagttttggactgtattactagcatgagcttctctacttacctacccacccaactaaagctaaactcctaacagaatttttcttaccctaatatttaaaattaatttgtccttcattatttgagaatgataagattatcctaggcagcatggccatagaaatttaggccgaaaatgttgtcagaaaaagttcacaaaattgataatgcagcaatgatagccttgactttgatgtcttttaggcagcactataaagaaagccaagcaaggcagaagcctgaattacagtcagccctccctatctgcctgttccatatctgcagattcaaccaatcacagatcaaaaatagttggaaaaaaacaataaaaaaatacaccaatcaaaataatacaaatataacaacaatatagtataacaactaattgcatggcatttacattatattagatattataagtaatctagaggtaattttaaactatacagaggatatgcataggttacgtgcaaatactacaccattttatataagggacttgagcaacctaggattttagtatccatgggggccagatgggggtgggtagtcctggaatcaatgctctgctgatatcaaaagacaactgtgtatgtaaatggccagaagtcttagcccaattattatgtaagaacctcattaattcctacaagggacattacttctcttgcaatcactaatgagatcactttattagattatggttgcagttagttagttgaattcttattgcattaggtctttgccatgtagggtggcaatgacgttttggtggctggcatagcccttgatgccatctaaagcgatgacatgagacacagccaagcagggccaggagatttgaccatgaactactaccctgggattgaactaacgaaagtcaacggatttaggtgtgctgcactttcttcctcatcttctttgggtcctgactctcaggggaataaattgccagtagaccaatcagacggtgagttagctgagattcccagtgtcttgtttctcaaggtatatatggaaactgacttgtgatgttaaagtaaaacattaccctgatacactaaatattccaaaagtcttaatatgttttcagctgataaaacaggaactgcttgaaaaattattttaaaatttcagtttgtactaagaaggaggtatccttcttagtgtcatgtctcaagttgagagaagacttagcctaaataatttatgggtgaggaaaaactccattaatttaatatatattttgttggtgtttggtgagtggcaaatatgctagaccttgagcatttagagttcagtaggatacaattcttactttcaactaccttgccttctattgaggacacaaacagttataatgtaataaataaatgtaatgtaataaaataaatattcctagatcaaggcctagtgctgtgtgagtacccaagaagctccaaagatgcaaaaactataaataagagtaagatcaagaaaagcttctcagagaaggggtcccacagctgggatgagtaagagttaattcaacaaaaggtggagaacatttttcatttctgaattctgactaattctgcctttcctactgggtgcagcaactggggtaaggcagttaaagtgcctagggtgcaaaatttaaatagtcactcacacccaaggcaatgcagttgtgctaagtgcctctcttgcctcactctagtcctggcccggctcatccgtttttttggtttttgtttgttttgaaacaggatctcactttgttgcccaggttggagtgtagtggcaggatcatggttcactgcagcctcagactcccagactccagcaatcctcccacctcacctccccaggtagctgggaccacaggtgtgggccaccacgcccactaatttttgcacattttgtagagaaggagtttttttcccagggtggtcttgaactactgagctcaagcaatctgttccctcccaaattgccgggattgtaggtgtgagccaccatgtctggcccctgctcataattgtaaaagcctttaagagcttttatttaaagattttaagggactctcttaaagagagaaacatattttatcccacatggaaacttttatcctatcaaacatagttacaatctattcttattttttgtagtagtttagttttatgaaggtgttgcaaaaatggtattggtggatatgaatcatctcatcgctcctaagagaaatataggattgggttcctatgcacctctggtcacatacatttcacaacagaataatatatcacttcgtttgttgtgtgtttctgttaagagacattttatttaatatataccgttgactcattaacatcagactcgtggccaattagccttataactcatgcctgaataaagtttctctaacacacacacacacacacacacacacacacacatattttctccataaggcatggaacgaccttctctcacttagggacactagatagcacttccgcactgcccttgagggtcttttaaataacaaaatcaccaatgaaaagcacaaaaatgtaaaacacgtggcgctaaatagaccatgaaaagaacgtgggtttacggtataagagctacaagatgacagagcatctccttgttcgaaccagctgggaatgcacacaggtgactcaaatttttcatcactctgcccgggtctgaaagaccacaaaagggccaagagtgttgattttcatgttacaaataaacgttagcaaataaacaaattgcaattacggaatcctcaaataatgaggattgaccacacttctaacagttctacagcttttcatgtttccttctttccttctgctcacttccataggtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagtgagtgtatcaacgtgtcattttaggaggcatgagtgagggtgactttatttggatcagcaatagggtgattgatgagcaatgtggaacataatgggagatagcagattgtcatagattcagatgacctggtatggcaaccctctttcagttgcaaccttttttacgtgtcttattataaccttcccttcagaattccacttatgttctgaaattaaatacaaaccatttctggtgaattacaaagaaactcacactaacagttctcgtctctatatgcctggtccatacacactaacagtaagtacacactctatttggtagtgatgtgtatatttgaaaacatgaaatcttttctcatcccaatggattgtcttataaatctcctgggatgcacactatccacttttgggaataacactgtagaccagggatagcaaataggctttactataatataaagtgacttgtttgaatgctgtaatgagaagaattctgagacctagtgcatgataattggggaaatatctgggtgcagaaggataaggtagcatcatgttgccgtattttagaatctctgctctagattgtcttccagcagtacatttttggcataaatcaagccagatttttcaagtatattaccatatacatataacctatttatatgttaagctttgccttgaatcttggatctttcctaaagtgattttatgactgactagaatagaatagctcttatgaaaggatgagaggttgaccaatcaggaccttgtttatatttacctttctgtggttaaaaataatcacttgttagtttaattaaaatatgatatgtgtcctggaagtattgtcagagactctgtagataagtgtaaaatatatacattatgagtccacttgagtaatgtagactttcaacttcatactttaggcaaaaaagaagtcaaaaactatcttccagaggcaaagattatattttacaatagaaatgcaaatgaacaataaaaatggttattttctatgttattagctgttgtagggagtcagctgtggaaagtgtaataaagagggcttatgattattattattattattgagtctcgctctgtcacccaggtaggagtgcagtggcactttcttggctcactgcaacctctgcctagcgggttcaagtgattctcctgcctcagcctcccgagtagctgggattagaggcacctgccaccatgcctggcagattttttgtattttttagtagagatggggtttcaccatgttagccaggctggtcgcgaactcctgaactcaggtgatccacccacctcggcttcccagagtgctgggattacaggtgtgggccaccgtgccggccttgttattatgttttaatcaatatgaatgtatctctgatagtaaagaaacactttctgagcacctgttatctacagagtggagtagacggcagggagaaaagaggcacattctctgttcaaaggactctaagctatttgagcatccaagatcctttttggcccgaagggatctcaccatttacttttagcataaaagttttgcaaattttaatggtatggttttatttgtaagcctgagcagaaagtttaatcacacagtgtattctgaaggagaattagaactcagagttgcagacacaatttccattgctaatcatatggatgttttgggatatcagatggaaatatatactaacatatttaagtggaaaatgatttagttcttataaaaccatacaaccaggatcaaagaaacagagacctgtaacatcatttatagacccaggagggatatctacctttcctaagatatgtgtgtcatggtattaagaaataccctcaaatttcctcctgttcactctgaaagtttgactataccaaaatgacctccaaaacatcactaagtaatatatcatgctgaactagttgctcttcagtactctttcctgtctttttttttttttttttttcagttaataagaaaaggtctcatatgtagtacaggaattggcaagctgctttttgtaaagtcctggtagtaaatatttagattttctgggtctatattgtcttttgcaactactcagctctgtggttgtagcacagaaacagccgaagataatgcataaaggaaagagagtggctgttccataaatggaactttatggaccctaaaatttgaatttcatataattttcacatgccgtgaaatattattctccttttgattgttcctccccctattaaaaactgtaggccgggcacggtggctcacgcctgtaatcccagcactttggtaggccaaggtgggtggatcacgaggtcaggagctcgagacgagcctggtcaatatggtgaaaccccgtcgctactaaaaatacaaaaattagctgggcaaggtggcacgcacctgtagtcccagctacttgggaggctgaggcagaagaatcgcttgaacctgggaggcagaggttgcagtgagccaagattgtgccactgcactccagcctgggcaacagagagagacttcatctcaaaaagaaaaagaaaaaaaaatacatacatatatatatatatatatatatatatatatatatatatatatataaactattcttagcttgctgtagtttgatagtctgtcttatagataaatgcgtggatctcctttcattgcttcttgaggctccaattttgtttgataggtgtacttggaagttaatatgtatattccaagctagaaagttattaaaagattttaggaaatcctaaagtggtttttcaggtggcatttcagtatctaataaaaagcaacaccagccttgaacagatatcttttttgtctgagaaagtgaggcatgcccatccagatataaaatgtagttaacgacacaacctcattgtcagatgaggctggaatagttgacttgattcacgtcacatattcttattgaagatgtgctatgtgaaagcattaaggatagaggtgagaaagatgtagctcctgccttcccatggtctacaatttaatggtgaatttctaaccttaacactctgagtttgaagaaagctctggaaatttatcctcagcattgtgcaagttaataggacaattttaaacagtttccatggatcatatgagaaaaagaatagtttcatgtcattgttttagaaacttgacaagccaggaggattgacatcattcagttcaggggcatatgctaaatgtatttgtttttatggcatacatgaaaatacataaccctctttttctatacgatgagtatccagtgcttattgtctgaccggctcacattgctctaaagggaattttttattcatatttcataaaataatctgtgtccccagagaagaaaacacatgttaatattgtgttatttttaaaagcacacaagattttagggacatatttacacttttttgcatgtgtggccacagatagatagtaaagaactagtagcttcatagttccctggtgtgttcatttaactgtattatatgcatgcttttgagttggtatctcacagctgtgataacttgtgcatggaaatctaacagactgcaaaattaaatctttgcaaaatatagacatttggtctaattatgtctttgtaacattatatatacatgggtctccagtgattgatatgcatctatataaatccttcagttgaattcttcagctgagtttttttagctcttattttcatgcaaatctccaagaaagagcatgaatgactaaacaaagaaaaacaaaaatctaatttcctggcaatcatttgaaaagaataaatcagcttggaaaatacctataatagcctgtgattttctttccaaaaagatagtaccaattttatgctggtaaggaatcaattttgtatttttctttatagtagagggaaaattagtgggaagagaacgtactttctgtaaggtggcactacaatatttttactttaattacttctattaggttcccactatgtgttttcttctgcctgcttttcatttgtgcatggtttttctttttaaaaaaatttcttcgcgtttaccttcatgatcataggctttatcgaagatagactttacagagctgctgtgaatcaaattgttatagatacaagtaggctttatattacgaagaaatgtgattttagttgatttgcttacattggaataaatatagagagttatgtttctagatgccagaatctaatagaaagacaaatcggaccctatctttagacttcttgccatcctattatcaagggacatcaacgcttaagacagctttgcagaagcctcttgagacctatttagcaacgttttgacttctgtacttcagatcagtactatttcttttttcatttgttagttgttttcccttattcttggcttccaacataaaagcgaggctgacatcactttgttacagtctcgcttaggctagctcttactttcctctggaaatttatttttgagcttctacaggatgaattttatttaaatgataaaacagatctgtgacatcctgatgagcccttagtgtttccttctcttttatgattacttgacaattgtggctcattagtaacacaagtcagagattattagaacaaagcaggatctccaagtccatggttccagcccctcacaccatagccggataaactgaggctctgtgaatttatagccagtttataataaagctaagactagaatcagatttagaacatagagctctttgtaatgttgtgttctgctacattggcagttaagtaagtagttaattataaaatttaaacatctatttccatttttctgtctcttttttgtaggattgttttagagatggggtctagctattttgcccaggctggacttggacttctgggctcaagcgatcccctgcctcagcctcccgagtagctgtggaccacaggcacaccccactgtgcctggcacgtttttctgactctgttgttagttacttggtatttattcttgtaggttcactttaaagtcctgtatctttaaacttgtttggcgatggttatcatcaagaatattgatatttttttctcagattcatgtatctgagggagaagcaggcagtattttcagtattatcaatgtagaaaagagaaaggtacacggtctccaaactgatagaaaatgtcaacaccgtatttctaggttagacagagaaatcctccacgtttccagaatatctgaaattgccagctttataggttaaaaagagatgaatattgataatttcatatgattcacccttatagttattatggaactacacaagcttttacagtttcctttttttttttttttttttttgagacagagtcttgctctgtcacccaggctagagtgcagtggcatgatctcggctcactgaaacatttgcctcctgggttcgaacaactctcctgcctcagcctcctgcgtagctgggattacagatgcctgccaccatgcccggctaatttttgtattttgatatatatatataattttttttttctttttttttttttttagtagagacgggatttcaccatgttggccaggctggtctcaaacccctgacgttgtgatccccccgaccttggcctcccacagtgctgggattacaggtgtgagccaccgcgcccagcctacagtttacttttgaatttcatagttatgaagttttcagggcagagatttattatctctgaattggtaatgaagaaaaaccatagagacggggtttcaccatgttggccaggctggtctcaaacccctgaccttgtgatccccctgaccttggcctcccacagtgctgggattacaggtgtgagccaccgcgcccagcctacagtttacttttgaatttcatagttatgaagttttcagggcagagatttattatctctgaattggtaatgaagaaaaaactcaatgattaattaaactcagatagattaaattacttttgtaacttctctcacctcattgcagaatcaggctcagtcctaggtcttagaggtctttagttagctgtacattgcttccccatccatttttattcgggcatattctgttaagatgatatcaattcttgccggtgacatggtttactgaatcctagcattaagcaaataaaaatgactttgttcctttgaaaggcatagccaaatgtgattcaagaagccaatctgggaaacaatttccaaacagttcatgagattgcccaactttcagcaaaataaaagggtttatttctggcatcctcgtggtgtaaataatttcttaattatgcaaaaaattgctttcttgggtttgatatatgcatttataggccgagttttttactcaaaggattaaggtatttatccatctcaatctgggaatatccaaaatactcattaaacagttctttgtaaatgcctgatgccacaggccccattctgataatatcatatttctctatacctcacacttaggctagacaagaactgtaatgagggataataattgaccagatgacattttacaaaagattcaagtttcttcttcttcattccttttttttaattgagtccagtaaaccgtatgcgaagcactgtgttaaataccttgatctaccttatctcagtggtcctcgactgaatcgccttgtgtaacttattaaaaatatgttttcctggatgccagcttgtgttggaagggagccaggaaaatgcatttttataagtttcacaagtgattctgatgtttatttctggttaactactatagccttatcccatttcttcctcataaaaatcttgagaagtctcagtaattgtaaaagaagataaattggaagaacaaaaatagcttttcaggcactctattctgtctatactatgatcatgaaggtataaggagtgtgtttctgaattcaattgatttgaatagatgaagtcctaggccttcattttttcttttctctggttcctctctgcagtctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggtttatcttgcagtttttttgtttctgtctctctcactttttttccactaaatactagaatattctcatgtaagtgcttgaagtagcatgtgtaggtctaaggaacaagaataataatagaatcatcactttgttcctacgtacatttcttctgtcagtatttggtatttttatttaagatactctgtatcaaggtcatcaatcgtaacaaggaactaaaatgcctaaactaacttaaaaaaatactttagctctatgagttttaaagtttgtcctaggaagccagacaccatagaatcatttattgacattcctgacaaacctctagttgtatgttaattcgccaaatttactaaagtgaatttcaatcaaatccaaatgttttaaataacatggcttctgtggcatagacattagcaaatatttggccagaaatcaacagtggaacctattgtccaatttttttttttacttatgttttgagccctgaataattgcttttaaaagcttcataagaagttctaaccaaaaaaaaaaaattagtattttagataaatatttcagaaaaaaaaatctttatatttgagataaaagtatattagtaaaaccagatgctcctgttatatttgcaaggtgtttttcaattggtctaataactttgattcacaaagcccttaaaggattggtgagtatgtttcgttttttgatatttgcttttctttcagaagggtttttcttttctttcagccttttttaagtaagtttttaatgtgtttatagtgacttgtatataaatgcacatatttgaaatgatggaaaatattagaaaattacagttttcccatctagagaataaatgctgcactgtctttagtagccagataacccggctagagagaaaggtcacaggtaggcagtactgggtaaaattgagagaagatatgattctttttctgatggtccatgttttcccttttttttttttttttcctgacctttctcataacaaggatgctctgctccgccctcagtatccctttctgctcccaaattctttactgcagaaatggtttgttgaaatagatttggcctaagctatcaccaaatcctactagagggttgctttttaatgagcagtggaagattttagccaaaagaaggaatctagtggaattctagacatctaggaggtagatagtgtaacttgtgtctgcgcaggaattttgatattctaccacatagatagtcactagggttggaaccagaaaacctgatttgaagtcctatatgtcctaaaaccacttctcgcttttcaattttgaattttattcttcggaaactgtgcagaagcttatattgttaaagttaagaactgggacttggctccaccaggatttttcttcaaagctggaaatacgtgaaatatgattttctacatctctgttacactgaattcttagaaaaatctagtgaggctctagagaaaacaacctgaggtatacaccttacgatttttttctgcagacagctggattcttacttttttgggttttggataggagaggagagtgtaggcaagaaaaccagaatggtacaggtcctgttattcttctgaacacattttccttctctttagtttctccagaaatttttggaatatttcacttaagaactattgtattaaatttgtaattttttttaaaaaaggttgttcttcaaggctttcaaattggctgagtttattcagccttgcttcctttttcaccgtatgtagttttcagaatgcttcttctagttcagtcattttgaaattaataatagacagactaccttgcttcccttccgtgtggctttaaaactcactttcatattaaagggaaggcattccgaatttctgacctttcctgactgttaaccccattcaactgttcaccctcatttctgggtatgttcaattaagaatccaactcacctctggccacttcctcctattaattcttacatagttatcttctatgccatgggccacatatcagagtgttaaatatttgaggctggagggaaacagtgaaagaagctaagaagctgatgtttcctgagcacctacaaatcactggaccctgtccagggctgttacatgatctcattcttaatagaaatcttctagagtaggtacaatatctaggctacaggttaagaaaatgagactcaagaaacttgtacaacatcctgcgtcactaagtttgtgttagatgttttgattgacttagaatccatgttccttctttcttcatctgtggtttctgacctaccctcctcaaattagtggcttatgatgaaaaatggtaaatgaactaataaaatagtcaaaaataataaccataagctaaagaaagcaggaggttgtaacaggaattgtaagaaggaatttactctgagcgtccagaaaaaaaaaaaagcaaaacttttaaatgtatttttatttttctaattgtggctattaatgattcaagcactgctttctattagctcttgctgtacatttgactggtttgaggagggacagatagagaggtctcctcaggttacagaggaccaactgcatcaggaatatgggctacctggaatcttaggtacttttcagtgagcaaagagaattgaagaaacatcagctggcagagaatctccttactgccttgccccaagctttcctatactctgatgtggactaatggatgagcctaagtgcagccatatgtgctgactctttgaaaaggttcccccacagggacggagtggattcagaagtgcttggtagtagctggagttacctcctttacccctcttccatcttggtctcctacatttctcttactacttcatctatttcttgtccccataacctagaaaaaacaataggtgccaggagacctagttctgccctcagtgcatccatttagcaacatgtgatcttgggcatatgttttttcttagaaccttatatttacccatatgtatatttggaatagtaatttctgtccatctctgccctgctataccatgacctgctccacaaggatggtgtgacaatcattcagaaaatgtacaaagaagagttcggtaacctgaaatgttttatagttgggaggatttattgtatcaacaccagtatatatatacaatgtggatctataattgtgagtatttgataagggctaaagagaaaagtcaatgccctcctaccttaaaggcagtgattgtaaaatacacctgaattgttaatttacattaattgacatgataatttatacacattaaaatacagcatattgtttgcattcatctagctgtggctctccattgacatggaatggagccttccttattttcatgtaattatggagagaatgcagagtggcagcttcgaagaccatccctacgattgcagcacctaagtgctagggccatttttaaaatgatttttttcaaatattatgccatataggcttggaacctgggtccatttacagagcctccaaaatttgaattatacatatatatgcagataaaactcaaagaaaaaatttgtctcccctctaatgtaaatatgcctgtgacagggaaaaggtaaacaggaacaacataattcgctttgtttgagaattgttaaaggggagttttcccataacagactagacacttgcttaaagtccagtcttcattctgtggtcacagtaattcagtgtagatgctgcatagtctgtacatttcttcctcatcttctctttttcagttctcatcatagccgtataaggtaggatggattattatatccattgcctccactactctatgagtgtctcaaagatggggaccatgccttaagttttattaacttgaacatctgactcatgcagcaagtgtaaatgtatgtagtttatatagttttcttgtgagaaaacaaaggccaggatgttaagtagctcgcatgggcatctatagcatcctaacagatgacggaggaaggcttcatctctgactttgtgactctcattgtagtacacatcactagtttttatattaagataaaacatcaggaatgacagttgagttgggaatattatctgttagatataatatgacaaatgagttctggtaactttccaaattgaagatcatgctgaatggaaaactattgggtttttctgttgctttgtttttttcatttctcccaggagacttttggaaagtcaatagaatagttatttgggcttcagcgttctcctgtgtagaaatgcttttgacattccagtaggttctctcatacatcatgaacatctctattgaaaatgcatgtttccaagtaggggcctctgcatgacagcaagatgagctgccaaatgcccagtttgattgggtttgtagtcattttctgcatatcccaaatggaatatacagaaagctacaaatggaatgccttagctgcagtttgagggtgggatatccatgtttttcgtcagcctttaagtctttgctcaattcttttccctaactgcttttcaaactcatttgagttgaagggaaaagaggagaagggaatggagaaaacaactgaagggaaaagaggaggcaagaattttctctttctcaaaggaaatactaaaccttgcactctgcacattcaggaaaaatatgatttgatgatagcctcgcagtcagtttctccctattcaggaaatattctcagatggaaacaaaattaacttcttaccattaatcctagaagaatgttttcaaatgtttggtttgaggccatgttttaaacagagacctgttgaaaatcaatagtccccactcttcagtgtcccttgctcaccattatttccatgtttgtcttcctaggacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagtaagagcatctccttttagctgtggctgaaggatgaacaggctagcttaggacaagactctgtgatggggaaggcatgttcttaagctaaatgagagacacagtgggacagatcagatcaaagtggagtggcttgggtttctgactgaacctttcacttttgaggtttatcattcattgcaaaatatactactggtagagatagggacggatgtttctttagtgtagggataaggatttctgtgaaaagaacagtctacttgctgctatcctggatggagactcaccacctgcagcctttgaaatagtcaaaaggaaacaaatgcaacatgcataaagtagcatgttgcagtgaacttaaaatctagagaaataggccgggcatggtggctcacgactgcaatcctagcactttgggaggccgaggcgggaggatcacttgaggtcaggagttcgagaccaacctggccaacatggtgaaaccccgtctctattaaaaatacaaaagttagctgagcctggtggtgcatgcctgtaatcccagctactcaggaggctgaggcatgaaaatcacttgaacccgggaggcagaggttgcagtaaggtgagatcacactgctgcactccagcctgggtgacagagtgagactcagtctcaaaaaaaaaaaaaaaaatctagaaaagtagattatcgtctggactctatgaaaaaaatacctctaattacaaagaagttacttctcgaatacttaattttctatccataaaattgtcactatatatacttaacattttatgtctgttactctataatcctggccttttaaactcacctattctatcccagacacagtcagtaaggaactgatctacgaaggaacctgccttttatttcttctcacacacattcctcatatcagctaagtacaaatgaaaaaggcactgtaagaattgggcctccaagtggatgatgactggcatatagctttactataaatataattatcttctccactaggactaaatctagcaaagtggatacacaaacttgaaggaaaaaaaagtcgtggtaaaaatgcaaaagattgtataacaccctcggggatacagaagactgaacattgcatgggtatcatataatccttactacctaaaaaacagtaccctcaagcttgtcttttgaaatcctaattattttgatcaaacctctaaacgagcatttcagtgttgtctcttctgaaagaaatcaggggaggctaggattatgactttctgtggtctaatggcacacattcattgttttggttttttttttttttttttagacagagtttcgctcttgttgcccaggctggagtgcaatggcgcaatctcggctcactgtaatctctgcctcccaggttcaagtgattctcctgcctcagcctcccgaatagctgggattacaggcgtgcaccaccacgcccggctaattttttgtatttttagtagaggtgggttttcaccatgttggccagactggtcgcgaactcctgacctcaggtgatccacccacctcagcctcccaaagtgctgggattacaggcgtgagccaccgcgcctggccacacattcatattttaatgagatagaggtgtgtgtgtttgcaatggttgcctgttatggcaaacgtagactttagagtgagatcactctctcactaatgataaactcatcataaggcttaaaacctgaccccttgacaggcctactttgacataaaaagagtagaaaccatttattttcaactttattttatttcttgtgacatcttagagtcctcaagttccttcttggtatgacaaaattgtgataatagtgatgatggttcacatttgtataacttacagtttgcctactttttttcttatttgtactttacaattatttcagaagggaaacagattgagatgtgatagggtatgctctttagttagctagttagtggcaaagaccttttctaggcatactgctactcactaaagtagaaacaaattacattaatcttttagtaaattattttgttctttttgacatgaaggcaaaattcattttataaatattgatattaaactttttttctctatcagtgagtgtttacacttaattgtttagtaaaatatcagtaagtattggtggtgttcctgtatacaaccctgaaaatggaccataagtaatagaatatttaattgtatcatcatttattaggcacgtgagtccttctaaatattgaagtcagtctccctattcccaaataaatgttccaagggtcactctttcattcacagatttgtgcatttatccacttaccctaagtttactgagcacctactctgtgccaggcactgtgctagggactgtagggatctagacacctataagatctaatctctgtgcttgcacaggttagtgagggagacagaaatatcaccctcgaaggcaaatacaaggaagaatatgttaacattaagagcaattagcaattagagaattagaagcagagaaaggggaggaaagagattgttctcggacaaggtacaaaagtcaagaggtgcctaattagtttggagtctgaccgttctgtttgactagatgtaggctgtttgaaggggtgtagtgagagcgaagattaaaaaggaaggctggtagtttaggcccttgataaaatttaaccagacaagatggaccactgggatgctggtacatgatgatggcagtaaccctttttgttcctcctgcttctgttcagttcccatgatgggcacccacatgccaatggctggagacatgaatggactcagccccacccaggcactccctcccccactctccatgccatccacctcccactgcacacccccacctccgtatcccacagattgcagcattgtcaggtgagtccacagcatgtgcccctgggggcctgccctaagcatcccgggatggtggagggcggatactgttatagtccataaaacagttggaagggaagacagcagtcctgtggttggagttcagtcactattatctctgatctgtggagtggtcaacaatgttttatcaaggaaaactactataaccagcatggaaacaagggaaagtgtctgttgataggcatattgttttcatgtctgtttccctcgccttcacttactcccttcctcctctctcacatttttacattgtcaattgcggccctcaagttggtgctcagggctgggtttccaaaagggcaataaacttgctatctcgctccttttcctctctctctaatccttatagctctcagccaccatgggaccattattttggagttggatgtccataaaaagttttaatgttatccaaaatgacagggactttcaaaaactgatggcctttactactctgcctatgggaaatgggcacactccagaaaaggggagttgagataagcagaagaaagaaatgcatgaagcctgaaagatttgcttcccacagaggcaagagtaggttcccagatttcttgcctagtgtatatcttcttcttctgcttcatgtgcagaatgattgtttcatttggctactggaacgatttgtgttgattttcctgctacgtcaatcacagggatggcaaagtgcgtggccttttccacccagggtctgttctgtaatgatggtggcatcatcatcagtctcagaccagcaccaaaaggaaggggatctgtatcctgagaaggacataaatcaaaaggcatgaatgacttaatggagtagaggcctacaatttttttcttaaccacatgagccattctcacaaagcccagatacaaaacaaataaagtagagatgttctttttgaagtgtagagccaagcagcaagaaagctaggaacctgaacactggacttccctttcaccctttgcaatggttcctaggacacttacacagaaccctagaattccacagatcaccatatgataatcgctgatctgcaggaatccttatagttgattttaatttctgtagacctaaacttcatgtcaccagtaatctccagacctcagacttaaggcccacatatatattacccaatcctcatctctgatgtggggcatccaagggcaaaatatattgggttttcccttatctcgccaatgcagttggggtgaactttctttttctgtttcctccttcctcttccctcctccctctgcagtttcttagcgaggttgggctgttcatcatgtctggactatttcacgacccaggggctgaccaccatctatcagattgagcattactccatggatgtaagtaactgttagacttttctcaaattttatttcttcatttctttcctctgatgacaaccgccttgtagttcaatccctgatagtttaaaaatttgtttttgtcatgcccccaattatccattttgatagaacccataactatgttagaaagattcccaggcctcaacctatacatattagaagcttagcaatcaatcttccttagcttgtcttatcagtcaacaattgtctattgcacttacactattctcaaggtgggaaagaggagctattcccgcaatcaaaacattcataatttctaaagaattaatacaactttttgagtgtgctcattaatctgtatcagttcccagaaaggatagcagggcaccggtggtgctattctcttaaaaacatggagagatgacacagtagtcatttgccatgactatttaaaacaaaactaggaatagaacacaaacgtgtaagcttacagtctttaactttattaactggccttttctgcctttctttaaattagtaccttaagggagattcagccgttcctctcaattaaaactatatgttcctttattaattttcagtttcatcctaatagagcccagccatttctaatcattgggcattatcaatggctatggggtcaaatcccaatcaccctttttagtagcaatgagaacttggggttatcactttgcctctctgggcctcagttaataaaatattgggttcaaattactcctttctggctttcatatcctttgatttgtctttgaaacaagctgggcgagaggggactttttcttgcttcctactccactttttgaactcctgctcacacgggagctagtgttgctctggtttatggcaatctgatttgtctcttaggccgcgctcttcatgctgctctctttggggttcactagcctctcttctagcttccagagggtactttggactgcgggaagaagacagtctctgcctctgctgctacttctattgttggggactcttttttccccctccttgagcaccgatgctagagatgcccctgcagcataagaatgcccccaccatgaggtgacgtgtacatagtgtactgcccctatgcccacccctcttcaccccataaatcactcctggctgctgctccctgatagaataagttataagcaaaaactgcagggaaagctttaagagtaagttccagtattattctgataactttacagtcacttccgtccactgaagagaacagagttgccctatatttgagagagtctcctgtagtagattcctacattttggaacagagaatcttcctcttccctatatttttaaagttatactttccacttgctcacttatttccactggggaatgtgtcaggatgttcccttgatcattaggatctgcagataccctttataagttcatttctgctgatgttgactaagtcctatgccaatctgtgggccacagctttctcacctgtcagtcattagttaaaatccatccagggcatcatgacaatgaacagagtctaatttacaaagagctttgcatttactgagagcctcaaaagtataaagaatccaagaaacataaaaagctatgcttatttaggccgggcatggtggctcacacctgtaatcccagcactttgggaggccgaggcaggcggatcacgaggtcaggagaccgagaccatcctggctaacacggtgaaaccctgtctctactaaaaatacaaaaaattagccaggtgtggtggtgcacctctgtagtcccagctactcaggaggccgaggcaggaaaatggcgtgaacttgggaggcggagtttgcagtgagccgagatcacgccactgcactccagcctgggtgaaagtgcaagactccgtctcaaaaaataataaaaaaagctatgcttatttttttgtggattaccttctttataaggtattcttctgctacagtaagagattaggaatacctctaatggcctgaaaattcacaccataggaaaatatgacaccagactacaaacttccaaattgagaaatgttgggaagctgtgcaattttctcctcctcacctcagcttcttcctgcgtatttctagaaagagacacccttttctcagcttttatcttagagccagtctaagttattgggcatcatcacttcctggaaaaggaatgtgacctaaatttggggaacttcattagtatccccataacatgcaaaaatgaggtaacaatacaacataataataatacaaatggttaatatttatagagtgtgttgtaatttataaaatactttcatagctgtatttacctatgagtctatagcatcttttgccctataaagcaattgtatctcattttaccaaagaagaaactgaggctggtagagaataagtgacttgctgaagttctatagccagtcagtgaccatcaaaacctctgccacagttttctcactccaagcacaatgtgctgtttacctaccattctgccctgtgaaaatatgagctatcactgaaacaatctaaagaagagctaacgcagataaatgtaagtgatatcaccacagtcagttaaggttgaccctatttgcaatgccttctgcacccattcacagaacatagacacagttgctctgcattttgataccttgctttattcaaacaccaagagaccttttagataaaagtgccgtttcaggttctgaggatgccctaagtccctaattttttcacttagttatgtgactttaaacttgtcaacctctctggccttcagttgttctatctataaaacaggtctaataatgtttaccactaatctggggattaaatgatatcatgaatataaaataattcagggcctggcacatagaaagtactcaatcttttcttctcatctcctcaaccaagtggtggtgacattccattaatacctttcttctagtgactagccaggtaaattcaagcataagtaggtacctcatgtttctatttgggatttttgccctctcatctagctattatcccaattttaccaatgaagaaactgaggccagtagagactaagtgaagtgttctacacaggcaggaaagacacctcaaggctgtgcctttgtgcttagttccatagagttgaagactcagagaactaattttattttctaatttgtggatcaatagattcagatcaattaaaccagagcatcagggaatgataggatgctgtggactaaatgtccgtttttctccctgttttcattctccatgacaccttcccctgttgcacaggatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaag

SEQ ID NO: 37337 - DNA, 219791 bp, Homo sapiens; identical to SEQ ID NO: 36476

SEQ ID NO: 37338 - DNA, 3650 bp, Homo sapiens
gcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtcccggagctccgcacagtgtgccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcacccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccgggccatgggccgctagcggtcctccagttcgggcccggcctccctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcagccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgccgcggcgcgggccgggggcgacggggatcgggacgccggctgcagggccgggggaggagcgcgtcggggctgccaaggcgtcgcgctggcgcgggcggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttaaagaaaaatgctaagggcagccctgcctgccctccccatcccccgctgtaaatatacactatttttgatagcacacatggggcccccatatctcttggccttggttttgatgttgaaatcctggccttgggagagatgccttccaggcagacacagctgtctggttcaggccaagcccctttgcaatgcaagccctttctggtgttatgaagtccctctatgtcgtcgttttcaccagcaactggtgactgtcccttcgacacggacctgctttgagatttcctgacagggaaaagatttctgtccatttttttcctgtgcctaacagcataattgccttttcctatgtaaatattatgatggtggatcaagacataagtaaatgagcctttctgcctcacatcagccctgtgtataaagccattattctctgatgcactgtttgccccagtaactcactttaaaacctctctttccagtgttccctctctccctccagggccactgcttgaagaagaatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaagaaaaactaatgtcagcacatgttgctaatgacagtggatttttttttaaataaaaaagtttacagatcaaatgtgaaataaatatgaatggagtggtc

SEQ ID NO: 37339 - DNA, 196663 bp, Homo sapiens
atttacgcgttgctgaatctcctgtggacaaaccaccaataggccaggactgtcctgtggacagacggggtgagcctcttcttgtgtctggagattctgagtgagtagaacccgttatgatccccactgcacttaatgtggcattcatgaatgagtctgggctgatgtgctaattgggggccgtaagaagagttatagccacgatggccctcacctttctctaataaaagcttaaacacagctacggtaaatatttttgctttctgctttcacaaacttcacatacgcttacatttattttgaggcgaaaggggaagaacagacatttacaggggaccagttgctaggagaagactgtgcattccctgtaaccctgtcagtctcacctcggagatcctgtccctggagtgccccaggtcccttttcccagctgcactgagtgcctctgtcctcctggtggagctgtgctgctttcttgggcagcctcccttccccatggggtgcacataggctgggggcatcccggtggtcagttcttcccagggacccaggaggaggggctggcagaaagtgggcaggttctttccgctcgacctggcaataacaattcctaaattgctcagcaccccaggctgcttgccttgacccaggtagccagtcccaggcaccaccagtgtgggcagggccctccccaggggcagcagcagggcagcccaagacactggtggccaccacagttagtccccacaaggcgattgtgcaggacatgttctcgagctgcctgcagggtctggttgtgggagcagctcagcccctcctgcagaggtgggagcatcttctacagccagccattgtcccgcaggagctctgtgcccagtggaatatctcagtgcagtgcacaatggggccacagctgtgtcacagccatgctctgtcctttagtgggccgtctgagccacattccacctgcctgttctgacacactgctctccctcgatgaccctgctcccactggcctccccatggtttcgatctgtaacccagaccctgttcccaggagctggctcagcaccatcctgctccacaccctctctcaggagacatcctaacctgcccagcctgtcctgttcctgcctctcaacccagaacactgcaggtccttcaggtattcggtgagaccttagaagcaggcacagcaggatttatcccacatgcaccatgcaccgtgctgaggaagccacggtcactcccctaatggtcactagaggtgagagaactgaggttgttgcccatgtggtagaactggaattcagggcctcagccacacctcagtcaccacaccacgccctgtgcaggacgctggggaaaccaggcagctaggactggcctgtgccttggaatgcttactcagaccacccatccttgtcccctttgcacctcaaaggcttggtctacttttcagacacagtttttatattgtcagcctgatacatatgcatattttaagatgtcaaagagttttataagttttatgaaaaaaatagcagacccctggcctcccagaccatctccccaccgcccctgccctgcccactccccatagattaccacttccagctcttattgcttcttcctctggatttatctccacatttgtaaagaatatgggcacgctgctatttcttagtcttctgttgtggtcaagatggttgaactcgtagatttccctcctgagagctgctccatctaaccctaaccctaactctgatatatagagttatgtcatcatttaggtgaacccttatgcagtgtgtatcagtcaggataggctgcctcatgatgcaggaacaagcatccccagacctgagagagttccgtttctctagcctcctgccctgggggtgggtgctgagtctgggggaggtgtggggtggggggaggggcctcagcgctcagcagacaggtgctcactggtgtcaccatgttccctgccctcttctcatatggaacacgtggtgcccttttgccagggcatccctgctcaggggtcaggatagtcctcctctgagtggctgggagtctgactgctccctgtttagactattgagtagccccctgctttctgcctcactccctttttgtgctggtgtctcagtgcttgggccttttggggttttagaggtgggccgtgaggctgggcatgaaaaggcttctctgcctccaccgcccccccggggctcctcatccctgtgctgcctcagcacttcgtctggcaagatttgcaggtgcagttttcatttctcattctttgttggttttgagtgatttcaagagaagatgcagaaaggctgtgaccccacctctaaaagccagcggtcaacctggccacccttaagcctgttctagtgggccccctgccccgttgccctgctgtgacagtgtcccacgaggacagactcaacacaggacttcagtccttgccttcccgagtgctggcagccctggtgctgttgctttccctctcccctccttgttctcaacctcaggaggaaaatgcccagtttctcatgatgagatatgatgtcatctgtaggttttttttttaaaaaagtgggtaaaattcatataacattagccattaaccagttgaaagtgtgtaattcagtaacatgtagtgcatttgcagtgttgggcacccactatctgtgtctagttccaacaagttttcttcatcccagagaggaactctccattaagcagtcactccccagcctccctaccccagtctctggcaaccccaatctgctttctgtctccatggacttacatattctgaatgtttcccataaattagacatcatataatttgtgaccttttctttctggcttctttggcttagcatgaagtttatgtggatgacccatgttgcaacatgtgtcagaacttcagtcctttctaaggctgaacaatattgcattctgcagatacaccacatttgtttgtgccttcatttgatgggcgtttgggtagtttccaccttttgactgtcaggaataatgcagctgtgagtgtgtgtggatagtgttagattcggtatctgttttcaactcttttgtgtatgtatttaggagtggaattgttgcgttctgtggtgactctgtttcacttttccaggaactgccaaactgttttccaccacagctgcaccgttttacattcccgccagcactgaatgaggattctcattttcccccatcctagccaacacttgttagtttctgttttttgtttctttgtttcatgatggccagtctatgggtgggaagtggggtctgactgtttattggcatttcctgaataggttttttggtagatgttctttatcaagctgaagatggtctctgcctcatttagtgagtggtttttaatcagaaatggttgttggatttttgtcagatgctttttctgcatcaattgatctgatcatatgattttgtctctttagtctgttgatgtggtagattatatccattgatttttctaatgttgaaccaacattgcagccttggaaaaaataccacttggttgtagtgtataattctttttaaacgttgttagatttgatttgctaataatttgttgtggatttttaagttgtttgctcctgagaggcagtggtatgtcattttcttataatttctttggttttgatgttaggataattccagcttcataaagtgaggaagtgtttcttcttttccaatttctggaataggttgtaaagaattggtgtaatttctcccttaaatgtttggtagaattcaccagtgaaatctatcttccttttactgatttttagtttaattctattgtagtctgagaacatatttttatgatttctatttttaaaatacttgttaaggtgtacttcatagctcagaatgtggtctatctttgtgaatgttctgtgcaagcttgagaagaatgtgtattttgctgtagttggatggaatattctataaatgtcaattctgttgagttgatttatgatgctattcaagtgaactgtccttgttgattttctgtctgcttgttctatcaattactgacaggtcttgaagtctccacttataatagtggatttaccaatttctcatttagaattaaaattctctcagattttgccccatatatttcaattatctgttgttaggtgcatagcctttaaggattgtaacatcctcttaaaaattgatttttctctcattatgtaatgtcgcctctttatccctgataattttccttggttggtagtctgctttgtctgaaattaataatggtactccaacttactttgattagagttagcatggtatacctttctctatccctttacttttaacctaccagtgtctctgcatttaaagtagatatcttgtagatagcatagagttgagacttgtgttttttatccactctgaaaatctctgtttcaatgggtgtgttttgatcattcacatttaaatgattattgaggtacttagattaatatcaaactttttagtaactgtcttctgtacttgccagagacttctttttctctctcctctggtttcaatggaccattttatgtgatgccattttatctcctttcatagtgtatcactcatacttctttttaaaagttttacaatatatgtttacaatatgtatttcaaaataatctaagcccaccttcaaataacactatacctcctcccatttagtacaactaccttataacagaatactcccaaatcctccttcctgtcccttgtgacattgctgttaattatttcaattatccatatgtcataatcatacagtatatcgttaccattattgcagtaaataaatttatttttatatcaaataagagtaaggaaaatagaaaattttatttcactgtcatttattcctttttgaatacctcttttttatgtagatccaagttttcaacctatataatttttcttctgtatgaagaaaaatcttttaacgtttatttcagggtatatattgccagtaatgaattcccttggttttgtttgcctgataaactatttctccttcatttttgaaggatactttttctgaacatagaatgctaggttggtggtttcttctttcaaaattttaaggatttcactccactctctctctctctctttttttttttttttttgagacagagtctcgctctgttgcccaggctggagtgcagtggtgctatctcggctcactgcaagctctgcctcccgggttcatgccattctcctgcctcagcctcctgagtagctgagattacaggcgccagccaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgctttttgttttttttttgttttgttttgttcttagtatttactctatttggtgttctttgagcctccatggtctgtggcttggatctgtcattaattttgaaaatattttggccatcattacctcaaatgattttcttctccattgtctcttttgttcccttttggtattccagttacacgtgtaacatctttgatgttgttccacagttcttggatactttgttctgttcccctccccaacccattattattatttttttatttttatttttttgtagaggtgggactttgccatgttgcccaggctgatcttcaacttgtgagctcaggtgatccccccgcctcagcctcccaaagtgctgggattacaggcatgagccgctgtgcccggtcttcccaccattctttgtgtgcatgtgtgtttcattttgagaagttcttgttgacctgtcttcaggctgattattttcagccatgttgatgagcccgtcaaaggcattcttcatttctgttaataggttccttttgggctgggcgcggtggctcacacctgtaatcccagcactttgggaggccgaggcgggcggatcacctgaggtcgggtgtttgagaccaatctgaccaacatggagaaacccctgtctctattaaaaatacaaaattagccaggcgtgatggcgggcacctgtagtcccagctactcgagaggctggggcaggagaatgacgtgaacctgggaggcggaacttgcagtgagccgagatcactccactgtactccagcctgggcaacagagcgagactccatctaaaaaaaaaaaaaaaaagaaacatgttgtcctttttgtcttctagcatgccttgtaagttatttgaagctagatatgatgtatagggtgatgggaactgaggtaaacaggcctttaacgtgaggttttctgttaatctggctatgggctacgtgtaatgtttgttgtagctgtgagtgccggcgtattccgatccttgcagtgcccttgtttttgtcctctggctctgggcttccctaaattcccttcctcagacagagtgagtgtcgtgcagctctcccagctttcacctgctgttgtacactggagtcctgttggtgtagttgtagggtgtggggagggccagcggtctatagtcttctgattacatctcagtctttctgtggtcccatttccctgggctgtgactgtcacagatgtttcttcttatatagcttttccagaccccaaacaggaggccagagggggctggactcaggaatgcccttcctccgtggctttgcaacaaggttctggtaaagtctttccctgcggggagcaggcctttgtcctagagaaggctctggatgcatttcaccaggatgacgtttgtcctccctctgccagagtcaccaggagatgtctcttgggttttcatggtgagaacctagtagggatcctggaggaaaagcccatgaaagttttgggcccccctaagactgtggcttctaggagtttctcagtcatgggagtccacccttggcctgcagcaatttgtcagaattacccaaactactgtggtatggccctggaggctctgttccaggtcagtggatctttggatttggctgtgtctctagatttcaggggggcgggttgcaaactcaattcactgatgagtccaaagaaggtcattgattttcagtttgtgcaccattttctagtcatgaggatgggagtgatgacttccaagttctttacgtgttggagcggaaactccaatccttcccctgctttgattttcctgttaccctaaccgggaatcatgtttgttatttgatggtttactcagttgtcatctgtcttcctaattaggacataagctccagggaactggagtgtcagtgttcccttgcgtccttgcacccacaagacagcctggcacattctgaatgaatacaccgaaagggataaataacgaggccaagccacctggctatgggtggctgctaatccgtaggatttctcgtgccttgtggtttcagtgaatttgcgacacacatgagtgatgctgccaatgggaggctcccagatgtcctcaacaaatagaggagtgaccactcagatccaagggtgtagcacttcccgcctatcactgggagctgatgggctgtctttagcatggcactttgtatggtgctggcgcccaggcttccctggggcaacagcgttggcccaggcgacacacaagaagaagggggtttttctgtggtcacttccgcgttgctagttgttttgccctcttactgtggctaaaccttctgtccatacctgtcccccattctcagtatttggcttttcggattgcagtagtgggacttgggtgcacattgcaataaaccaatttgcccccattatccatgtcttgttgatggtcccactgccagcatcagttcttatgaacagatttctaaaccatcaccatctgttctgctcttaatttcaagtgtaaaaagtattactttcctaattccgtcaaggggagggagaatatgtattcctaaagaccacagttcttgtatgaggaagtgtagatctgccacccacctactaaaggaaaggttgcttctgcccatcctcaaagctgttgagcagttatttacctagagggtaaaactggcccattcgcatctctataaaaacaggtaggaaaaggtggaaggagctgagttggggaggtggaaggggggcaaaagctatgtctcccgtccctccctgacagtgcagccccccaaccctccagcccccgccagtataggtgggaatgggctggcagggctgcattgtggtggtccctgctgctgctagggctgtttccagaagaaggcccagtttcaggcttgacttcccctcagaagtcataaggaccataaggtccatctgggtgggcgctgagctctccacgatgggagcaggatagacatgagcatcttcaccctcgtggtccctctgagcctgccctgggggtgagctctttttctgctcaaatgaacattccaggcaggccctggagctttctgtcgttctaaggcaatagaaggttctttggttactttcagtcccaggaacattgttggtcagtcatgaaaaggagtaattatagactctttggagcttctcccacccggctggagcctgacctgtcttggagccggctggggagggagggctgtgtgtctccttctttctttctttgcctctgtttttgctggccagggagtgttccgagggatggagtgtctggggagagggcattctctccacaagtgggctgggtggcacttctggggtccagcagatgtttcacttggacttcctgtctccagtgaccctcgggtaggtttcttagagatgaccctgctgggaacttgcagctcttccctgcgacctgtgggaggccttgctgggctgatgcccttgactgctctccctatcctccaccatgcccctcgggagtgctcctgggctgttccttcaaggcggccccaggctggccccacactggtgggagcagcaggcagctcctccttgggcagctcctcctcttcccctgtgaggcagctctggtcatggcctcctgcctctggattctcaggaaactcgggtgccgcgtccgcagacattggggactcggtacagctatcctaggggtctgctagaagccctgtttgggaatcatggtgaagccacctccccagccccctccatgaggcacagcccttcacggaaagtccctgctcctcttctggtaccccgtaggccagaaaccatgctggggtggggagctgggagcatctgttgatgtgggatgcaggcgtgcttgtcacctctcctggccctcagggcagcaggacagcttacatgaacatctcatcccgctgctggtggcctctggtgagagactactccagtcggtccccctgtagctcctggatcttagcgggggcctgggaatgggaggccacaaggaggttccagagctaactaaagccgctgagactcagagggagtctcacgccactgcctcctgtgcccccatcccctagcaaagtgggactgatgagggatgaccttgcgtccttctcccctgttcactgggacctggtgctgttgccaccgtgggcccaaacatccactgcccttttagcaaggcagcgctgctccatagggtccagccggggaagcatctggctttgcacaggtggaagatcatgactatttccagagtctgttgccaggctccatgtagttcaggagttgtttctccctctgagagtccaaagtggttgttttccggagtttggcagtacctaagggttaattgggatgttattgtctgcatttggcttagagataggaaagttttatgtttattcaaattatcagtaatttaaaattacaattttagtcttaattgtacgtatttggagatcccatttaagtctttggaaataattgcagagtaatattttgggaagttatattacaatgcacagacgttcaagtggagaaaggtccctgcgtgtgagccttggcctggcagaggggcatccaggacaggatctacagcacacagccctcccaactgggtctgggcatggctgcagctgagtctagccctcctttctgtgctgctgcatcccaggggatacggccacacaggccacagttgcctagaccgacctggtgtcaggatcactgtctctgctttggtaagatgtccttgggaggggaagggagccagccaatgagatgaggggtaggagggtgacagggtggagcagaccctcatgctggcagaagagaggttcacattcaccagggagcaggtttttctgaaccctggagagctgaggggggcacctggagcacccctgcagtccacagcatggggtgctggcttctgtactgtagtgcagtgccatgaggtacccatcccttgcagtggggtagggtttaaaacccagaaggcagccctccctggagcacagccccatggtgtttagagaccctctcctctgagcacatgcaggatgtgacaatgcaggtgggcctagtgctgcagtctcagagacacccatgggcttctgccatgctttttatccaccagggcagtaaaagcaacgtccacagtggcttagcctcctgcaaagcctgtggcaggacagccagggttccctgacagtggagatggtggacggccccatagggggttggtcccatctcgccagcagaagtgacctgtgtggccttagtggtcagtgctgcctattgtgatagtggattgtttaaagccaggtcccatcgtggctcctgagggaatgaaaatgaggggttctttgctgtgatctgatgcttgtgttccaccaaatccatattttggaattcttatccccaaagtgatgggacctttgggagggagacattggaattcacattcccaaggagatggggccttatggaggtgtcttaatctgtattctgctgctgaaacagaataccacagattgggtaatttataatgaacagaacattatttggctcagagttctaggggctgggaagtccaaggttgagggttgcatctgctgagggccttcttgctgcgtcctaacatggtggaaggcatcatatagtgagcgagagagggaagggggccaaactcattgttttattaggaacctgctcctcagtcactaacccactctcgcgataatggcattaatacattcatgagggtagagctttcaggacctaatcacctcttaaaggtctcacttctcaacattgttgcatcggggattaggtttccaacacatgaactttgggggggcacattccaactatagcagtgggtgatcaggtcctgatggtgaagccctcataatgggatcaatgccgttttaaaagaggctgcagagagagcctcccgccctccaccatgtgaggacagagtgagaagctgccgtctctgagccatcacgcaggtactcaccaggcacggaatctgctggctctctggtcttggacttcccagcctcctgaactgagacaagccactttctgtcatgtataatctacccagtttatggtattttgtgagagtaccctgaatggaataagactcccttcaaacaaatgtcctgctctttgaaagagagtgtggggctcacagtctgctagtaaagacagttgtaggagcaatggcaagcccacactggctcggattttcagaccttatcattgagttaggagcgaagtcctcgacctgaggttttattggtccaaagtcagggcctgctggagcccgacaggttgcgtgcttggcctgtggagcagttttctccagagcacctctatcccctctgccttgtgccaggcccagcagggactgagggtagaataatgacaggcacagctcctcccctcaaagagtccactatctggggtttgatgctggagcgcaaggaggggctgcccacatgggcggagcagagggcctggggaagttccaggaagaagtgactgtgtgccgaggctgcaggagtagaggcagcccaggagaaaggggggcatgggctggaggtgggggtggttccaggcagagagagcagcttgcacacgggaaaacaaggcatggagtgggcagctccttccgcctggtctctaaacctgtgaagagggggctggggagaagagacgggggtggaggagagcaggactcacaggccagccagccctccacagccttgggaacagagtgaagagcttggactgtgtcctatgtcctggggccggtgccactgcaggctttggagccaggagggactcagtggagcttgctgtgtatgattgtgagtgtggggaatggtttggggtgggaggcaggacaagcagctgtggactcctgtctgcaggtgagtgccagggctcagtgtgggttctgattgggctaagtaggtgcccatctgcctggagtccagctgtccttgtgtggtctgtagaccttgttgtcaaggtctggcagctcaacgctggtctttctgagataatgaaaagggaaaactttagaggcaggacgaagaccttgtagtgaccagtgacatccccacagggtctaggtgtgcgaggtctattggcgcctgtgtgggaaggcgggaaaccaggggcttggggccagctacaaatgccacactgggctctgccttggctctaggtgctttggttgctggatttggtggtggctcagggcagtcacttgtcattctcagtattttatcccctggggcctcctcagagccataggagatggttcacctctgaaggactgccccatgctgtgcttggtaagctcggtcacccagggctgtcacagagatgggctatggcccacatgggctgagcggatttctgccctgccacctacaccttgctgtgattactttggcagtgtttccccgtcaggagagcaggtgggaagggaggcaggtccctgaactgggatagagcccggagacctgggtgtcctctgctctgttgtactgacacgctgcgtgcttatgaaatgagggcaggggttctcagtgctcccatggcatggtgactataatccatgaatgatgcccacacagttcctggcatgctcagtgtagccttgttgttgtaagagaaaaaagcagggattctccacttccccacagagtgaactggaacgaggagagactggtatttctccaacactaggtttctttggatttttatgctggttgatactccctaaatcacaggtcgccttaaagagagcaagagccctgcacggtggcccggacccttggggccccttccatccgatgcacctcgtggcccagtctttacctgctcaccatgcacagcacttcgcatgggtttggaaacgtgtcatctgcatggcaaggatgggaatggggagtgggaacctgcagtttagggtccaggcgggtggattttaatttgcccctgggggattctagggccagcagagctcactgccgctgctgtctgggcctccaggcagtgagctgctgggggagcccctctggaaatggacagtggctgtcagggcgtaggacgctagggggcgaacagaggaagtagaggtatctggggctgaagttcaaggttgcagcatgaagttcagggttgcagcgcccagcctagcagggcagggttcaatctgcaggactggcatgaggaggcagaggagtcagccaagccctcccctcagcctctctccagacactacagatccaaggccaggtctgcatgaggacagccacctggtctcggctgaggttacaggaagggagtcggggcaagggccagtgagtttgttcctaatttgggtcccctaattgtccaagagaagaagaaaaggcctaatttctgtttcgctaagttttagactactttagttcatgttctttaacaataggttattcatgcagagctcatctctattaatcaaaatgtatgattaggcagaaagccctattcccacaccagagtggtgaaatgcagtgcatgtgtgttcagatcaatttttgaagtcttgattttgttttgttacatgtttatttgattgcttgcagaagaatgaagttttttggccctctggaaaatttttctttctcctgagaggttttccaatctagtagaaaatagacgcagagtttggcttgcactgattgcggcattagaagcggccctgtacattttaatgtggaagacgtgatggttttgcgtttgctcctccagttgtgccccatagctgtctttctgccagctctcttgcacatttagttcttgagtgagatgttctaaatagaagccatggtccattcagtccccagcctgctgtccttctgtgacccgccagccagctttgcttagggagctatgagcccctcctactaggctacaaagtcatgggcaggaaaagcatttgtgcacagccaggagcagagcacccaggcccaggtctgtcccggagccatgtggacctggcgaatggctgttcaggtcagaagggggtttggatacaccggttctgtgtttcggaggccagcgtagtccccagtgtatttcgcagaagtgatagcagctttattcccaaggcactagtgcctgcgcgttaggcacgtgctgggtgcctgcttgagtgtctcctttgttcctctctatcactggctgtcccctgcagaggcaagcgaggcagagagttggctggtaacagccagtgtccgcagagccccagggctccctgactgggctgtgccacctggggacaggcagatagaccccaagtaaagttaaagggaagcacagtggggcctgcacaggatgtgagttggaggctctggtgaaactgagacttggtgggggatgggaggcaggggccctgctgggacagacaggagaccaggggccagtggcagaaatggtcctcgatctaccctcatgcagatggtggcctctaccgggagccctgtgtgtctctgagccttagtctccctccctccagtctgcgaaatgggcataatagaaatgatgcctctcactaataaatctgtgcagaaagagaaagcagtttgcaactgcaaagcattattcaggtcttcctggctctacctccaggatcgtatgcctccgctctctcacgagacacaggcctcccatgtgcccggtggtggtctcgaggtcatctgagccatcatccacccctctataccggggacagtgtgctgccaggaggggcaccagaagaggtgtcatacagtggcatgctgagctaggatttgaggcacttcctgcctcttctagttccttgtgggccgggggtgctttgctcagatggtgctggggaggaagggcaatatctaaggatgtattgagagggtcacattcaggtgtgccatcttctgagggacagaaccctgtcacgacagttttgccgtgactgaattcccacattgcagagtgcgcttggggtgtggctctgaacatcgctggcaggtcaggtggagcctcgctgctctggggagctgtgcccaggttccctcggttcctgaagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacagagttttgctctgtagcccaggctggagtgcaggggtgcaatcttggctcactgcaccctccacctccctgttcaagcgattttcatgtctctgcctcttaagtagctgggactacaagaggtacgccacctcgcctggctaatttttgtatttttagtagagatggggtttcaccacattgtccaggctggtctcaaactcctggcctcaagtgatctgcctgcctaggcctcccaaagtgctggaatcacaggcatgagccaccgcacctggcctacatgtggtattttaatataagcatatacattattaattgtggcaaagtacacataacataaaataccatcttaatcattttaagtgtatagttcggtggaattaagtacatcaacattgttttgcagtcatcaccatcagctatctccaaaacgttttcatcttcccaaaacttaaattgtgcgcatgaaacagtacctctcctttcccccttcctccagcccctcccagccaccactctactttccctctgtctgaattcacctctctaggtacctcatgtaagtggaatcgtgcagtatttgttcttttgtgactgtcttatttcacttcgcatggtgtccgtaggggtcctgcacgttgtggcatgcgtcagaattgcttccttttttagtgctgaataacactccattgcgggaatatgccacattttgttgatctgttcttctgctgctggacacgtgggttggttccgccatttggattgtggataatgctgctgtgaacaggggtgtacagatgtctccctgagtcccttctttcagttcttttgggatatacccagaagtggaattactggaccatatggtagctctttttaaaattttttgaagtgccatactattttccacagcagctgcacccatttacatttctattatgccaacagtgtacaagggctccaatttctccacatcctcaccagcacttgtgttttcattttttttgtttttcttttctttcttcttccttttttaaatggtactatcccaacaagcgtgatagcaggaatttgcttttaattacagctacttctggcctcacgagacgtctttcagaggaatgtagtgtgatctcaccttggaaacgagagctgcctcaaggcagtggtgcatgcggtgctgacaggtgccaagggtcactgccttccccatggacatctgggctgtgctgcagtgcccctgtgggtgcagcagggcccctagggtgcctccgtgcagcttgggagccatggaactagacagtgtgcttcagacgagtagataagcacagaaacagagccgtaaggactggggggaacgtccagtccatagttctgtgtggaaccacgatccacggaggcagctgaggggcaagtgtagtgtacgtggctgtgcgctccatctccgtgcttacagccctacaaagtgggaagagaatggaagaaacaggagagaaaaagtcccgtgtggtttcccggaatcctgtgggtagtgagagtctcagcattgttattcctagcatgttttgtgtgtaacgtgagatgaagcaaatgattactgatgtgatcttttaactctgaggaccttgaccaggattttcagtggcgaggagaaaggagatacggaggaaaggtgctgcgggttaagaaagcctcgggaggctgggcgtggtggctcacgcctgtaatcccagcactttgggaggccgaggcaggtggatcatgaggtcaggagatcgagaccatcctggctaacacagtgaaaccccgtctctactaaaaatacaaaaaaaaaaaaaaaaaaaaaaaaaaaaaaatagcggggcgtggtggcaggcacctgtagtcccagctactccgaaggctgagacaggagaatggagaatggcgtgaacccgggtgaacccgggaggtggagcttgcagtgagccgagatcacgccactgcactccagcctgggtgacagagcgagactctgtatcaaaaaaaaagaaaaaaaaaaaagaaaagaaaaagaaaaacaaagcctctggaatccggaactacaaatccataagtagccctagagcgttccctggagaggcctggaatcagtggccaaaccaatcacacggagcacccccagtcccgggtcatgtcttgaaattcagttttctgctgaaagaagctgagactacttggacaaatggttgataccgggttgggggcgggaaatgtacaagttgaacctaaatgctttgtcatagcagataataaaggagccaccctggactgtgaggatgtgattctgctgagagagagcattaaaagaggaaaaaaactattaaagtcaaagtccacgaggatagtgttaaaaggactcgtgagctcacctgatgaggccagagatggacaatttgaacatcagtaagagtaaaaatcacagtaggttgaaatgtatgcagtatgtttaagtccatgagtttttttaacaatactcaggaaataaacctaatccgtcacctttggagaatgctagggaaccaattatatatttttggtaaataagggaaagctctgaaatatatatcctgcttttcttatgcaggccgcactactgggtgagcaggtggcaggttgggaggttccatgtatagaggatggaacctctgtgtctgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaaaaaaaaaaaaaaaaaaaagaggtggaagcacaaccaacggttaaaggggacataaaaggcacacatagtgtgtgtgtagggacatgtgctacatggagcagggtggggctatgattaccctacaaccaggatgtggtcaggggcacacagggaggctgggtcccgagggctggagtggccggtagggcccctcttcttccctgcctgaggattgtaaaggttgtttcatagccgttttgtttgtttatttatttatttatttatttagagatggagtctcgctctttcgcccaggctggagcgcagtggcgcgatctcagctcaccgcaagctccgcctcccgggttcacaccattctcctgcctcagcctcccgagtagctgggactacaggtgcccgccaccacgcctggctaattttgttttgtatttttagtagagacacggtttgaccgtgttagccaggatggtctcgatctcctgatctcgtgatccgcccgcctcagcctcctaaagtgctgggattacaggcgtgagccactgcgcctggcctcatagccatttattaagctaaatatttacactatgttttctaaaaaagtaaaattattttaacaacataaaagtcaaaggaagaagttcctggaagtggtcttgaaggtgcaagtgggcaattgtgaacagtctgctggtgcaggatgtggcgcttcgtcgtgggagtgctgtctccctccactgtgggccgcgctccttcctgcagcactcgcagctcactgctgccatttcccgtgtaatcctgtcttctgtcttgactcagacccactcgtatctttgttgtctggggtctgcgctttactaggggaccttggagttctgttgttggctgtgacttcattccatgttctttcccataaggaactgtgttgggaatagtttgatgattccatggtcatgccttttggccttttctgtgaggggcgaatggggagcacatggaacttattgctgctgtcttcagtatttcttgggggaggaactcggtgtggttttttccagcctgagcccaccctgaggtcggttgttggacccacctgcctgatgcagactgccagggtcttcctgccagcgcgggatcccccactttccatttcctcttgcaaccatcagacccagggacacatgtgtggctccttctccagtaagcgacctgggaggtatccttaccccaggacccgagtgagcgtctgttggagactcccaggtgtgcaggccagaaggacatgcccagttgtgtggctgcctcttccctgcagggagagagagaaggctggcgtggggcttctccccgggctgggcctgcgttgtccccgaggcccgtggccgctggagcagcccctgagcgactctgctccttcctgggcctcggtttcctcgttctcagggggggcttctgccagactgtctgggagatgttttcagccctctaatttgtgcatgctgtgactcacccaaaattacagagcaaagctaatggaatcaggaatttataaatcccccttccttcctcacgcggttccttgagtttttgaaaactaccattcagaatgagacagtggccttctacctgaggccacagggttgtctgtggcctaactgatttctggccagtcaggctgggtgagcctcaacagcgtgaacatactaaaggcttcttccttgccctgggacaccggttctggccaggctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagtacatgatgcctacagtgttctgggcctcctccatcaggaatcatgggcccttctccccaggacgctcatcgatggccccggctcctccagccctggctcctccagccctggctcctccagccctggcccctccttgggctgtggctgcaccctgggctccacccattccagacccaaaggcccatgggccaaccagacaccgcccctacatggtgtgcccacaggctcttatggatcccagagggccccctttgtcctgcttggggaggctggggtggccgctacacagtgccctgccgtggcccccatgctccccaactccctactgtgtctgctggacgtttgaacagcctcctgccctaaaccttgcatcctgccacctctggcccactctccaccctggcctactcttcaccctggcccactctccactctgcagccaagtgatcttttccagcagcacatgtgactgagtattgctgatggctgcgactgctttcaggatcaaattgtgtctcttccgaaagagacatcagataagagacattggaaaagaacatgaattgcggtcacccagagctctttcgcggtttgggattaagccatgcagaaaggtgtgcaggagcctagatcacctgccaacctgcctcttgccatcctctattttgtacgctcagtcaccccagaaaattgctccggcccttggatttacctccgtgtcactgtccatccggtaccctctgcctgggatgcctcctgggtctccatcacccgcctcactcgtttttcctctgcacatggcatctacttccgcccttccgcaggacaccttcccaggctgggtctggaccaccctgcggactcgctcctcgcaatactggccacatgccctcaagcccatctgtttcttagagtcgatgtcccctaaggtgtgagttcctggtgagcaggagaacctgtgccttttataacctggtgtgctgctcggcgtgccgaaggaaccaaggcgatgttgagaaatgaatggaacagctgtactgtgcagagatacgtgcagagaggggcaggaggaagcctccacttcagacttcagtgtgaaaaagagacactggaaaagaacatgaaatgtggttgcccgatgctcctttgtggtttgggatgaagccctgcagaaaggtccgggcagcactgcagccccgccatgctgcttgccccacgtgggttctggagtctggtggcacctggaagagcaggtggagtggaagctgctagaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagccacacaggaggtgcagcagagcatgcggagatccacctggcaactcacagccagccgcggcgtcactgtcaggactctgtgaaaaacaaggtttctgtttggcgcggggacgaccagagggaaggagactggtagagcctaagtattcagccgaccattaaaaagtgaaagtcagaagcaatgtaagtcaaaactcaggacatctcagggtgaccttggccactcacagttgttcgtgtttgaaatcacattgattctcgcagctgtccaaggcgcaggaaataaccactctgggtgatgtcgttgggatggttttgtcagcactcaggatttgggggtttgttatgaaaatttcacgttacaaaaaagggagaagtgcagttttgtgtgtttagggttattggtggctagacatctgaaaatcaggatccccgctcattgattttttttttttttttgagatggagtcttgctctgttgcccaggctagagtgcagtggccaatcttggttcactgcaacctcggcctcccaagttcaagcgattctcctgcctcagcctcctgagtaactgggattacaggcgcctgccccccgcctggctaatttttgtatttttagtagagacagggttttaacatgttagccaggctggtaactcctgacctcaggtgatcagcctacctcggcctcccaaagtgctgggattacaggcggtgccgctccttacattttgttgctgttcccaggaagattgatggagggaaaacacactctccacagaggagatcctgtgtttacagccgtcttagatagagtcgtgatgaggaggaggactctgggccgacagtgtatgagggttccgcctcataaggctgtttggtgtttgtgcccacactgggtgtgacgggttgaagcagtggataacaagcctattactgttatgcaaatgtgggcggcccagttgcattcttcatgcatgtgtctctccctaatgagtttcaaaatcttaatttagatcttgattttgttgcagataggattccaatttaaagagcgtttgtcattcagagactgtggtagacaggaaaatggtcttcagagatatccacaccctagctgtggcgcctgtaaatctgttactttatgtgacagaaaggactttgcagatctgattaagttatggatcttgagatggagagattattctggattattcaggtgggcccttataatcatggtgacccttataagaaggaagctggaggagttaattgtcagaggagaaggtgctgtgacgatggaagtggagattgaagtgatgcactttgaagatggaggaagcggctgcaagccaaggaatgcaggtggcttctagaagccagaaaaggcaaggaaacagattcttgcctagagcctccgtaaagaaccaggccagtcgacaccatgaccttagcccaaggagacctgcgtgggattcctttctttttattttctttcttttcttttcttttttttgagacaggatcttgctctgtcatccaggctggagtgcagtggcgccatctcagctcactgcaacctccacctcttaggttcaagccattttcgtgcctcaaccacccatgtagctgggatacaggcacatgccaccatgtctggctaatttttgcatttttttgtaaagataaggtcttgctatattgcctaggctgttcttgaactcctgggctcaagggatccacctgcctcagcctcgccaagtgctgggattataggcgtgagccactgcactcagccctctgtgggatttctgaactatagaactgtaagagagcaagttggtgttgtctgaagtcactagatttatggtgacttgtcacagcagccataggaagctaacacagagactcagggaccaagcctttccattgcagcaagattgatcagttgttctctcccatcacggggctctcattttgctcaagtcctatgtcatcgtccctcttttcctggagagcaggagctgacttcagacgccagatcttcttttcctgccacagcgcacttgcagctcttgggaggtgaaggttctgcctgctgctcttctggaatgataaacgctgggcccttagtggaaatgtcaggtgaaatggaaggcagctccttgggtgcagtgacaggacctgcagtgggcctgttggagctggcactgagggctgctccccatccctctgtgggtgtattggctgcatgctgactggccgtcctcgtgggcgtggcctggtgtgtgtgcaggtggacagaggctggagtatccttgagaggctgtgcgttctctcggcttcttttggagccagagccatcagggagccatcacctgtcctggcctgacctgtcctgtcatgagtgctgtgttccttgagctgcctctcaggctaggggatgaggtggctgtgctcaggcctggcttctgcaggcttcttcctatctttggagcggctccaccactggaatctgtgacatgagaggcccgtagcccaggcccatcatctagaatggagaggcagccccacagcctcctgggaaccagagctccttgcctgggtcatcacagaactaagccttaaaatcaggaggcctcagcaaagcgcctctagagactcaaaccaccttgtaaatctcactgggagtgaacgattgactttttactcagtaccaggactacatactacctcatttatgggtttttcctctaaattgctaatgtttgaagtggaaattttcaaaactgactaatgtctctgcttcaagatttgctgtcaggcaacttatttataaataaagcagcttttcaaggagcactaacaaacaatccctcgtgttaggagactcagagccaagtcgtggctctaggttggccttgcagggtgttagggagccagttctccaccccagggccatggacttctgggtccttgcaccatccagagaggtgatgatgtggttattcccatgtatagagtctactgttttcagggggcatttgcatctgtggtttcattagatgttcagagcatccccacaggggttagttcatgtagagaaggaatcagaggctcacagaggttcagggtttgctgggtcaccagctcctaagaggggccctttgggctgaggccacggcgctttctttcttgcaagacagaaattttccttttcctttctttgccataatggccacctccttccaccccatatccttcttccctttggccactggtgagttctgattatttttggaaaaaaaaaaaaattaaaactctgggagcttgagactgaggtaaagtcccctttcgtagagatttttggactgacatgttagctctctgccctgtgtaacttcagagtttggtaggtgatggggacacgcctgttggagagtcctggtgtgtccagttttgtccccgcagcttcactggctgtcagagccacagcctttgcttacggctacgccctggaatatttaacagcaatttcttttcgctttcttctgtcgtgttctgtctgtgtcagtgttttgtggtcttactgtacctgttgttttattataggcagatactgtaaacgctgatacagtctgtgccctgcggttgtggtttttagggccttgcggcggcatctttgctagtgctcactgcaaataggggcaggaagcagttgtttgggaatgagccacatggtggaatatcttgaatgtcccaggccaggcacagagcagctgctcagtaaatgttgctgagtgagaggctggggggttggtgaggataggcaggggtgggcgtccaaggctgcagagttgtaaagcggggggtggggcagccagcaagtccagctcgaggaaacaccacggggttcaggggctctgtgtaagaaatggcagaggtttggcttcgcttttagttgttttgtttcttgttcaagtgaggagaacacaccgagaagggaggagagcaaggctggctgagcgtcatggcagggtggtaaaggaatcaatcacccggacaggttgtccgttcatgtgccgttgtttgcattgctgtgatacagactgctgtgccactgaaaccttccgaaaagcaagccacccagagagtgacttgggcaggtgtgtattcatgtgtgcatcagggagaggaatacttgcaaggagcagagcttccagaagaccaagattcagtggaggcagcaagtcagggccgggcagaagcccctggggtatctgcggaagagcactttccagggtgcatggatggatgcgttaaccagccagttcctacgcatcacggaggagaggtgcctgccctcctgggagccgtgcctattccattgcttctgttgtttttttgagacagggtctcactctgtcacccaggctggagtgcagtggcacgatttcagctcactgcagcctctgcctcccaggctcaagcgatcctcccacctcagcctcccaattagatgggacttcaggtgagcaccaccatgcctggctaatttttaaatgttttgtagaaacggggtctcactgtattgcccagactgttctcgaactcctgggctcaagtgatcctcatgcctccacctcccaaagtgctgggatttcaggcgtgagttaccacacccggcctcttgttgttgttagtaaacttttaattctagaacagctttaaagttataaaaaagttgcaaagactgcagagaattcccatgcttgcttcctccagtcttctctctcgttaacatcttacatcacacggtgcatttggcataactgaggaaccaacgtgggtccattgctatgaactaaactctgcagtttattccaatttccttagtttttgcttaatgttttttttctgtcccaggagcctgtccaggccactacgttacctatagtccttgcgtctccttagcctcctctggtctgtgacagtttttcagctttccttgtttttaatgaccttgatagttttcaagagtacaggtctttgtgaatatccttcgatttgggtttatctgctgttcttctcatggttagactggagttatgggtttgggggaggaaaaccacagaagcgaagcaccattttcaacatacatcaatgttgcatgatatcaatatgactcataactatcgatgttgaccccgatcagctggctgaggtagcatgtgccagttgctcactgtaagattaccccaccttcagcggggtgcggtggctcatgcctgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaatatttctgtatgggggacttatctattctcccccatttatttattcaaacatttacatcaatatggatttgtggatatataatttataccttgctttataatccagtgctgtgttatttattttattgctcaaactgtcccagctttgactatatgaagctctttcaggtggcatcccatgtcccttagagagatccctacctttttgtttttttgagtacagtcagttggccatatccgtgagttctgcatctgtggattcaaccaaccttagatgggaaatatctgggagaaaaatagatggttgcatctctactgaacagactttttgtcttgtcatcattccttaaacaatacagtataacaacgatttatatagcatttacattgtactaggtattataaataatctagaaaggatttaaaatatattgaagaatgtgcataggttatatgcagattctacaccattttatagaagggacttgagcattgaggattatggtatctacaggggggcctagataaccaatcccttacagatacccaaagaaaactgtacctctttctggcacaagatactcaggctcatcttgaatttttcctacccagtcctggactcagctatttctgcaaggatccctgccttattttattgaagaatggtatctagaaaccaaggtctggagacagggttcttcttgtcaccgaggtacattgcttccaggccctctcagcagacagagctaggaaatatgcatgtatgctaatctgtgtatacatatgtatctcccatagtttttttttatttttttattttttgagacaaagccttgctctgttgccaggctggagtgcagtggcacgatctccactcactgcaacctccgcctcccaaattcaagcaactttcccgcctcagcctccctagtagctgggactacaggcgtgtgccaccacacccagctaatttttgtacttttagtagacagagtttcaccatgttggccaggatggtcttgatctcttgacctcatgatccatccgccttggcctcccaaagtgctgggattacaggcgtgagcccactgcactcagccttttttttttttttttttttttttttaagacagagtctccctctgttgctcaagctggagtgaatggcacaatcttgtctcactgtaatctccacctcatgggttcaagggattctcttgcctcagcctcctgagtagctgggattataggcatgcaccaccacgcctggctaatttttgtgtcccatagcttttttttgaatgcacgaccccatctggcggcgaagccctggacctagccttctgatcactcatgggaaccatgaccacgtgtcacatagtagaaaggaaaacttggacaacttactgtgtagacaggagcagcaacaacaaaaaagacttggaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccctccttattttagcaccagatgctgcctctcagcttcacgctgccctccagcagcattgcctgtggtccatgggatcttggccttcacactcagcattgaaacagctgccttccgctcccatcataggaaagagaacagaagtctcttgctcccactccccccgccccaccccctgctgctggcctatttctgtgctttgttttgctgtagaacttctggaaagagttgtctgcagtggctttctccatttcctcccttcccgttctctcttatacccgctccagtcggacttttgccccttccacagacacctctcctgacacttttgaccccatcacttagagatcaagatctgtaagactccaagtctccagatccagtggtcagctctcggtcccttcccatgtgactgaccagcagtgtttgccacagtcgtcccctctaggaaacaccttcttcccttggcttgtggggcactctgtgcttgggattttcttcctgcttcactggactttgctcagtccccttactgacccgtgagtgtcagagtgtccctgcggtcagtccatgcccctcttctccgctcggtccacactcccaccatggttgacctcattccgacttgtggcacaaggagctcacatttatcttttagctctgatttctcttctgacctccagactgtacaccctgttgctcacccagcgctttcccttagagttctaattgacgtccccacacaacaggcaccaagctgtccctggccatctcaaccccaatctccacatctcagtaaatggcagctccatgcttccggacacctagaccatagacttggagccaaccttgactcctgtctctcttaaaccccacatggaatctgttccgtaagctgcccatggtcacaccggcaccgctgccgtgcgatgagagcctgtcatctccttgctagattgctgtgccagtttcctgatggttcctgtttccacactgactgcataccttcccacccaagtctgtgtctgctcagcagctggtttattgcatacaaacttaaatgagaatgctcctccgaccagagctctccgttccctggccatcccattaagagtaaatgctggaagcccctcctcaactgactttatttcttaaaactctatcctgcaaaatcctgcctggctaataactttatcaccttcttcgtgttggttccaacgttcccttctgcaggtggcttctgcggactttggtactggcccacatccctgagctggtaaccccccaccatgcacaggcacccccacattaattctgtagcttatttgtttattgttgtctgtgccactccagacaggaagcctgtgggggttgggggcttggtctgccttcttcagccctgggctcacagtcctgacatcttcttgaagacggcgctcacggtcaggctgcagcaaattcacagttgacatctaggagtgagggcctcctgccatgctgcactctggcctctcacctgcctcctgctagtcctgggcacacctggaggacaatcagggaatttctttccccatctgctttggcatcctccaaacctgggaacctttctaacacctgactgcttggtgaccatgtgtgtgctctgtggatttctgtccaggagggtccctcactctggccctcagggccatgtgcatgtggacaccgactggtagggttggtttcctatgcagagagcagggccagaggcatagccggcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagcttatttaaattaccccaggaggaacatcagctctgttcaagaaatgttattgtagttgctcacctgctttgttcagggaaatgcatcttttgtgggatttcttctgagtaattaagagggtctaagaagccagttttatagtcatttatttaactgtagagaacaatgaagttaaacacaaaagctggttccatctgcaggaacatatgagtgatttgcattagaaagggtgttcatcaaagctcctcccaggtgcctagggaggcatggggggccttggtgggttccctgagggtcgggccaaggccttgggccagggagcacagttccattgcactgggtgtgttggggcagaaccttgtgcttggaggtaggtgttgcttctggccctcggttgcttgctcctgcaggcagggccgtggacccgtagctcagcaaccatggaggagctgtgagaaatgcacagtctcaggccccaccctggctctgctgacttggaacctgcatgttaacgagactgggggtttgtatgcacatcacatccggtccagctctggcctgaggactccggtctgtggtttctagtttttatcatccagctggtcatcctcagcagtagagaatgtggttggttaccatgtgcagggcagcctgctatgtgctgtggtaacagaagggtggggcagagccctcctagccctcccagccctctggggcttgctgtctctagggcaggcaggggctggcatatgcagttgtacaccatggtgttttacaaagcacgagtgccatggaccccatgggtgggctggattgagatgcaaggagggaaaacagatggggtggggtcccaagcaggaggaactgcatgaggaaaggcgtggaggctggacagatgcagaggcagtcagggaatagccagtgtcagaatggagcaggcgacagccgggttttggaggctttcagtcccacgtttagatatttggactttatccagtgggtcatggaagctactataaactttttaaaattaaatactattttatttaaaaaattgtgtaaaatacacataacataggattcaccttctggaaccatgtttaagtgtagagctcagtcgcattaagtacatttacacggttgtgcaaccatcaccccatccacctccagagctctcctcaccctgcaaaactgaaactctgtccccattaaacacttaactcccattcctcctcccctcaccccctggcacccaccattgtactttctgtctatgattttgacgacttcaggtgcctcgtatgagagcaattgtataggatttatattttgtgactggcatatttcactctcaacgtcctcacggtgcacacacgtcgtagtgtagcacgtgtcacagtctccttgtctgttaaggtcgaggaatacttccttgtatgaatagaccacattttgttgatcgttcatctggtgaaggatgcttgggttgcttttacctcttggctgttgtgaatcatgctgctgtgaacatgggggtacaatctctttgagctcttgttttctttttctttttttttctttttcttttgagatggagtctcgttctgtcacccaggctggagtgcagtggtgcaatctcagctcactgcaagctccgcctcccgggttcacgccattctcctgcctcagcctcccgagtagctgggactacaggcgcccgccaccgtgcctggctaatttttttaagtatttttagtagagacggggtttcactgtgttagccacgatggtctcaatctcctgacctcgtgatccgcccgcctcggcctcccaaagtgctgggattgattacaggcgtgagctactgcgcccggcctgagctcttgttttcacttccttcgggcatacccccagaagtggagtcattcctagatcatatggtgattctatttttaatgttttaaggatagcattttccaaaggggctgcacaccattttacattcctacccaccgtgtacaagggttccagttttctccacatcctcaccaacacttgttattttctggtttttcaatcgtggccaccctgatgggagtggggtagcagctctctgtggtttggatggcgttttcctgatgcacgatggtgtggagcacctctcctgtgtgggagcactgtggcctggtgagcaggggctctgtggtggggaggcgcgtgccgagggctgtaggagagggcgacgggtggtgctgtgcatcaggttcggggtgatgggaacgctgtctcttgcacctgcacatcaggcctcccccatgctactttggtggcttctgtgggagcacaatatgtccagggtgccatccccaaggcagaagggagcaccatctggtttgatgtgtggcctgtacttcaccaagcccaccacatttggcctatgactgtgtcctgctgcgactgggttgaagtcagaggagccgagacaggcgggggagcatttggaggacgtgtcccttgctgtggtgtctttgcagaagtggccagcacttgcactgcccagtagtattttcgatgctcctgggaacatgagaggattgcactctctgctttctcaaagttagataagaccatgtgccttgcttcagccaatgacatgtaagcagaagtgacttgtgggtagaagctggaagggactttctatgctgtcctttctccagtcacatcggtcctagaagcacatgcctaggaggaggggccataatagcaacgtggctgttatttgctttggactcacagtggactttgagtgagcaagacagaaaccattactgggcccaggccctgtggcgtgggagctgtttgttgtcacagcacagcctagcctgtcctcactgatccaggaggaacctgaaaagtattttaagtgcacagataggtgaagatgaaagtgtagcgttttgggataattctgcatgcttcttagtatctccagcagtttcgagatttggcgaaggggctgaacttttctgtaggtaaatctcttgctgaagagttcattatcagctggtaatggcttcattttgtcagcggcacagagctctggcttgtgcgtgtctgaggcctgtccccactggggcagggaggtaatgagaactcatgaaccctgcatctctgcctggctttaacagcctctgtgttttccagtgcttatcaaatccagagctgtttacatttcaggagacaacttcagactctgtggacctcattatacttccaaagcaggagggtcgttgtttttaagcattattcccaacttttttttttttgactgcagaaatgcctttttaatatcagaaaatttccaagttttccttacttggctatagtcttgtttttagtactgctttggtggttcagtaactattcattaaacaaatctcttcattttaagtttatttcttctatagggctcttctcttctcttctgttctcttctcttctttttgatacagaatctccctctgtcgccaggctggagtgcagtggtgcgaccttggttcactgcaacctccacctcctgggttaaagctattctcctgcctcagtctcccgagtagctgggactgcaggtgcatgccgccatgcccagctaatttttgtatttttagtggagacggggtttcaccatgttggccaggacggtcttgatctcttgacctcatgatccacctgcctcggcctcccaaagtgctgggattacaggcatgagcctccgcattcaaatatatgtaaaaacggagagaattgtgatccctgaaaattcatgtgttgaaatcttcacccccaggacctcagaatgtgactgtatttggagagagggtctttgaagaggtaactgagttaaaatgatatcatcaaggtagcttaatccaatctgactgatgttcttgtaagaagagattcagacacagacaggcacagacggatggccgtgtacatacatggcggaagacagccgtatgtgagccaaggagcgaggcctcctgagaaaccagccctgctgacaccataatctcgacttccagtcgccagaactggaagaaaatacatttctgttggttaagtcccctagcctgtggtactttgtgatagcattcctagaaaactaatacagtgcctgtgtgctattgttcagtgtcagcagttccagtttttaagcaatcttcatggactgctcccgaagttcagggagcatggggcctatagcagagaactaggcagcacctgcccttgtgaaactgacactctacggaaactggaaaaattcatgaggacaagcttcagttaacaacactttgaggctgggtgtgggagcttgagcctgtaatcccagcacttcgggaggccgaggcaggtggatcacttgaacccaggaatttgagagcagcctgggcaacatggtgaaacgccatctctactaaaaatacaaacaattagctgggcctggtggcagttgcctgtggtcccagctacttgggaggctgaggtgggaggattgcttgagcccaggaggcggaggttacagtgagctgagattgcaccactgcacttcagtcagcccaggtgacagagtgagaccttgtttcaaaaaaaaaaaaaaaaaaaagacactttgagactgggcgaagtggctcgtgcctgtaatcccagcagttcaggaagcagaggcaggagtactgcttgaggccaggagttcaaaaccagcctgagcaacacagcaagacccctgtctccacaaaaaatatattaaaattagctgggtgtggtggtggatgcctgtagtcccagctacttagaggctgaggcaggaggattgcctgagcctgagaggttgaggctgcagtaagctatgatcatgccactgtattccagtctgggtgataaagcaagaccttgtctcaaaaaaaaaaaaaagagcactttgaattctcataatcataatcatatgacatctgtctaccttagaaaccctcgctggtgggtggtcacacataatgctggtggtctgcggggggcagatggactctcacaccctcctaggttcccctttaggaactgaggcttcaggtatgggaagggtttgtggaataaatggatgaaaatggaatgagaagctttgcccacgtcagagccaacctatcatgtggaccaggattcagaccacccctgggagaggaaccaggatgcacccatcattctttttttttttttttttgagacggagtgtcacactgtcacccaggctggagtgcagtggtgtgatctcggctcgccgcaacctccgcctcccaggttcaaatgattctcctgcctcagcctcccgagtagctgggattacaggcgtgcaccaccatgcctggctaattttgtatttttagtagagacagggtttctccatgttggtcaggctggtctcgaactcccgacctcaggtgattcacctgcctcagcctcccagagtgctgggattacaggcgtgagccaccgcacctagccgacacccatcattcttacacagtgaagacccagggagatgatgagtcacaccgggaagtgattcatttgcttactgttaagttcatccaggattcctttaaataccaaatccccatatacgcttaaaaatacctagttcactcagaaacagtgtgctgactgacggaagccagacatgaaagactatgtggtgcaattccatgtataggacgtttctagaaagggcctaatgacagagatggaaagcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttggtaaggagagacagctgcaggggactcctggtggaggaacaggatcccgggggagcggccgggcgggtgactgaggcgccaatggaaggagaagcctgtcacaggtgagggcattgaagggaactgcagggacacccagcgcttctcaactctgactgcagatttccagctgccatttctaaaggacaggtgcctgggctccactcctggaggtttggatttaatcagtctcgggtatagatcccggacgttagtatttttaagcatatttttaaatgaagtgatactctaattctatcattttctttttacttctcagcttgttgcttctctaaagagatacctccctttatccattttgtggtcacccagtgggacagttgagagagaaaaggccgggtggcatgtgattcttctacttcatttaccagttttgaagatgatgaatttgtttcccatgaccttccaaaggtggttttttaaaatttattttaatctatcgtcgtgaactcctggggcgtgaacgtgtgtcataggtttcaaaccactgcaatcattatcctcattgaggttcattgtggctggtggtagtgtcttcatattggcctctgagaccttctgacctgattctagttatctttgataatttccttgtctttaaaaaattataattgtatatattttttaataataaagatgggtttcggctgggcgcggtggctcacgcctgtaatcccagcactttgggatgcagaggtgggcagttcacgaggtcaggagattgagaccatcctggccaacatggtgaaaccccatctctactaaaaatacaaaattaactgggcatggtggcgggcgcctgtagtcccagctactcaggaggctgaggcaggggaatcgcttgaacccaggaggcggaggttacagtgagcagagatcgcgccactgcactccagcctggcgacagtgagactccgtctcaaaaaataataataatagtaataataataataaagacagattttgccatgttgcccaggcttgtctcgaactcctgggctcaagccatctgcccacctctgcctcccaaaatgctgggattacagtgtgagccaccatggcccagcctaacttccttgccttttaagagtaaagcagttttatttcccattgctcttccactagctttaagtatgtgttaatttattattttaggttgtcctagaggttatgatctgcagactcattagatgctagtgatgctggtcttctttaaattggtactttaaccgcttcctggacaaggcagggactttgcatacagatatatcagtatggtgtggaagacagctacactcaccattataccacctgcacagatatcagtatgttttgaaagttgcctggagaccttggtggcaatccagggctgaaaactctgggtggggcactaggtgggtggcaggtgcactggggactgaatgggatgctgtggcagagaggaccagacctaaagcctttagtgaagaaggcctggtgtgaattttttagctggttatcaggttcatattttaaagaatatttttctaattacgtttgtttgtttggtctggcctgatgtgggacgtggtattttcagtgtataggtcttcctagagttgggaaggagggatgcccttctgttggagatgtttctgttaactcaggtgctttaggaatggaaaggaaagtcatgcagctcaggcccggcaggggcattgttgaagatcctcagccagtgaggcgccttccctgtgcccagcacattgctgaggaccttgcctgaaagatgtcctttcatcctccccacccacctgaaagatgagaagtggaggactgatgagaaccttccagatgggttctccaagccacacagctaacaggtgccagagtcggaatttgaactcagctgtgacttacttctgttaccagcagaagtgggtgagaaagccggccacagtccactaaacacgggctatgaccaaggtctctttgacaacataatccaacaaataggcttgttttagaatataaatctcaaggaatttggggggagttgatatactcttgttttttactttttattttgaaatatttttagattcacaggaggttgcaaagaaatattcaagaagatcctgaacactcttcacttagccccgcttcaatgttaacattatgcataacgatagtacaatagtcaaaccaggaaactgacagtgatgtagtcaacagaaactagtcagactccagtagttataatgtatgtatgtgtgtgtgtatgtgtgtgattctgtccaattgcatgtgcaacttcatgtaaccaccaccacaatcaagatatttaattgtatcatcagcaaaggactgcctcatgctaccccattgtagccacatgcacagtccctcttccatcattcctaacctatggcaaccactggaggacatttggagtttccagtttggggctgttatgaacccagatctgctatatgaacattcacttacaagtttctatgtgaaaacaagtttttattcctctatgatcaattatctacaattgctggattgcatggtaaattcatttttacttttaaaggagttgccaaactattttccagagtggctgtaccattttatattcccattagcaatgtatggatgattcagtttctccacatccttgccagcatttggtgttatcactgttttttattttagctattctcataggtgtgtagtgatatctagttgtggtttagattgcatttttctgatgcctaataatgttggggatcttttcatatgattatttgccatctgtgtatcttcacgggtgaaatatctgttcatcacttttgctcattttttttttttttttgagacgaagtcttgctcttgtcttccaggctgtagtgcagtggcacgaacttggctcactgcaacctccgcctcctagattcaagtgattctcctgcctcagcctcccgagtagctgggattacaggcgcctgccaccacgcctggctaatttttgtatttttagtagagatggggtttcaccatgttggccaggctggtcttgaactcctgacctcaggtgatcagcccacctcggcctccgaaagtgctgggattacaggcatgagccaccgcacctggcccacttttgctcattttctaattagattttttttttaattgttgagttttaagggctgtttatatattctagatacaagtcctttgttaggtacgtgatttgcaaataatttctcccagagtataatttttttttctgttatcttaacttgacccttgacagaatgaaagtttttaattttgaggaggtcaaagttttatcaaattttttccttttatggatattgtgtttggtgtatgtctaggaactctttgcctaatcattaaggtcccaaagctctttcctttgattttttttttctacatgtcttatagttttatatttaagtccttgattcattttgcgttagtttttgtataaggtatgaaatttatgtcaaatttcttttttctttttttgcctatagatgtgcaaatactccagcgccattaattgaaaaggctgtccctccttcatggaattacttttgctccttgtgacaaatcagttgggcatatttgtagggatcatttttcctgggctctctactccattccatttgatctctgtgtctctccctttgcctatatcacactgtcttgattactatatctctgtaggaagccttaatatcaggcagggtgatttccccaattttattctcctttttcaaagttatttggctattctcaggcttttctctttctaataaattttagaataagtttgtttgcatctacaaaataccttacaaagtttgacaggacttttgttaagcctgtcagtcaatttaggcagaatcgaccttttaactatgttgagcgttccagtccatgagtatgtctcttcagtatttaggtctttgatttccttccttgtcattttgtaatttttattttatatagatcctgtacatattttgttagatatattcataagtatcttcttgttatctttagagcaactttaaatggtgttgcatttaacagtcttgatttccacttctttgttattagtgtatagacatgcaatcagtttttgaatgttgatcttgtaccctgaaaccttactgaactatatgttttcctctcagcactgtctgagctgcatcctaccaacttggtatgtcgtgttgtcattttagtgcagttctatatagtttaaaatttcccttgagatttcccctttgacctatggattagttagaagtgtgttggttaatttccaagtatttggagattttcctgtagtttttttgtcattgatttctagttggagtccattttggtcaacatattctgcatgattttaatttttttgaatttattaaggcttttttttgtgacccaggatatggtctatctgagtgtatgttccatggacaattgaaaagaatgtgtattctgcagtttttgggttgaattttctataaatgtcaatttgatctttttgttggatggtgttgcacacttctgtatctttgctgatcttctgtccagtagttgtgtcagttgctcagagtgggtactgacatccccaaatattattgtgaatttgtcgatttttctcttggcaagatttgtttttgctgtatgtgttttgtggtctggggggtacgcatttagaatttctgtatgttcttggtaggctgggcattttattattatgtaatattattccttgtctttatttagtttctttactctgaagtctgcctggatattaatatagccacttttgctttctcatgattagtgttggcatgacatgtcttttcccatcctttactttcagtctacccatgttgttatgtttgaaatgagtttcttgtaggtagcttgtaggttattttttaaatccattctgccaatgtctgttatttgatgtagttagaccatttatatttaaaatgattattgacttgctagggtttaagtctgcattttatgatttttttccttctctttctcattcctctgtttctttttccttgccttcctatggtgacaaacattttttagagtcccacatttccttatttatactgtgtttgaatgtacggctttggatagtgttctttatgattgctgtaaatattatgtcagcctactggtgtcagagttttaccactttggaccctttaccctcactactttttaaatataattgtcttaagtatttcctccgtatccactgagtaccttatcgtatgacataataacttttgcttcaacttaaagtatgattaaagaacctcatgaggtgaaggacagtctagtcttcttctgttagtctctttttctgtttgaagacatttctttagcccttctttaaaggttggtctgctagtaataaattctttagcttctcttctcctgagaatatcttaatttctccttcatttcttttttttgatagcaaatttattgagtcataattcacataccatgtaactcatacctttaaactgtacaattcagtggtttttagtgtattcacagagttttgaatcataaccacaatctaatgtaataaaattgtaagtctggctttttgcatgtgatagaggggagaaggaaaagcagtctatatcatcttgctctggaactagaagttgatagtcttttcaagtgttttataaatttcaggttcctctctccatccctttatttttatttatttatttattttgagatggagtctcgctctgtcacctaggctggagtgcagtggcacgatcttggcccactgcaagctccgcctcccgggttcacaccattctcctgcctcagcctcccaagtagctgggactacagacacctgccaccacgcccggctaattttttgtatttttagtagagatggggtttcaccgtgttagccaggatggtctcgatctcctaacctcatgatccacccgcctcggcctcccaaagtgctaggattataggtgtgagcctccgcgcccggcccctttctttatttttaaaatgtattttaatttttagttcttaattgtggcaagagatacatacaaatgtatcatcttaagcattgtttaggtgtacaggtcagtgacgttaaggacattgacattgttgtccagctatcaccaccactcatctccagaatgatttcatcttcccaaaatttaacctctgcactcattaagcagtaattgtccattcccctcttttcacaccccctggcaaccaccattctactttctggctgtgaatttgactcttccaggtacctcacgtaagtggaatcctacaatatttttgtgcgtgactgacttctttcccttagcatagtgttctcgcaacgttgtagtaagtgtcagaattcccttgcctgtgaaggctgaataatactccaccgtatgtgtagaccacattttgtttatccattcatccatgatggacacttgggttgtttccacgttttggggactgtgaataatgttgctatgagcatgagtgtgcaaataatctcttggagatagaccctgcttttcattcttttgggtgtatactcagaagtgggattgctgaatgatgtggtaatttatgtttttaattttggggggaactgctatactatctgtccctgtcttttccttacaaacacgtgtggaagactttgaggcatttgacctgtggaacatctcccttcttattttggatgggtgcactcctggtgaagttcagcgtgtccctttgtcctctctctcctgcacattggcagctggatccagtacctttgctggacttggttccgtctctttcgcaggattagaggaagtgctctatgtctgttcacccatctttttgtgagcaggcagctgttgatgctcaatgcccctgttttgggtaaaattgtgtctccccaaaattcatttgttgaagtcttaagctccagcatctcagaacctgcccttatttggagaaatggtctttacagagcttatcaaagcaaaatgaggtcattagggcaggccctaatccagcatgcccagcgtacttccaagaagaggaaatgcggaagcagacacgtgcagagggaggatgggaagatgtggtgactccatataaacataaacacggctgtctcttgcccttcattcttgaacgctttgctggacaggaaatccttgagtgtcttaaataggctactctttttttttctggaggtaatcatggttgtcaaaaagtcttaagggtcagccacagtggctcacccctgtaatgccagcactctcggaagtcaaggcaggaggatcatcggagctcaggagttagagatcagtctgcgcaacatagggagaccctgtctacaaaaaccttacctttcatttctttttctttctttctttctttctttctttctttctttctttctttctttctttcttttttttattttttatttttgagacagtctctctctgccggccaggctggatccagtggcacaatctcggctcactgcaacctccgtctcgcgggctcaagcgattctcctgcctcagcctcacaagtagctgggattacatgcatgcaccaccaagcctggctaatttttgtgtttttagtagagatggggtttcacctataggccaggctggtctcgaactcctgacctcaggtaatctgcccaccttggcctcccaaagtgctgggattacaggtgtgagccactgcaccgggccttaacctttcatttcaaataaaaaggagataacctggaattctgtgtgggctctcagtgtaaagatagaaggacacacagagtgttttgaaacatgcccctccctgatcagcaggtgtcctgctgtgtcacatgtgactgtcagttcccgacccctcggccgagcagaaagggctttggcaaggtgtccggagttggaggtggcctctgggaggtttgctgcccgagggtcctgttgccgccaggactggtgaggagactgaggattgaaggggccaaaagctgacaaaattctgtgcgggggctgagtggcagattcgggtctgaatcatttcctggttcctggaatattcccacttaggtgccgaagccagaattggagggagcgtggcgcctactcatggagcctgccaaggcactgccagctgctcacaggccaggccgggcgggcagagcctcctcgctgcctgctggctttgaaattcatgtttgagacacacattccagccttcactgcttgttcaaggtgatacatgattttcagactggacagcttggcctcttgtctgttcttgtgttttcctttatgtaccaggataatgttaaacccttcccatgatgctgcaaaaaccaaatagtgcagcacacaccccacagcccgaaacaactgcaggtgcgtgtgccagtggttctgaaaggaatacagagacgtgtggtttccgaatccgctgattgttttattatatactgttacagatcatgttattctaaattacaaaataaaacttatgttaatatacatttatacaacgtatatattatacattatatagcatgtagtgatgtatgatgtaatgtatgatatgtactatataataatttataatatattataattattataataaaaatgactggccaggcaccgtggttcatgcttgtcatctcagccctttgggaggccgaggcaggagggttgcttgaggtcaggagtctgagaccagcctggggccacatagtgagaccctgtctttctaaaaaaaaaaaaaaaaatagtaatttgttattattcttcctattactatttttaagggacaattttggaaacatactttactttttctagtgtagcaaagaatttacattttgtcacctgaaagcgtcctggaaaatccatcctagtgtcttgtaattctaacagtcaccaggaaggctactttgagaaaatttcatatggtatgagggaaaacaagaacattctcatttttttttgtcttgctgaattaaaaaaaaaaaataaaagcaacaacaagaaaaaacaaagcccagggctggggttaagtaggtgaaggaggaaagggagtccccacctgccagtctcagtgccgctctttgccatgcacacacccgtatgtgtgcccatgtgtgtgcacacagacaccaccgggtccccttggagttaccaggcaaatgcatgtcatcagctgttgtgccttgatgtctcctaagctacatagaatcccctcagaccacgcctgacacccaggacaccagggcagtaatccgcacgcccatttcactctcaccatgtaaattgcgttttctattttcatttcattttatgtcacttttcttcaacaagtaattattctagggctttataagaacgctgtgctttcttagtctatttataatgagtaagaagttgtttttattctatttcttttctgtctgtgcttgccattttttttaatcacgattggataaggggggatccctgcaagataacagcgcccaccaaattagaatctccctgaaaaacatacagttaatcaggaggaaaatatagttgcccatagtccatgattatagcacaactaggggacaattaatgtagcaaacctctgtttccacccaagaccaggatacagggtttcagggccaggccagagccccgagccatcaggaccgggcacaggagagtgcagcagcggcctggtcccaccctcactcgggagataataagagacatctgaaatgtcactcaggaataaaagagagggtcttggaaagtgcatgggatgggagagtctgctcctgggagatgtttcctggaggtttggtgtgaaagggaagagaagaattagctgaaaataaggaacttagtaaaacaacaaatcatccacaaagaagagctcctctcaggggaggaggaggtggaagaagaggaaaatctctctccttaattaaaaaaactgtactttagagaagtaagagaagagtgcatggctgaaccatgttcctgagcaagccacacagacctctccctccctactgactctactcatcagcttttggggagtctaagtaaattaatataaacccaagcacacctagcgtccatacaatattactgtaagaaaaagaaatagaaaatgtgtagcaaaatgctggacatgaaaacagccaagaagcacaaatgaaatgtaagtaataggcaattgcaaatgtgaaaaaacaccatgagccagctcttcataaaataagactggaaatggataaacaacgggagatatgaaatgagagctaattaaggaaagcaaatgaagaaaagtctaagataatctctgaaattaatagtaaatgataaggttccccaaagggatagtagttacagctgaaagcacagtagggatagaaatgaaagaaatagaaaagatcaaaaccaaagtgtctgttggaaagacatccaatttacctgtaattggtgaccctgaagaactaaaacaaggcaatggaacagaactaaaaatttaaaactgcaagtcaagaaaactttcctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagctgtaccattaggactgaaattcatcttttaaaattgtccatggtttttaaaattacagatccagttaaggaaatagtgattattactggttattatgtgataattactgaaaacactgttgtcacatagaggatgaaggtgttaaaaattagccacattatgtatgccacatagcaggggacaggcttcatccaatgaaaagatgatgtgggaaactttggcgaaggcactgatagtatttttacacttaaacaagtattttaaaatgtttaaaaaaaattgtatatgtatgaccgaaagaaaggtagggataagtatggaggaatggctataaatgttatatattctgacaaaatagaaataatgaataaaaataatagttggagtaggaagagcaaaagaggaacagagaatcagctcattgattgccctgcaggtaggaaagtggtaacattgtttggtatacaagaatgaccactgaaacaaaaatatagaccttaaatacccaaagaaatgcaaaaacaaaacaaaacaacttttaaagaagcaaacaaaccatatagtgaaatacacacggtcaatataacactaaagaatagaactgagaccaaacctagcagccgcatcagtaaattagagtggatttaacccatttattaaaaggcaagactgattttcagattggttcacatagtggcacccaactctatgctgtataaagaagtcatatccaaaacacagtgatccaggaaggctgaaaatgacaggagggtgtatagcaatgaagagagaaaaagagcttgggagttttaatcctgactgcagccaagctagtatcaggccaaaagcattaatggaaacaaagagggccgctgtcaatgctaaaggctgcaatttgcagagaagatacactaggtgtggttatgtctgcttcacataacatcaccagaacctctacgatgcggaaaccacaggggcggtggggagacatgagggacacgcagttccaggacattgtgactgccttgctcagcctgagacatgtgaaggggaccaaaacatacgcctccaaatgtaccagactttgtgctgtgataatagggaatacaactttgtttcgagactacttggaacacttaggaaagttgacatatattagcttacaaagacaacctcaatgagttccgtaacagaaataatacaaacaacattctgtgctcacaatgcaataaaactaaaaattaatcataagattaaaaaccaaaaaggcccttcaatttgaagagttacaagattaaactctattaaataagtttttaggtgaaaggaaatacacaaaccaagtgcataatttttgaatttgacgataattaaaatatatcactctgtggaatacacataaagctgtggttataacctcagaaatgaaaccaaacgaattaatggatttatcatctaactaaaaatgatagataaaaatagccaaataaacttagagtagaatgacaaaaaataagagtaagattggaaattcatgagttttaggaatgagaaaaaaatgaaactgataaatacacaaaatactacatcctagaaaaagaatcaagtggacaaacctctgtctaagctaatcatgaaggggagagagagagaccccaaacaacacagaataagaaatgacattaacagaacagagcatatttaaaaaaatcattaaaagcttactttgtatagtgctttgcaagtaagtgtgaagacctggatagaaagggaacttctttaggaaaatataatttattcagattgaccccagtagacacagaaagttttaaaaaaaaattcctactggaaaaaaattcaaatctatattttcacaggagaattctatcaaatcttcaaagaacagatatctcaatgctacttaaattattctagaacatagaaaaagaaaccttaagattattcaatgagaaaaccacacaccaatctcacttaggaatattgatgtaaaatgcctaagtaaaacagtattagagagaaccctttaaaaatggttttgagacaactggatagccatttggaaaaagataaaattttgtcgatatctttcatcatctacaagcatacatttcaaatgtctctaaataggtagttaccagaaaaactaccacaagaaaacatgggtaaattttaaaataacctgtgggtagggaaaattatgattcaaaatccaaaagcaatgtaaaaaagattgagaaatttggttgcattaggaaaaaaacaaaacaaaactgctttcgcatgatgggggagggacaccataagcaaagtgaaaaagccaggtaataaaccagtagaaaatatttgcatcttatatcacaaagctaattccttcaaaatatagattataacaagataccatttctcatgggccatattggcagagaggaaaaaactcaaaacaaaacaatacaagtttgatggcgccctctattggcgaggctgtggagcagccattcagattgctccacccctggaggaaacaggatgccttgggacttggtgcacctgcatagaccctgactcagccatgcctccttcctgaatttacctggaagacaatactccaaatccaaacatgctcatggcatatggagatcttaaattaataggtcctcttttatgtctttcaataaagtaacagatatgtttctatagaggtcttccatttttacattaaattgattcccaggtatgaaattttggctactgtcccagtggcagccctctggaaatgacctttgttgagtttgtgttttgacctggtatccagcaaccttgcttaacagtctgaagagcagcttggggcttttctctatggacagtatgtctcctgcatgtaatgacagttggctttcattcatccattgcaatcttcatcctttaatttctttttgttttcttacttctgtggttgggagtgacagaacagtgttaagcagaagcagttatactgcaaattcttgtcttattccttcttgtagggccatctctaatggtccaccatgaggtgtggagtttgctgtggacttgtggtagatcctcactttgttaaggaagtctccttctggtcctaatttgctaggagttttttctccctttaattgtgaatgcatgttgaactttatgaaatggtttttgggcatcaattgagatgatctgttaatgtgatgaattatgtgattgcgacaatagcttttctaatattacaccaagttgacatgcctgggataaacctgtatttcatcatgatatgtctcttaaaaattgctgggttcacttggctaatactttatttaggatgttttttcacctgtttataaatgagtttggcctataatttacctttcttattctgcctttcattggttttagtgtggagattatattagacccataacattcagcatctcatccttttctcttttggagagcaattaatataagactgaggtgatatgttcctcaatggtattgttaaaacttacctgtgacaccttctggttccagtgcattactagtggccagatttcaagtgactaattaaatttccttaacatttaaagtctattcacaatgaggaaataaaccttacctcatcagttggcttccttcaacactaccatttttcttctttcttgtgagtatgtgagccttagttcaggctgctataacaaaaatatcatagattagtttagagaacacacattcattcctcacagttctgaaggctgggaagtctaacgtcaaggggctggtgattcctggtgagggccctctgcttggtttgcagatggctgccttcttcctgtgctctcacatcggggagagagagagcatctctctcgtgacttttcttctcattcccattcatgagggcctaatttcttcccaaaggccccacattataatagcatcacattaaggattaggcttcaacctctgaatttgggaggagcacattcagcccttagcagaaccccacccccaagattttcctaagtgaatgaatagtcatcccccagccttgttcctggcctctaacagcattttagaaggaggtttctcatgactggggttggctgagatgggaatttcctgattccattggctgtgattcagccccatgccatcctgccagtaagatgaacacatgagtcatgctcagctgctagggtgcctggtgctgcttccagttcctctgggtgacctctgtccagcacataaacctcctgaagcattccgaatttgcggaaagtgagccaccctcccaatgtgtacatgtctgggcctaccttcctgctctcgtatgtgacaggcacacagcctttccagaaggtacctcattgcctagtacagaaatgctgaggttctcacaggagtgagaaccctactgactggctgttgtgtctctcccatacagtcgggtgtggagcagttggacccacatacctatctgcgcccatcctcagttgaaaggtagtgaacagcttgggctgtggactcaggcaggcctcggttcaaatcccagctctgccactcaggggctgtgtgtgcagataggctgcatctattgtccaaagccaaacatggggaaaaccaaacaatctctcaaaggggtgtggtgagggcttaggcaaaagactggtgtaccgtggctcggatggattagtttccattctccctctctctgtttccagctttcctctcactacaagatgagggccctgtccctcttgggcgtttgccaaaggaaggtctggacacccagcagctcattcatgtcgcttcccagtttgctgttaccatgttgcagtgcagaagccataagccgcatgatccgtgagcctggccctgcaacttggctcctccacacagcagcgtttgccttcattgtcacagatgactatgagaagatgcccttggtcatctttggtctgggctctggagttctgtagagctttgagccgccagagctaagggggtgaggcttgccccaggccggtggcacacccaggactgggcctggatgactttaatggtaggacagaaggaagagaaaggagctccccagagtccagctgctgggctgtgcagcccatttgcagtgtacttccaggagccttgatggtgaatgctgtaaaagggggaatctttcttccccacctttctttaaatcatagagctattgtgatggcttctgagctgcaatagaatcacccatgaggatttttgtttgttgtcttggcatgaagttcctgtcccttcacagtaatccggcaggtgcctcccagggcatggagtcattgtgtcacattcttctccaggactgcaggagggtgggcacagagttccacaacttgaaatgcagcagacagttgaaaggattctgctcacaccaggagttggattgtatttttccaaatgcattaagtattttaagcagcttgagctgcttaatgggcctgaaagcatttgattagtccaaagggctctatgcccggcaggtcaggggacaagaagttcttaaaatcctatgggtctgaccccttctgctctctctggctatctggctacaacgggtccccagggttgcagcaatagctgtgacctgcttatcttcccagaagtgctggaggcaagctgatccctgagcactgtgcctggagcactgcaggtgccctgcagccatctccatccacaccccctgcctggcctgccccgattccaggctgggcctcgggctcccctcccttcttcgtccccctcctcatctatctgtggctctttctctcgggccctaccaccaagccctctccttgccattctcttctgtccctcaagccgtattcctcagcatcacatggtcctcccgggtcccggtccactcctgtcatgtgagaacaaatggtgtctgctggaatttgcttcgggcctctgttgtgttttgagccaatgtgtgtggtcctcctaacgtcatttgattcatccggcaaaaggctctgctgcctgcctgtctggggcagagcttctaagaccctgtcagttttggacaatgaggcttccctgggggtgcagagtggtgaagctgtttggaatccttctcttgaggtggagtccagagtttcttcctgtcagttcctccccatttgtgtcagcagggtgctatgtccagcgcaggtcctcccctggcccctttctggccttgcagagtgcccccggccccgtgtgagcagatggccttctgggcggagcgtgcagtctcttggcagggcagccaagttgggggtgagatggacctagggctctctgaccccgtaggtttggcctaggctgagactctgagcaggtcacttacctctgggtcctcatgctcaggttcaaaatgagacagacagtggagttaagagatgatttttctgatccttctttgggtctttgcatcagttattttaaaaaaagagaaaagcaagccaacacaaccatcctcggctgattggtggagcagggcttacttatgtggctagttaaaagaaaatttatttttgaaagctgcatggagattttccgtaagcacagtaatgtgagccggggtcaaagctgtctttcagagacagggaagtgcagagatgttcaatgtaaattgtgccttttagctaaacacttggtagattcagcactggccgtgtaggtttgtcctgcttgttttgggggaaccagaaaagatctgattgaatttaatctgatttctgctagagtttggtcatgtaagatttgaaaaagtgaaccttcctgagccagagcaatcaggcaacaaagaaataaaaggcatccaaataagaaaagaagccaaactgtctgtcttcactgatgttatgattctatacatagaaaaccctaaagactttgccaaaaggctcctgtaactgataaacaacttcaataaagtttcaagatacaacatcaatgtagaaaagtcagtagcatttctctacaccaataatgttcaagctgagagccaaatcaggaacacaatcccatttacaatcgccacacacaaaaatacttaggactacagcgaaccaaggaggtgaaagaaatcagagatgacacaaacaaatggaaaaacattctatcctcatggattgaaagaatcaatattgttaaaatgaccatactgcccaaagcaattgacagattcagtgctcttcctatcaaactgccaaggccatttttcacagagctagaaaaaactattccaaaattaatatggaaccaaaacagagccagatagccaaagcaatctgagcaaaaagaaaagccagaggcaccaattaccaaacttcaaactatactacgaggctgcagtaaccaaaacagcatgggactgatacagaagcagacacacagagcagtggaaccgagtagagaacccagaaataaagccacacacctacaaccatctgccctttgacaaagctgccaaaaataagccatggggagaggactccctattcagtaaatggtgctgggatagctggctagccttatgcagaagaatgaaactggatccctaccttttaccatgtaaaaaatcaactcagttggattaaagattcaacctatgagaatcctagaagaaaacctagagaaacatcattctggatattggccttgggaaagaatttatgactaagtcctcaaaagcaattgcaacaaaaacaaaaatcaacaagtggaacctaattaactaaagagcttctgcacagcaaaagagtaaacagacaacctacagaatgggagaaaatacaaactatgcatccaacaaaagtctaatatcacaactctacaaggagcttaaacaattgaacaagcaagaaccaaataacctcgttaaaaattgggcaaaggacatgaacagacacttctcaaaagaaaacaggtaagaagccaacaagcatatgaaaaaatgctcaacatcactaatcatcagaagaatgcaaatcagtaccacagtgagataccatctcacatcagtcagaatggctatttttcaaaagcaaaaaaaataacagttgctggcaaggctctgaggaaaagggaactcttacacactattggtaggaatgtaaattattcagccaccttggaaagcagtttggagatttctcaaaggacttaaaacagaactacatttgacccagcaatcccattcctcagtatatttccaaaagaaaataaatcactctaccaaaaagacacatgcacttgtatgttcatcactgtggtattcacaagggcaaagacacataatcagtctaggtgcccatcagcagtggactagataaagaaattatggtacatatacaccatggaatactatggagccataaaaaagaacaaagtcatgtcctttacagcaacatagatgcagctggaggccattatcctaagcaaattaacacagaaacagaaaaccgaataccacatgttctcacttataagtgggagtcaaacattaggtactcataaagatggcaacagtagacaccaaggactactagagggcagagggtgacagcggggcaagggttgaaaactaactgttgggtactgtgcttgttacctggatgacgggattaatcataccccaaagcttagcatcacacaatatacccaggtaacaaacctgcacgtggactccctgaatgtaaaataaaggttgaaattagtcaaaaaataaggaaaagtgggccttccccgccccccacacttataaagagttaaggattttgtgtttattttaagccatgttgaactcagcccaacatattgacacaaggcaggacttagtgcagtgtcactaggctttaattttgttgccctttgggctaataaagtcaggttatctcactgggctgtttccttatccattaagacatttgatgtaactaagtacccatcctatggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgacaattctgtgtttcttttcagcatttgccaatacattattttctagagtctctcccagcatacggaaaaaccccaaattcaaatttgacttttctcttcgaggctggttgtggcatgctgaagctcccaaggcatgtaatgtagtgaacaaggtggcctccaggagcgctgtcggctcatgggccccacccacccacctcgcggtgtaggaggatccaccaagtcactgtcagagtgggttggagagacctggcctggggtcagctctgtgggcagatgggccctttcccccactgggtggagtacgctccttagtagcccaagacagaacattgccttctcccgagaaacccacctctggggaaggttaggccatgggatctgcgggaagggttttaggagtagattaatgggatttgtgatcccaagcacccaggccactctgtggtccccacccctgggcttgagtcctgctgaggtataagtggtgctagaagacctctgccctgccctgccctgccctgccccaggaacctggctttctctgggctaatgagtgtcctctctgaaggtatccagaggccgtgcagacactcacactttggtgtgaggcgtgccctcggttgatcagttacactgctgtggggtgcacaggtggcaaggtgggggattctgggatcggggaggctagtctgggtgtagggtcctgccctggaggggctcacagtggggttgaaagcaagctctcgaggcgttattattcgggactctgagtgccgggccatgctgggggagtgagggcagggggagctgcggaggcagggctctgagggctttagaacaagagccggtgtgtgtttcccactgagtacctgccggcacctcatttatgccacgtagcaaccccatgacataggcttataggggactataattatccccatttcacagctgggagaacctaggcttagtgtcacagaacctaggcttagccactgggtggctgatactgccacccagttctgagccagtatcagcttccagccccctgactcagtctctctgctgtggtttcctctcaagtgccaggatccttcctggtcccgtttccaactcagaccagtggaggggcgcgctgtggttaccactcattagaagagaggcagggtctctctgtctctctctgggtgtcccccactgccatctctgggtgctgggggagctgctgtatatctctctctgtctatccctatctctccctccactgccatctctgggggttgggagagctgctctgtctctctatctctctccccccccaccccactgccatctctggagtttgggggagctgctcgctctctctcccccctcccactgccatctctggaggttgggggagctgctctatctctctctctctctctctctctccccccactgccatctctgggggttggggggagctgctctctctctctctctctctctctccctctctccccctccgccaaccactgccgtctctggaggttgggggagctgcctgggatgcagagcggcttggattggtgctccctctgcctcagtggttgagctgacctctgtccagtctgtacacattggatcctgaggctgagcttgggtggctgtggcaggaaggtttggtgacatcacacccttcaggcttgtgtctgtctgagccaggctctgactggctgggagaagaggaggaggtggggttctgggaggccctgaggctgagcacggctgctgtgctctgtggctgcactgcaggggcacgggctcagcatgttctgggccagggcacacaatgctttcagatcaggctccagcaccccacacgccccttcatgctttgcactttttgtctaccagccagagggcagtgaataatgagaacaaacaacatcgggtccagattttcgtggtcattttcctaacaagccgaggtcagagagcactgaaaggaggcctaagtgcttctgccacctcagctgactgtttttcaaaaaggaaagcatgcgtgggatgtgtgtattaggtgttacggtgatgtctgttgtcagatcatggccagaaaaggggttgtttcaattaaaatggattttggacttcgtttttcttggaatgagtaaattgagggaaatagcacatgttgagattttggatttctgctcttagaaaggatttaaaataagtggtcttcagtagttccacagcggatcttcgagactggtacagatggggtctcctggatgtaacgagttcttgctgctttaactggatccggttgactctgtctgaccagctcagctggttcgttctatgaaacgcacttctgctttctggaatctgaaggaaggagagagatagaagacaaagaaggacagatgtgttggtggccagaccctggcttctgaacagtccttcctgatggcttcaggacctgggaggagcggcggagcaggtggctgccctgggcttgccagacacctccattccagcaagatcctcctgggggatgtggtgccctccctgcctctcaggcacaagcatatgcttgtttggcctaaaaaagtctccttaattaaaattaatatcgtaatgcagtaaatccttctgcctcctcttcccctgcccagttacaattcccggcggctctccagcccatagaggaggcttctcaaagtttcctgcctcctggaggagagaagccattccccgatcacccaaaaggacaaagtatgtgcccactctgcgtccttgcttgtcactgcccaacatctgcaaacattaactaaagtgctgagcccattcaggtgtaggactcactagttggttaatgtgacagacagcgtttcctgtgccagcgctggctggtcacttcctgtcatccagcactcttgagtgttgcagtggatgcctgtttcgtaggaacactcagcctgttccgtaagaaggagcgccacttctcagcctgtacttagcaggtcactactgttggccactctgcttttctttttaaaattttaattattaaaaaaattttttttgagagtttccctctgttgtccaagctgaagtgcagtggtatgatcttggctcactgtcacctctgcctccctagtagctgggattacaggtgtgtgccaccacgcctggctaatttttgtatttttagtagagacggggtttcaccatgttggccaggctggtcttgaactcctgacctcaggtgatctgcctgccttggcctcccagagtgttcggattacaggcatgagctactgctcctggtccccttcttatttttatgttagtctttggaaacaattggcatatattttagtctgtttaggttactgtaacaaaataccataaactaggtggtttacaaacaacagacatttatttctcacagttctggatgtgggaagtctaagatcaaggcgccaacagatttgctgtctggtgagggcttcctggttcatagaaggccatcttctcactacatcctcacttggtggaaggctcaggagagttctctggagtctcttttacaaaggcacaaatcccattaatcacctcccaaaggcccactgtctaatagcatcactttgggcattaggttttaacatgtgaatttggagaagggcaggcacaaacattcagtctgtagcagcatacaaaaatgtaacaagaataatgtgatgaacagctaggtatccacaagctgctaaaggtagagaatactaccatattggttacctatttctgtgtaacatattatgccaacacttagtggtataaaacagtaaacatttattatctcacacatagtctgtgggccaggaatatggaagcagctgagctgggtggttctagtggaggggaaagatgtgagctggggcacctgaaggcttgactggggcaggaggatccacgtccaagatcgacttcacctggctgttggctggcaagagggctcagttctttgccatatagacctttccacagagctgcttgagtgtcctcacaacatggcaggcggattcccccagcctcagtgattcaagagagagtatagagagagtagagaggaagccgctgtgccttttatgacctggtctcattagtcatacactgtcatttctgcttatgtctgttcactagaagcaagtcactaaattcaggccacactcaaagagaaaggaattaggttccactctttgaagggagtgtcaaagaatatgtggagagagatatatatatatatatatatatattcttttttttttttttttgagatggagtctcaccactctgtcacccaggctggagtgcagtgatgtgatctcagctcaccgcaacctccgcctgccaggttcaagtgattcttctgcctcagcctcccaagtagctggaatttacaggcacacaccaccacacctggctaatttgggtatttttaataaggcagggtttcactatgttggccaggctggtctcgaattcctgacctcaagtggtctgcccgcctcagcctcccaaagtgctgggattacaggcatgagccaccatgcccagcctgtggatgtattttaaagcatcataacaccattgcagctagagcccctccccagttgcatcttgtctttcacacagaggtaactactgttgaagtttgatccttgtttatggcctagtacatgtataagtatttctatccctgttagttctgcattttgtctgtaagcgttatgtaaatgatatcaccttgtatttttttctgtagtgtgcctttttttttttttgagatggagtcttgctctgttgcccaggctggagtgcagtggcgtgatctcggctcacggcaagctccacctcctgggttcaagcgattctcctacctcagcttcccgagtagctgggattacaggcgcccgccactgcacacagctaatttttgtatttttggtagagacgaggtttcgccatgttggccaggctggtctcgaactcctggcctcaagtgatccgcctaccttggcctcccaaaatgctaggattgcaggcctgagccaccgcgcccatccagtgtgccttttttgcttaacattatgtttgtgagattcatccatgtgaaaacaggtggctgtatttcatgcattttcactgctgtgtggtattgcattgtacaaacataagactatttgtcgttctccattgatggatgcttagttgggttcctgtgacttgctgctacaaacaaggttgtcttgagtactcaggtatgtgtctctctgtgaacgtgagctggatttgtcagtatatttagcaaggattggaattgctatgggagagagtacagtaatcttcaaacgtactagaaacagctaaattttattccaaagtgtgtgggtgtcctcatgagtggtcccactgacagcgtatgagtttcctcttctcctttttcttgacagcacttggtgttgtcagacattttacatttttgtctaatgcgtgaaagtgctgtctacatgaggtattaatttgcatttccctgcgtgccagtgaggctaacatctttccatgtatctattttcacatatatattttttcatatatttggtattctgtgaatgactggccatatcttttgcacctttttttctgttttcttattgatcaatctgatccgttgttgagtttatgtaccataaatatcttttttcttttcttccttctaacataatgtagaagctaagagtgtggattctggggccacattgccagggttaaatcccagcttcaacacttcctgtgtggccttaggcttagtctgtgtatgcctcagtgtcctcatctgcaaaatgggatgatggctccccacggtgggcctgggaggatgcgcaggttcgtatctgtgaatcagttagtgcctgtcatagtaagcacaagatagactaatgcaacctagtgtgctgggccctgtgtggccacacggggctgtatgcacaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatcgagaatcactggagagccgtgtcagagccctgctgagaagggcgcggggaactgtgttcctgtctacctgatgctgtgggctgcacaaggacggacttactgaagattacaggccagggggaagagggcacgtttagtgtcaaccctacacagaagaagttagctccgctgggcgcggtgggcactttgggaggctgaggcgggtggatcacctgaggtcaggagttcaagaccagcctggccaacgtggcgaaactgcgtctttactaaaaatacaaaaattaacctgttgtggtggcatatgcctgtaatcccagctactcgggaggctgaggcgggagaattgcttgaacccggggtgggagaggttgcagtgagctgcactccagcctgggcaacggaaactccgtcttaaaaaaaaaaaaaaaaaagaacaagtcagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaaggtaagtttccaagaacagagctctgtgaccattttcatgatagcaatttgtacattattactaagtaattttaatgccgtgtttacaggccaccttcccaaacaaaacaattgtttctggaagttagactcttgaagacttaacttttaatccagtttgttctcaaaacatttgcacaaatgagagtcttgaggtttgagctttctattctaaaggctcagcttcttgcccaggagaaaaataatacatgctcgtgtttataaataagagttatggcattggagtcctttacattgcagccagcctagggactcagttattcagaatttaaacattttacttgtaaagagcactttggtatccaccccaagggccctcctctgcctgtctcagcaccatctctgtgtgtcccatcaggaagcaacagacaactccctaagccccacagtaaaaacgtctctcctggtctgggggcgcatccatcccccatgtccccagtcccatcctgggtgttctgggattccagccacagctgtggggacaccgccatctcactgcatccctcttgctcttgcggcagcttggctgagctacagggccgggccgcaggaggcgtccttgtgccggagctcaccttgtgccggagctcaccttgtgccaggtgttgagctctgccagctgcccggccccactgtgaggccgccccttgcaggtgagttcactggcagcccagccagcccacgaaggccatgtgagtgtgaacccccattacaagctttccctcatgagatggcgctgatcagtctgggggatacctgcctttcagtatgggctgcagccattaggctggtaccaggaggagccaggtcgagctggcactggggcgacgctctgtctttgatgcaccctgatgcctcccccatcctgctgaccatggtgctcagcacagaccccttccaacccatcccagggcctctgctcagtgtggccagagcctcctgtcaacaagtatgtcactgccttcgggttattattgttcaccagattccacttgctctacaacccaggcacagtgcaccagagtttcccaaacctgtgtgccgagtgccagccccttagcaagtgcagcgttgcccatttcactctgggaaatgcagccatagctctggggccagctagaggaaggagtgtgattgtgccttcccgggacagcttccaggtctgggagtctgtgatgttgtgagtgttgccttagctttgctaagaaaatgcttagggagatgggttccttcacccattcttccactcatgtgcctttctggctccagggctggtgtcccctgctttggaggggacgctcacatgagctgccctattggggttccgtcaagtttctcttagcctaagcggcttcctgtctcgggctccctccccagccatttgggtcaccttgggtccctgaggatcgcttctggatcttggaccccctcaccaactcctgtgacataataatcaaaggtaatcaggaaatgtatgaatcgtcttctttaaggaatatttagcatttctgctcattccagagtccctggaagcatggcatttcaaaggcttggttagatcacaagtccaatttactgccagaaatttgcacgtagaataatacagagcctatgatggcagttgaagtggtatcctgtgagaaaattaattagtcctgaaactaaatgccgacagcctcagcaaaatattcatgagagaagcaaacctcgtgcgtggtgtttgaagtcaggcagctgaggctgtgtactggacgtgttctctgtggctgagttctgctgtggattctgggctagtctaggcaaggcctgcctctccttctggactggctcccagggctgggggctcaggaaggccctgcaccctggagaagaagggagcccctgagactctttggccttgtatttgtgtgtccctctgggctgcagggctgcagaataaaccagctcccaatcctccaaacaaaaataaagacctgtgaatggctacacttggagagcagagtgttttgatatcatggggagacctgtgtacttaatttacggcctgaagattgagaaggatttaattgttccaaaaatggtgagaaaagagcaggtcccagcctttctgtctgatcacaaacagccgagggggactggggaagtggcctggtcctcactgcccctggaggggcaggaagaggatggagtgatgtgcttggcagatgcaggaatggccaggcagtgggaaaagcctagggtttccaagccatgtctgatcctctgtgttccttctgcctgctgggatggagcccgccccccaaatatgcctggctcacttacgactcagagtcagctgcccccagggacttcccggctctcgtgaccttgctgggcatgactttcaggggagccctctgtccaggagacataggtcactcgaatcacacagccgtgctttagtgaatgctagccaggggccctggagagggcaaggacaggacactcctgcatggaaacgaaaatgaatatttttctctgcagaaaatgaaaagtggtgctgggtccaagtggtaggtgacctggcttttgagcgaaaatgctgctgggaaatgagagaaaagaaacatgaaaagaatgcaaatgagggtggtggacaggggcccagaggcctgattcctccaccctccgcaaaggctgggtgtgtgatgcctataaatagacactcaaaacccgttctaaatggagtgaagacatgggcctgcttcctcttatggaaaggccttacataaggtgcagtgctgctattgctcctgggcggtgtgatgattctgtgcctttgtcggaagtcagtgtgaagcctgtggggcttctgggggatgcacatggatgagctctgggctttctggagactcgcagactctgggaaggaggcggtgggcgatgggcaggtctcctagggctgggaaacagtcctgagacaggctccgggtttcctgaggcgcttctgggccaggagcaagtgggaaaagctggactgcagggcttggtcaagtgacagctgcccagagccggagtttagggtgcctggagaggacaggggctggcaggcctgactttctcactgatccacttggggtcacagagccaacctgtaacagagtgaggaactgaggccgcattgctggactcccagtggaggattcttgctgctggactaacctttagttcatgaactcacccagaaattacttatttttggaggaccgcagatggcgagcttaggagtgaagaagggaatactatttgatgctaatgtgattccaggcaacattctagaggttcccttgcaattcaccttcccagccacctttgaagtagttattggccagttttatacacgatgaaactgacagagatggtgtgaagggattttctgacgttcacacaggaagcaagcagcccatgctgactccactgcggaaagcgtgtgtgtgattgacatgctttttgtgtggtgctcactttgggtgtgataaagaggcctccttgcaaagggccaggatctgtgaagcaccatgttgcttcacagaacaggccgtgaaaagccacagaagcaccatagcctgggaaagaaatggaacaacggtgcaaacagccagtttcccctgagcagaggcaagcaggttacggctctgcagctcccttaacgggtagcttgttcaacatggaaacatctttagcctcctcagagacgttgggtcatctcctttacatggggaccagaagtatcttccctgggccattttgggtggaggaaatttcgtaattataaccctctgctaggggtgtctacctaggaagtgagagcaactggccgctttcttagagaagtgaagacgctgagtagactaaacctttgtgatgaagtcgaagccactgtgttgcctgtgtcctgtttccttccccagtgaatggggctcttccctacgactgcagaccccaggaccagattgcaggtgccctgtccagcagcgcagccattcgtgaagggctcgcagcctggcccggctcaacagctgatgcccccgggaggaggctgtattactatcctttttgaaaggaacacagaaagccctttgtaactttgtctgtagccaacatggagggagaggcagaattcagatgtgatgttgcagacaattgaacacccctcctcctgttccaccccagcttcctgcccgtagccttctaatgcccttgccctgaattcctgatccaacccaagggcctggccttgaaacccccgagcctgctggcagtagcttcctcttcagccttcctgtgcagagcttcctctattcagggaagtctgagacctggtggcctctttctcattcttttcatgaaaccatcttgcccaggagaaggtgggctgagaccctgggcattggaaaggagaggtggtcctccttcctctcttcactttcatcgcagtcctctccccgcccacccccatatgcacaccctccgcagtctgaaagtgtcgtgaagcaccagctctgcaaacccgtggggtcaagctttgttgtgggaaaatacatattcatgagggctttgaggagcctcattaaaatgcagagagtctctcctttcagaatggtacataagccatctctttatttgcccaacacattgttcttaaggcaataattatgcgatgaatggctaaagaaacattttaattatttgtttagggtaatttctgattatctcattagaattataatctgtccacttttacaggtgattcaaagcctcatatttacatttttatacttgaaggagctctatgtgcgcacctgtatcattgctgaagtgaaagtaattttctctgttttcttctgctttattccagaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaactgccgtggctctttgttttctgggatcctgtgtgtgtgagcttggggagtttgaagctggggtttgagtcacagccaaggagtggatggacactggggacgcttctggcacttaccttgcccggaaccgacctgcccaccacccaatgacaacacagcaagacacgcactccccatctgtcctctcctcattatactggtgtttctgtaaaccatggtcctcaccagactcagtcattgatttgtgtaacccctacctaggttcctagttacagcgaaagtagacacatgtatatcggcaataataggtagcactcgaacctttcactctccagtgtgggcagtggctggtctactttgagaagggaccagccattgtgagataccaggaagctgagcagaagaaatctaactttgataaaaagaggcctcctcatcttgccagggatggagcgtggtccatcctccctccctgtgcatggagcagtattgcagccctgaagacactgccccatggtcagcatctggcttgcccttgccctgtaggactggtaggaacagagccctggtgccagccgagtgttccacacaggggagacttgcaagggacaggttctgcactgcagatgaattggctgtcttcttctgtggctggagacacacaaggcagcggctttgtagggaaactggtgtacagggtggggcgtgtttggagaacgaggagcagagggcattgttgctggagttaaagaagcagagccagggatggtcttcatgtcctgatgcccagagcaggcctgagcttctgatggattctgggggttcttatgtattcttgggaaggagcatgtggtaagcttggacagggaggcagttcagagtgttacatgcaaggcagcggtggccttgggaacaccccccctgcctgaccaaggcaaggaacactttgtgtgtcccagtgtggaatctctgtgccagttgtgaggggacggatgaagaccagcaggggtgaggacgggattctggagtgtcaagactcaggttcagaatcacagtttttcttccagggcagcacaaggccacaagtgtggctatttgaagccacccaaaaagccattatttgtaaagcaaggcagctttattgatttcactttctgccctgcatctttcccacattgtggtaaccactcaccatccctgttctgctgatgaggcaggaattcccttgcatccagttggggagcattcttgtcacaaatgtcctggatgaattacacggtggctctccgtggagggagcacattcacaaggcatttaagagatgcaggacaatcagccctcgtccatgaaacagggtgaaacgtagaagagctgcgtgattattaatgggtttggacataagctggagtgtttactgaaatttttctcagttgtcagttttcaaagtttgtgaatgtacttttgtgctctcaacaggccttttctgctctatttaactttctacttagggttgtaaacatacttcagccgtaatgacattagatacatcatccactctcagctctgaaaatgctggagattttgattatcaccagcagtaaggacagcttatgaagggagatgttacttatggagacacagctcatgattccataaaattccagtcttctgggagcccagggttaagcagctgcctcagcccatccaccctctagggactgtccacggtgaaattggcttcttgacgttttccttatggaacctggggtgtcattacattctgttagagtcatagggtggttctatttatgcctgtaaggtataaggtatttttttcttctgagtctagaaaagacctactggaatttttatgtatcctgaaatactattagacgatcaaaatcaattgcaatagagaaggtgctgggctctcttcccaattgctctcacccatctgcagtgtaataggcctatcatgtaagtgaatatactcatcacaattctctgcagcttcccagcagaaaagcatattccttctcagagagaaaggcggcaaggagatggatatttttaaatgccaattatgccagaatgagtctctgtgaggagatctgtaaagagaagaaagggccggggtttatttatttttctgctgcgaatggaatcattctgtagcttcagaatactaatccctgtgatgtgcctgatgtcttttcataggataatttgtgaatgtgcttccacttacaggaaaagtttgaggctcttttcttattcttctttttcttttttttttttttttgagaattaaattctaggcctcactatatcctatgataaccgtcctataggccctcgatctataaaatgtgtgcataatgaaatatataaaatcagcgattatcctgaaggaacacagaaaagattaataagctgtatttaaatcacggcaagtctcagaacatatattaagttagaagacatcacgtcctgaaaatgacgggctgatgtgatactagcatgtacccccgtatggatgcatataaatgctgtgtaaaacctagcccaaagtgttctttaaaacctaagatccaaagaaaggcatggaaattccaagctatgagacatgaagagaaaacacaaagccagagcactaagggaggaggccatgagacccccaagcagtgaggttcctgatggagagccaggatgatgaagactgtgtgacatttgtgcagggagagacacggcaatggctgggacagggtagcaaggctaggagcaagtgctcatatgtataggaagccaggaggtggcagacgtgtgttatggaccaggtgggatgtgatgcaggacagctggttggccacataggaaaagagaaaagataaagtgagatccctacctcacagcacatgtaccagtaaacggccatagaattaaaggcctatgccgggcacggtggttcacacctgtaatcccagcattttgggaggccgaggtgggcagatcacctgaggtcgggagttcgagacgagcctggccaacatggcaaaaccccatctctactaaaaatataaaaaattagctgggtgtggtggcggacatctataatcccagctactcgggaggctgaggcaggagaattgcttgaacctggggggcggaggttgcagtgagcgagatcatgccactgcactccagcctgggtgacagaatgagactccatctcaaaaaaaaagaaaaaaaaaaaggccaaaatgtaaagacaaaaatgttaaaatacatagaagattttttctatctgctcttgaggtgggaaacatacacacatcataaaagaaaagatggattaatcaaacatcagtattagcaacttctttaagagaactacaggctggaataaatattcatgatgaatttactgtgagagatttgtattctgtttgtatcaagaactctttcaaattaattttaaaaagacaatagaattgaaaaatgagcaaatactatgaagaagaaaaaatgaaaatgtcaaatagacaaatgaactctgccttgctcctaatctgggaactgcctgggagaccatgagatgttggcaaattagaaagtctgataatcgaagggttgcccagagtgtgaagcaagggggccttcatgtcctgtttatcaagggcaagttagtaaacccctttagagaacaattaggtgttatctagtaaggttgaaatgtggatcccccatgacccagcaattctgctcatgaaagggattcagtgttgtattagtcagttctctcaaaaacagaaccaataggatcagtttatcttagagtttatgtatcgatcaatcgattgattggtcaattgatataaggtattggcttgcatgatatggcatctgggaagtctcacaatctgccatctgcaagctggagacccagggaagccagtattgtagtgcaaaggcctggaaagcagagaactggtgcagattccagtccaggccgaaaggcctgagaaccagcagcatggagggcagagaagaccaatgtcccagtcaagcagtcaggcagagagtgaattcaaccctcctctgctgttttgttctatgcaggtcctcactggagtggacgatgcccacctacactgaggagggccgtctgctttactcagtctgccaattccaatggtaaccgcttccagaaacacctcacagactatccagaaacagtgtttaaccagacgcatgggcaccttgtggcccagtcaggttgatacataaaattaaccatcacaagtgggtcacaaccagcgttttctaaaaatatgaaccagattagaacagaagatatcagagtttgttctgcatagtgaatgatagtgatcctgagaagggggactttgaggggatgggactgacagcgatggttaagcctgaatggaggtttgctacattgttttctatacttctatgtatttgcaaagttgaggagaaaagaagttgtggtaaacccctggatgtaggcacacggaccccagtgttctgtgctgtgggtccctctgatgcagccgtcttgctcccgtcttgctggttcatcctccaccttggctgactacctggcctcacccttgtacaggtgcttctgtttgtctcttcattgaaatgggtgggatttattgatttatttagagacagggtcttgctctattgcccaggctggagtgcagtggtctgatcatggcgcactgcaaccctgacctccagggctcaatcaaccctccctccttggcctcctgagtagcagggactacaggcatgtgccaccacacccagcttatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaagatggaaaatgggttaagaaagtagcacgaggaactgtgagcccaacataattagtgtgatgaaagagaagttagccatttctgtatgtaacttttgattaatgatattcagctctaattaattatgtccaattctaattaatgacattagtgtgcaagctggcattctcaaactatattctgaggattcccagcggatgttcttgaatataatagtccccggtcacattaggttgggaagtgctgtgtgtactgcccgtcttggacactcccaaagcaccatataaaaggccttcagaagtcctgcaagaaaaggaacaatttaaatttcttttaacctgtcatttcccagacttacttttaccatgtgtgctgctaggcacatacggacatgctaatttaactctcataccacaaggtgtgcttggatgaattgatgagcaatgtacatgtcatggagacgttttctaagtcttccagagtcatagcaggggtctcctgtatcgcagcagagcatactgcaaagaattgcatttccatacagtctagggctgctgtgaactaatctcctttcttgggcaaatcgcttaatctccttcaatcagttcatacatctgcagaggaaagggtgatggcatgccaccctggatggtgggaggactcctagcagtggtggctgttaccatctcataagaaaccctcattacaagaaagtccacgtcatttgccatgtgctggtctcggggggtcagcgagtggggggctgcagggagagaccaccagttacctcctgagcctcacgtgtggggtacactgtgttttgtccgttgttggatttgtattcattgttcatctaaaagtgattatgttgaaaaacagaatggtggcagacaggcatgtttggcatgggttaatgcgaggctggaaagagagcccctgaccttcagttcgagaatcagccactgcaggaaagggtggcgtcttggtggccgcatactgtgaatgtcaagggagacgaagagtgcaccctggggagggcggactcatcagtccagtgggttgtccaggagggagtgagggttgatctttcatctcgaaggatgaatatacatttctgcgagagagggggaagacgggcgttccaggcaaacaagcgtgtatatataactgaagcgtggacagaggaagcagcgtggctggtctgggaatggaattgtttgatctggcttgatggaggagctagggggtgaggtagaagaggtggcagaggccagcttgacctgtgtagatggcttgggagaagccctggcaggtctttgttggagggctgacaggaagggatatgtgctttccatagttgaccttggagggtgcggcatggggtggaggcccgtgcaccagaggctcctcatagagtctctacagagagatgaccaggctagcgttttcatggcatgaaggttgtcttcagaaactcgcttcacaatctacttaagatgagtcaaatctaccctccaaagaacatctgctgctactggagatagcgcttcaaaagctaatgcaggtgctgaatgtttttccaccatgagggttccttctgtgcatcaattagtctagactcttgctgtttgaggaaagaggctcagagtagttaagccactagctccaggtctcatagctggctgataggacatcaacctgcggagtctctatggaggtggaatagtttcagtggtgcactgaaacagtaggggatggataggagaaaggcttggtctattagtcaggttgagccagagaagcagtaagggatggatatgaggagatacattgtgaggaatctgcacacgtggttttgggacctggccaggcaagcctgaagcccgcagggcaggccatggggaagggcaggctggaactcccaggcatggctgcagctgcagtccacaggcagaatttcttcttcctgaaggaagccttggctctacttttaaggtctcctgacaaattgatccagacccagacagattgtctgggatgatctcctttctaaaagtcaactcattatggactttaatgacatggacagaagactttcacagcaacgtctggaagagtggctgattgcctagccaagtcagtacctcaaaaagaccacactcttgataacacgtgggggctccaggaccaaaagctggtgctgcagatgtgtggggtggcagcattgtcacttcctgtctcccactaacctcagggtcacagtgggctggtggctgtagcatgctccacacctgctctcagggatgctggagggagactgaggcccaggcttttgtcttagagacttgggatatgtctaggatcccttctaaaagccaagttctagatagaatctggcctttcagggttggagagaccccatgtggcttctgagcagacttccttcctgatctcagtcttggaagtgaaggtcttacccctggttgcccccttcctgtgacagagggctctttgcctctttgcactccatgccccagagacaatcagtgctggggacaattttgtcagaaatctattcccagccctagcttagcctagtggcactctcagtcctgaaagctagaggccatttccacattggtgtagcaccgtggttctcagactgtgtttgctatcaggatcacctggggaacttggtaaaaatacaaatgcaggtcatattctgcttcctccatcctgggcctctgtgttctttattagccttcttggtggttctgacctacatcaaagttgaggaccactggcataacgcacggctgctcgaactccagtgtgcgccggaatctcctggggatctcatttattttatttttattttttgagacggagaatcactcttgttgcccaggctggagtgcagtggcacgatctctgctcaccgtaccctccgcctcctgggttcaagcaattctcctgcctcagcctcccgagtagctgggattataggcacatgccaccacgcctgactaatttttgtatttttagtagagatggcgtttctccatgttggccaggctggtctcaaactcctgatctcaggtgatccacccgccttgggctctcaaagtgctggggttacaggcgtgagccatcacgcccggccagggaccttgtttaaatgcagattctgattccatggtttttggtggatcctgcgattttgtgtttctaacaaccccccaggtggtgcagttgcttctggtcctcaggccacatcttaaatagcaaaggcgtagataggggccgaaattaagcacttaagaattacccagacttgcatcggaattctgcctctaccacttaactgtctctgtgttaccctgagcagactgcttgatctctctaagccttgatttccttatctggacaatgggaataatgtgcctttttttttgtttttttgaggtagcacctctgtctgttgcctagcgtggagtgcagtgctgcaatctcagctcactgcagcctcaacctcctgggctcaagcggtcctcccaccttggtctcccgagtagctgggacctcaggcacacaccaccacacccagctaatttttaaatttttaattagagacagggtctcattgtgttgcccagactggtcttaaactcctgagctcgggcagtcctccctccttggcctccgaaagtgctgggattacaggcgtgagtcactgctcttgctgctttttaaataaaaactgctggccgggtgcagtggctcacgccagcaaattccagtgctttgggaggccaaggcaggtggatcacttgaggtcaggagttcaagaccatcctggccaacatggtgcaaccccatctctactaaaaatacaaaaattgcctgtcgtggtggcagacccctgtaatcccagctactcaggaggctgaggcaggagaatcacttaaacccaggaggcagaggttgcagtgagccgagatcatgccactgcactccaacctgggcaacagagcgagactctgtctcaaaataaataaataaataaataaataaatattgctttgacagttagaaaagaaagagtttaataccgcaacataataaagaccatacaggcaaagccaccagccaacagcatacccagtggtgaaaaattgcaaaggcttttcctcttaagatcagaaacaagacaaggatgccccctttcaccacttctatttaacatagtactagaaattctagccagaacaatttggcaagaaaaagaaatcagaggcatccaaattggaaaggaagaggtgaaattttctctcttttcacatgtcatggtcttatgcaatatgtagaaggccttaaagacttcacacgaaacacacaaagctgttataactaatacatgaattcagtaaagttgcaggatccaaaatcaacacacaaatatcagttgcatttctatacactaacagtgagcaatctggaaggggagttaagaaaaaaattccattaaccaaggaagcaaaaaaattgtacacagaaaactaccgaacattgctgagagaaattaaagaagacaccagtaaatggaaagacatggaatgtttttagattagaagacaatattgttaagatgtcaatactacctatattagtccattctcatgctgctaatacagacatactcgagactgggtaatttacaaaggaaagaggtttaatggactcacagttccacatggctggggaggcctgacaatcatggttgaagatgaaggaagagcaaagtcatgttttacatggcagcaggcaagagagcttgtgcaggggaactctcatttataaaaccatcagatctcatgagatttattcactaccacaagaacagtgtgggggaaccacccccatgatacagttatcgctacctggccccacccttgacgtgaggattattgcagttgagggcaagatttggcgtgggacatagccaaactatgtcatatccaaagcaatctacagattcattgcaatccctatcaaaatcccaatgatgctttttgtagaaataggaaaattcgtcctaaaattcttgtgcaatctcaagggaccctgaatagtaatagcaatcttaaaaagaaggacaaagttggcgatctcacacttcctaatttcaaaactagctacaaagctgtagtcatcaaaacaatgtagtagttgcataaagacagacatacagacgaaaggaattgagtagacagcccccaagtaaaccctgacatatatgggcaaatgattttttgacaaggatttcaaggtcattcagtggggaaaggatagtttcttcaaatggtgttggaaaaactgaaaacaatataaaaacaacacaagagaatacaaaaatcaactcaaaatagatcaaagacctgaacataagagctgagaccataaaactcagaagaaaacaggtgcacaacttcatgacattggatttggtagtgacttcttggatgtgacaccaaaggcacaggcagcaacaggaaaagataggtaagttggacttcatctaatataaaaacttcctcaaaggacacagtcagcagtgaaaaggcaacccaaggaatggacggaaatctttgtaattcatacatctgataaagggttaatagccagaatgtgtgaagaattcttagaatttaacataaaaagaagccacctgattaacaaacgaacaaagggcttgaataaacatttctccacagaagatagacacatggccagtaaacacagaaaaacatgctcagcatcacaaatcgttagagaattgcaagtcgaaatcacaagataccacctcatatctattaggccggctattacaaaacaaaacaaaacagaaaataagtgtctgtgaggatgtggcagaattggaacccttgtgcactttaggtgggaatgtaaatggtgcagcccgtcggaaaacagtatgacagttcctcaaaaaattgaaaatagaattgccgtggaatctaggcgtggtttcacttctgggcatatgcccaagggaagtaaaagcaggggctcaaggaaatatctgtacattcatgttcatgcagcatgattcacaatagtcaaggggtggaagcaacccaggagtccattggcagatgaatggatcaacaaaatgtggtgtatacatagaatggaatattattttgccttgaaaaggaaggaaattctgacacatgctataacatggatgaaccttgaaccttgaggtcattatgctaaatgaaggaagccagatagaatagcacagatcctgtgtggttccactgacatgaggtactcagaatagtcaaattcatggagacagaaagtagaatggtggttgccaggggctagaaggagagggaagggggttagtgtttaattaggacagaggttcagttttacaaagtgaaaagagttctggagatggatggtcatgatggtagcacagcagtgtgaatgtacttagtgtcactaagctgtattcttaaaaaggcttccaatggtaaatttatgttacgtgtattttaccacaatttttttttcttacaacggaaaggactcaacaccatatctagtaaaacacacactgaatgttgttattgaaagcatagatggcaggatcacttgagtccaggagttcgagaccagcctgggcaacactgggagactcccatctctacatagaattaaaataacagattagctaggtgtcctagctactcaggaggctgaagtgggagggtcctttgagcctggaagttcgaggctgcagtgagctgtgatcatatcactgcattccagcctaggtaacagagcgagatcccatctcagaacaacaacaaaaaacaaataaaaaaataaaagcacagagccagtcacagggacactccatacatatgaattctacccacagtcattcgtgcccctgagtgtctgccttcccaccattctctgggagttggtttccattccctcacctctcctgttctctctgacaaaggtaattgaaactatgtttctgttctttcagtatggccaggtgggaagctgttctctagtgtgagttaaccaggacagagggtgtgtatgtgcaggggagagaagccggcaggctcttcctcccagatgctggactatggaatgtgatactaacatggggatcctccccaagagccttggatcccctagtgcaccaaagtatcctactgagaaggcatcagaaaatctgactcacagaagttagggcagtgtttacagtaccatgacagcaggcagagcttggggttcaaagcagaatctgaggaaagactctaaaaagacgagcccctgcccaagatatggtgccttttctagtctcatagcacattgcaccccctcccctcactgtaacaatccacaccctcagaacgcgcacctggagttgttcatggagactaaagtgggaggaagctttggacagtcacctttttgaagtctgttttgaattgaacagtgtgcaaatgataagccacttattttaaaataagcttcttaattcaagtgtaatataaacagaaaagtacaaaaatcctaagtgtttattaccatgaatattttcaaagtgaacacatccatgaaactaccatccagactaggaaacaaaacatcaccacaacccaagaatctcccctagggtcctctcccagccataacccacccccgaccactaccaccaccacctaaaggtaatcagaatcctagcaccaaatgttatttttgcaaatgtttgaatttttttttaaataaatgaatttctacaatatatactgttttatgtcagcttattttatgcaacattatgtttgtgagagtcactcacaggtggtgtgacagtagttcattgactcactgttacagagcattgtaaaaatacaaataattcatccattctatgtttgatggacatttgcatcttttctagttttgggtcatgattgctgctgggaacactgttacacatttgttgtacacatgattgcatttctattgagggtacatccaggattggaatgggtaggtcacagggtctgggtatgtttctattttagtgaacactgccagtcctttttctgacgtgattgtacccaattacactcccacctgcaaataggagtttcatttgctccacatccttgctcataactggtggtgttagtcattttaatttgatttttagtggatgcatggtgggatcctctggtatgattttcagttcactgaagactgttgaatatctctttcgaatacttgtcttgtgcttttcgaaaccttctcttgaagtttttgtgcaagtttttgctcatttttctgttgcattttctttcttagtgctttgtaggagttctttttttgttttatgagatggagtctcgctctgtcgcccaggcttgagtgcagtggtgcgatctcagctcactgtaagcttcgcctcgtgggttcacgcccttctcctgcctcagcctcccaagtaggtaggactacaggcgcccgccaccagcccggctaattttttgtattttttagtagagacggggtttcaccgtgttagccaggatagtctcgatctcctgacctcgtgatccgcccaactcggcctcccaaagtgctgggattacaggtgcgagccaccacacccggccgggagttctttatatagttagtacctgagacctttgctagatgtacatattacaaatattttctcacactttctcacgttcagtggtatcttttgatgagaaggcccagattatcaatcttttcctttaaggttaatgctttttgtgccctgtttaggaaatctatgcatacctaagaacatgaaaacaacagcatatttattttttccagccattcttgttttctaatatatgattttagggttataaatagcctattaagcctgctttagctgtaatccactatttttaaaaattgtagtaaaaaaacacagcataaaatttaccatcttaaccatttttaagtgtacagttcggtagtgttaagtaaattcataatgttgtgaagcagatctctagaactttttcatcttgcgaatctgaacatctatacccattaaacagcaacttctcattctccttgccccagcctctgggagccaccattctactttccgactactctaggtacctcaagtggaatcctacagtttctgtctttttgtgactggcttattttgcttagtacagtgtcctcaaggttcatctgtgctgggttgtgtgataagattttctccctttttaaggctgaataatattatgtggtatgaatagaccacattttgtttatccatcatccatcgatagacattgggttgcttttattccttggccatgatgaatagtgctgctgtgaacatggctggctgtccagcaccatttttggatacgttgtatttttattattaattagttcaaaatctgttcactttttaaaatttctcctttgaaatgtgggttattttaaagtagttgatttccaaatgcctccatattttctggttatatttttgttatttatttctagcttgcttaccccgtagtcaggaacagattatttacaatgttaacattttgaaatttgtttacactggctttagacttgtccaccatatgattaattttgacagactatcccatgtgcccttgtgtgtagttcctcagttcagtactttcgatatattcatgaggaaaaatgggtaattgtggtgttcaaatcttatatttccattcttatttttacttctttgttatatcatttactgaaagaagtgtgttaaattatccagctgctcataatgtctgtgtctaatagacataaatttcataatgtctaatactttagatttgtcttattatagtcctgtcaattctccctttataaattttgagtgcatttaactagatacatataaatttagaatttattcctagtaggttgccctttttaattatgaattctttcttttccataagaatgctgcttttcgtaaaatctagtttgtctaattaccaatataggtatataaactttcttttttaacttactgctttagaatagttttagattcacagagatgttgcgaagatagtagagagttcccatacatcctgtacctacttttccctgttgttaacatctcacattagtatggtacatttgttacaattaatgaaccagtgccaatgcattattattaactgaagtccatacttcattcacattttcttagtttttatcaaatgtccttttgctgttccaggattctattaggagactgctttgagttcagttattatgtcgctttaggttcttttagactgtgacagttcctctgactttccttgtttctgatgaccttgacaattttgaagagtagtggtcaggtattctatagaatatctttaaatttgagtgtgcttggcatttttctcatggttcaataggggctatgggctttggggcagaagatcccatctgaaaaagtgccattcttatcctatcaaatcagggctacataatttatcactgctgatgttaccctcaatcgtctgagtgttatgcaccatctccatgagggaacagtatctacacaaattatttgcaattctgcacagggagattggtctgttctcactcatttattttctcattcatttatttatatttgtatggactcatggatattcattgtatactttgggctataaaccagtattgcattattaattttgttgttcagatagttccagcttttgccctttcctaagatagtggactcacccctctgtgtttcaactctaccaatttggaccctcaagttcttgttgccttattagccataaattgcaatttcttatttccccagtcctctgagactactgaaagttctgcttaggcctattgcctcttaaccactactttcttcctgtgtgtgtttttaaccttttggcttccatcactcacaaatccccaaatgccttgacgagaaaagcagcacagaatgctgagcttatttctgggtaattatctacttgtcatgatctcagcccctcaagtcctagctgccttggactctctgatgcttccacagagatcatttaaaaaaatttcgtcaagagtttctagttgttcttggtgagaggattagtctgacacaagctagtgcatcatagcaggcggtggaattcttcagacataatatttttttttacttcttctactatgtcatagttgatggtgcctcatggtattttaatatctgatgctttgcacccatacagcaactatcctgagtaacgaagatgttatgtcatataggaaaatgagtcattcttttttttttttttttttttttttgagacagagtcttgctctttcgcccaggccggactgcagtggcatgatctcggcttgctgcgagctccgcctcacgggttcacgccattctcctgcctcagcctcccaagtagctgggactacaggcgcccgccaccgcgcctggccaattttttgtattttttaagtagagacggggtttcaccgtgttagccaagatggtcttgatgtcctgacctcgtgatccacccacctcggcctcccaaagtgctgggattacaggcgtgagccaccgcccccggccgaaaatgagtcattctttgcatttcattcatttatgcccttagtcacaagggctttagcaaagaattggcttccaccctctctttaaggtaaggaaataaataatgaccttggaagacagtattcatcataaaagcgcttgatgaaaggagcaattggagtgaactatgtaaaacaggcttttcagtctaatgggacagtgtaattactggtgcagatttctagttaggccttaaagaaattaagcctccctatatggttaataatggacttgtgtaagaagattgcttcagagatgaagtttgtgattcacattagcatatttggcagtgaaagcgttacctttctcaatcaagcaggatatgtaagatctttgtgtatgcttttgctaaactttactgctgccatccctgaacttgacttgatatttttacatccccttcaagtctgcatcccagttttgtgtcatctacagttctgaagagctgccttgtgctttatcatcatccagggttgaaaagagccagatcattggagaatccccacagactgacagttttccctgaatcgatgcctgcttattgtgctcatgcaggtagctcctattccatctcacttcgctgcatgcagctcacatatttcagatgatccacaagaacattgggaaggacctgccaaaatcctgccttgctaaagtccaggtatactctcttccagatctcccttaactgcctttgcagattctatatcggagaaagaagtgaggctaatttcacaaacttattcttaccgaattcatttatagctctaataattaccacttttcttagatgtgatcccaaaacaatcctttaataaatgcattttagaactgcactgtccatagtggcagctacttgccatttaaatttaatttaaatgaattaaaatgaagcagacaaaaaatgcagtttctctattggactaaccatgtttcaagtgttcaatacctgccatattgggcagtgcagatagaacacttctatcattgcagaaatttctgttgaacagagctgttctaaaaccttgttttagaatcagatctgagctcacccgtctgcagattactcagtcatcatttgactgtttttttttttttttttttaaagagacagggtctcactttgttatccaggctggagtgcagtggtgccatcatagctcactgcagccttggactcctgagctcaagtgatcctcctgcctgtctcctgagtagctgggcctacaggtacatggcaccaggcctggacattatttaagtctttaagaaacatctacatgtgttttttcctgtcacctctctttttctccatttccttcaaaatcaccttgaaggcgactccatttctgtattgcccaaatcagtctacagtgtaggtgttggatgtggactttttttttggtttctaatgaggttgtgttgcagatgagctgaagccacctttgatattctaggatttgtgcctgaagaatagcgctttctgtcttgctgatgtttatatgactgctatgattgtcaagggaaataaggagaaatgaatgggatccacgttgcttggcccagcatacctgtttctgagtgctgttggagctgagaggcatgctcttggagaatcagccatcaagctgtcttttccagagtggatgttgtccagggcagttgcagagtgagcacactgtcaatgagtgcctggggtccttcatttatttctttacagcatctgtagtagaataaaattccagtgttaagagacaaaaaaaatgtgcccagctctcctggggttgacagtctcagttggtaaatcccatcccaagggggcagctcctctcctgtctgtggtttgcctgctgtcccccaggagccacactcaccagtttggtcagctggcagatgataagagggagagaatcttttagaaaacagatcctggagatcattgttagtggagaacttattatcaagtcaggaagaagaaaaatcattgttagttgagtgaatacattttaaaaaatgataaagtgttcgtcaggcacttgggatttcttgctcatatgctaataggatttttgaaaatccactcactgtttggaaacttgcttgctcagtgacaactgcatccaaatagcagatcatgagccaggtttgtggggggacaagagtgaagggagttcggaggaagtcgctctgggccaggaggcagggaccctggccaccagccatgtgacccggggcagatccttgcagtgctgggccttggttttggccactgccccctggccccccacttcccagaattattgtgaggaactgtgcgtgtatgtgcaggaactgggttaacatatctacttatggttggccgggcgcggtggctcacgcttgtaatcccagcactttgggaggccaaggcgggcggatcacaaggtcaagagatcgagaccatcctggccaacatggtgaaaccctgtctctactacaaacacaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtccttgctccctggtgtggggcatctgaagggctgtggtgggaagagggtcagaaccaaggccagatgcacccggagcttgctgcacgcacttctgggaggtttcctcttattttctctattttaatttctccattttctcttttctctctttcctctctttctggaattcccatctatctgatttttgacctattcattctatctttgaagtctctcttttctttcatatttttccatcttcttttctttctttctttttttttttttttttttttgagatggaatctctctctgttgcccactgcaacctccacctcctaggttcaagcaattctcctgcctcagcgtccagagtagctgggattacaggagcccgccactgcgcccggctaatttttgtgtttttagtagagacagcaatttcaccatgttggccaggctggtcttgaactcctgacctcaagtgatccgtccaccctggcctcccaaagtgctgggattacaggcatgcgccaatgtgcccggcaccatcttcttttctttccgttctgttttctgggatagttcaacgactttaaatacccatattgaaatgtttatgcttgctcttactttggctctctgagggctctttctattctttcgtcatttcttattttgtagcactgtatctttgtgtttctgcggcaatatcttcttctatttatttaaaggtattaatttgttattttgtttcttttttgacaattacttctgtttccttcactatcttttttcctttgctgtccttgtacttgcttgcctggattttcttcttcctgtttgagaccttcctcccagatctgtgagccgtggttgttaattcgcattgagaagtgaagcactgaaaattgactggagtgtctgcaacgtggctgcacattagcatcacctggaagcattaaaaactacctctcccgggggacagtctcagggccattggatgaagatctgttagattggggtctgcatattgataggttgataaataaagatattgatagagatcggtaggtagaaatacagattttccctcctcagcaattctaatgtgcaagcagggctgagcgttgtatagtcttgggtgacagtgccgggcctctggagagttggtataattaccgtgcagcgaaaccactctgcgttttactgtgccgggtgcctggaagactttgattgcatccatatgattctttttctgtacctctggcaaattgcagattgggaggaattatatatccctacagagacttcagtgaatgaagtttcagggacctatgagcaagaaggatgaactggcttcccggggaggggccagcagtccttctgccagacaagtcatcagggctgggacaggaagcatgggaagggcagctgtgcagagcaggatccaggaggggccacctggtggcaggtgtggccactgagcagcccctggctagggatggagctggagctgccagggaagctttgaggccaggtaacttggctcttgggctctcatgaagccaactgttcctctcccaagctctgagaaaacagtggagtcctggagtgacaggatatggtagctccataaggaggaggaacctgtagttggaggggcaacaccaggaggccagtgagcgatactctgtacctgagagaggtggccggaacctgggcccccacttgctgccagtgaccttgcacctgccacaccttctcttggagttttggcttctttaactgggacatgaggatcctgaccatctctgccaagcaggagaggaaatgggctgatgtgtgttgtgaggcagtagagactggggcataggaagcaaattgactctcagagtttatggtataaccttctcccacgctgtagggatcaggtttgcccctaaacctgcagactggctaaggccagggctggaaagggaaaaaagtaagcagaggacaggtcatgctgcaggccggcccctcacccctggtgacttgtgctcttggagtgagggcccaggagggggttgcctgcctatgcgtgtctctccctttccccctcctgttctgtggggctgggcctcacacggccattcttcgaaggaggaaggtggccttttgcattccctgttggtgtgttacttattgtcacttatttttgattaaggatattatatttagggagaaattatttgcattttctttgtaaatcatctgaagaattgtgcaacacaggagtgcattcgggaagaaaattcagacatcagagataaagcagagttctcccttggctgcatctacaaccttcctctccctagagaaccactctgtggttagtgtgttttccttcattatcttatataagcatttatgcatgtgtagatgtagatggctgtgttttgtttttatgcacatagaaggtatctgtgcattgttctgctgccggagttgttcagaacatggtattgtggagaaccacatgactgtacacacaggtctatcttagagacctgcctcatttgctttaactgctgcagaggcttccagggaccgtgtgtacagtactagatactgtttaatgaacactttcctactgatgaacatttaggttgtttcctaatgtttgctgtcacaaacagtgatgctggtgggttaatgcttctctaggggagagagcaagaagcagaagtgctggctgtcatctgcattctgcagtttaccagatactgtcaggttcccttcccaaatggctacagagtggtttggtccctgcagtgtcatcagttcccgacattataactttgcagatgtgatagggagaaaatctccattttattttttcatttcctggattatttgtgaagtcaagtatatttgcctgtgtttactggcacatgtattttctctttggtcaatttcccttttgtaatttttgctcagtttcccatggggttattcgtctttttcttattgatatctaggaaggtcacacgttcatgtgagtgtttgggtgtgtgggtatacaagcaaaaaaaggtttaatacatcctggatgctcattctttgatacatttacttcgactattttcttccagtctgttgtcttctgttttaggtgttttttttttttctcatccaggtttaaacattgtttattgttgtagctaaataattcactttatttagggattataagaaaatgtagaaagtaaatttgcattcttttcctttttcttagtattatgaaacttatttcttttttaaaaaaccagtctgttgaggtaagattgccatataaaagctgtacacattttttttttccagtgacttttttaaaaaatatatttaaaaacaaaaccggccgggtgctgtggctcacgcccgtaatcccagcactttgagaggccgagaggggtggatcacctgaggtcaggagtttgagaccagcctgaccaacatggtgaaacccggtctctactaaaaatacaaaaaaaaattagctgggtgtggtggcatgtacctgtaatcccagctactcgggaggctggggcaggagaattgcttgaacccgggaggcagaggttgcaatgagctgagatcatgccattgcactccagcctgggcaacaagagtgagactccatctcaaaaaacaaaagacaaaacgacctcctcccaaataacccccaaacaaacaaaaaaccagattaaataaaatttacagtgaatatacccagcaaacatttgtatgtgcaattcaatactgtgtctgttactgcggcacgaacctcagacaatatataagcgttctggggggtcgggagagtcccaagttttaactctgtggggtctaggaagacaagatggggaagtgagagaatggggaaatccgttttgtttatcttaattctttccatataaatatattcataaagaccaaaaaggaaaggaagcttgggatgttaaggtaataggagaataggagagtgtgggactttcccaattctgactgaccaaaaaatatgaaaggaattaattttatggtgggagaagagatttaaaaaataaaaaaaagaggatgggggccaggcacagtggctcatgcctgtaatcccagcactttgggaagccaaggcgggcggatcacctgaggtcaggagttgagaccagcctggccaacatggtgaaaccccgtctctactaaaaatacaaaaattagctgggcatggtggcgcgcgcctgtagtgccagctactcgggaggctgaggcaggagaatcacttgaacccaggagccacaggttgcagtgagccaagatcatgccactgcactccaaaaagctgtacatatttaatgtacaactttgtgagtttagagcgaagccaacccccatgaaaccattgccacagcgtgtgccgtaaacagatccatcacctgctcacgtttcctcctgcctactttattacgatgatgatgatttgtgatgagaaactcaacagaagatccaccttctcagcagatttttaactgtacaatacagtgttgttagctgtaggcactgtgctttatagtaaatctccagaacttactcagctcggacagctgataccgtgtaccctcggcccagcatctttccacttcccctacccccagctcctggaaacccccattctactctctgcttctatgagttgactttttaagattctgaatataagtgagatcatgcggtatttatctttctgtgcctggcctatttcacttaatgtcctccagtttcatccgtgtggctgtacatggcaggatttccttctttttaaaagccgaataacactccattgtaagtgtataccatgttttctttatctgttcatccctcaaaggacatttagattattcacatatcttgggtattgtgaataatgccgcagtgagcgtgggagtgcagacttctctctgaaataccgatttcagttcctttggatgtatgcccagcagtaggattgctggatcattcggaagttctatttttaattttttgaggaacctccatactattttccataatagtgataccaatttgtattcctatcaacagtgcacaaggattttcttttctgcacattctcaccaacgcttcttatctttcatccttttgatactagccattcttacaggtaatagtgtgttttgcatttccccgattggtcttttccttgatgattttttattgtcttatttaagaagggcttccttatactgagtatctaacattttagagtcacctattttacaataagtctttagtccccttgaaatttatttttgtgaatagcgtaactcagggatatatatatagcttttaaaaaatgagttgcaaagtttataacccattccccccaccagctgatttgacatgttacctttatcatatggtaaatcattatagatgatgagttgttctggactgtcttctgctggtctatttgtatactctcgtggaataaaaaattctatggttttatatccttcattgttcttctagagtgtttctgcaattgtttcctctgccatctgaattttattattctcattggaggttcttttggaattgcactgactttctaagttgatttggaccaaattaaaatacttaaaattgaaatatttactatattaaaatgcagtattatttgtttttatctgggaatgtagtgtatttttttcttgaaagttttgtacacttttgttatgttctttccctatatgctttatagttttgttgctattgtgtatgaaatattttttattattacattttctatttggttgttgctggtgcttaggagagccattgatttatgtgttaaactcatacctggccaccttgctaaacctttttcttagtcctaataattcgtccgttgattctcttggttttctataaagacaggaatattgtctgaaaaaaatgcctccttcttcccctcttccttctcaaactgtacacctcttgagatgtctctttgtgtttgtacttctaggtagggtaaccagccccagactgaaaggtgacagtgatagcagccttcctaatcttgtccctaaatttacaggggatacttttatggcgtcactataaaatgagatgttttgctgcacttggctgataaatatcctttatcaagttaagggagtttgcttcttggtctaccttttaaggtttattttaaatcaggaatgggttgtcgaatttgatggccattatacctttttccttttttttttttttttttttttttttttttttgagacagagtcttgctctgttgcctaggctggagtgtagtggcgcgatcttggctcactgcaacctctgtctccgaggttcaagcgattctcctgcctcagcctcccgagtaactgtgaatacaggcgtccgcccccatgcttgactaatttttgtatttttagtagagatggagttttgccatgttggccaggctggtcttgaactcctgacctcaagtgatccacctgcctcagcctcccaaagtgctgggattataggcatgagccaccacacttggccccattttatacctttttcatggaagtaaacattttctaattcacaataaaagagaaaaaagtataataaacacaacatatccattgccatatttgcttagatttgttgttagcattttattatatttgctacttctttcctttttgtcgattttttttttttttttgagatacagtctcgctctgttgcccaggctggagtacagtggcatgatctcggctcactgcaacctccacctcccaagttcaagcgattcttctgcctcagcctcctgagtagctgggattacaggtgcatgccaccatgcctggctaatttttgtatttttagtagagacggggtttcaccatgttagccaggctggtctcgaactgctgacctcaagtgacccacccacctcagcctcccaaagtgctagaattataggcacaagccactgtgcccggccttttttgctgaagttttaaaagttgtagccatcattatttggccatataagttcagcgtgcactttaaaaataagcacatcttcctacatttccacgagaccattatcatagtaacagcattcacagtaattcattgataacatttaatacccagtctatggtaaacactctccagttgttaccagaatgtcctctacagctggtttctttaccagggcctggtcactgcggagacagcactgtgggccctgatgtctccactccttctctaactggaatgcaccctcttcctttttgttccattacacctctctattgcagagactcacgtggaccagctgtcctgcatcaaatcccatcttcagcgttcgtctgattgctttctgggctagcatttaacttttctctctagctcttgcgcttcttgtaaatgggaatttcagtccaaaggcttgtgtgtttttgctgtgaaacaacagcagaatctcataggacgagaatttttcttcctgtttgtaggcagggtcagcaaaagggcaggtttgttcaggttgcaggtctgctggggtagctctgcctgacatgtttattctgagacccaaactagagggtaggggctgcatggggctcgtgttgcccatggtgagtcagaggaacacaggaggagcggatggaagcaggagatggcctgaggtatagccttggggcttgcaggtggacggttcccattccactgtcgagtatcaatggagtgggcagtgtgcttgtcccatggaggaggaaggggtatttgctgaatgattaaatccaacccaccaaagcatgtttagattcagactaaaagttcttggcaagaatacttcataagcggtggtgtatgcattctattgcagcatgtcacaattcacatgtaatacgtggttgtctcattagcaactgatctgactagttaccatttattaataagatgctgtgctgaacttctgttaacctcaaaaggggaaagcaccaggttcaaggctgaagaagagacccagagccaggaaacaagaattgggattttttttttttttttttttgagatggaatcttgttctgtcgcccaggctggcatgcagtggcgccatcttagctcactgcagtctccgccacctgggttcaagcaattttcctgtctcagcctcctgagcagctgggactacaggcacgtgccaccctgcccagctaatttttttgtaatttttagtagagacaggttttcaccgtgttagccaggatggtctcgattcgatctcttgaccttgtgatccgcctgcctcggcctcccagagtgctgggattacaggcgtgaggcactgcgcctggccaagacttgggattttattaggggcctgcatacaggggagacggatggtggtggattggaccagagaaccgccttatgtacagagatggtccagtgatgggctgggcgtggtggctcacgcctataatcccagcaatttgcgaggccgaggcgggcagatcacctgaggtcaggagttcgaggccaggctggccaccgtggtgaaaccccatctctgcaaaaatacaaaaattagccaggcgtggtggtgggtgcctgtaatcccagctactcgggaggctgaggcaggagaattgcttgaacccgggaggcagaggttgcagtgagccaagatcgtgccactgcactccagcctgggcgacagagcaagactccgactcaaaaaaaaaaaaaaagaaaagaaatggcccagagatggcgggctggataacatatcggccttcctgcagtcttgtggcagtgggctgggcaggaaagctgcaacttcttgccaactttatgcagtttatttagcatttctacttaacaccctcctcttaatgacccctacccagcaaccttcatttaccccaaaactcagggcctcaatgccctgtatggcccgtgttccataggatgttccaggggctcaaatgttcctcatagacaaggaacgaatctctgggttggccacacctgattccccagctcagagcacacactcaggtgcatctgccatacagggtccttctgagggtaggttcaagttatcgctgtcaggtgcatttaccctacagctggtgacagcttgagtcttcttttataaagtttcttatgcttgagactgacaagaaatctgtggctagttctttggcaccatgtatatgaacggccagttaaccctctgttatccattggtgatcctggcctgaatcagttaattcattagttgttgcaaattggtggtttcacaattctctcatactgttttcatttattagctgttattcttctgtaaagaagagattttccttatcacctggagctgttagaccaccctgaaatacagtatcgttagaacaggccgggcatggtggctcacgcctgtaatcccagcactttgggaggctgaggtgagcggatcacgaggtcaggagatcaagaccatcctatctaacaaggtgaaaccccgtctctactgaaaatacagaaaaaaaaaaaattagctgggcatggtgttgggcgcccatactcccagctactcatgaggctgaggcaggagaatggtgtgaagccaggaggcggagcttgcagtgagccgagatcctgccactgcactccagcctgggcgacagagcaagactctgtctcaaaaaaacaagaacaaaaaaaaccaaatccttatttctcttcaattgttaattttcagaataagaagttggcaatagccaattttaatggtatgatacattctcagggtgtgccatcttcccctttatgatataaaccatttttggtcatgacgtgttagtttttaatgctaatagtgaacctatttgttaaagtttgaggtaagatctttgcctctctcatgttggagactagtttgtgcttatcctttcataaaataaattgcttcagctttccatctcttttttgagatgtgacatcatggtaatctattccttgaaaatgtaataaaacgtgtttgtcaattcatctcggtctggcctttattaggttaccttgttattttaaaatatcttctatagctattcagtttttctacttattgagccaattgtggtaatttatattttcttagaaaatcttacatttcattcagttagatttgcaaattcattggcataaagttctgaaaagtattctcataattttataaatttttctgcatctgtaattatgggcttttcagttctaatgtttgtgttttctttctttttcttgatttgtcttatgatatgtattctttttatactgggccaactttcaattaattactgtcttaattttttttagtcttttatcttttttttctttttttttctttttgaggcagtcttgctctgttgcccaggctggagtgcagtggtgtgatctcagctcactgcagcctccgcctcccgggttcccgcattctcctgcctcagcccaccgagtagctgggactacaggcgcctgccaccacgcctggctaattttttgtatttttcgtagagatggggtttcaccgtgttagccaggatggtctcgatctcctgacctcatgatccgcccaccttgaagcctcccaaagtgctgggattacaggcgtgagccaccgtgcccggcctagtcttatatttttctaattccttcattttgattttcacttttatttcttagacttattttatacattaacactcttttcgtttttttttttaatttaatttttaagttttggggtacatgtgcaggatgtgcagcaggtttgttaggccggtaaacgtgtgccatggtggtttgctgcacctatcaacccatcaccgaggtattaagccccacatgcataagctgtttttcctaatgttctccctcccccgatcccacccctgacaggccccagtgtttgttgttcccctccctgtgtccatgttttctcagtgttcagctcccacttataagtgagaacatgtgatgtttggttttctgttcctttgtcagtttgctgaggataatggcttccagttccatccatgtttctgcaaaggatatgatgtcattcctttgtatggctgcatagtattccatggtatgtatatatgtaccacagtttctttatccagtctttcattgatgggcatttgggttgattccatgtctttgctattgtgaatagtgctgcagtgaacataggggtgcatgtatctttgtaacagaatgatttattttcctttgagcctataaaccagtaatgggatcactgggtcaaatggtatttctggttatagatctttgaggagtcaccacactgtcttccacagtggttgaactaacttgcattcccaccaacagtatacaagcattcctatttccccgaaacctcgccagcatttgttgtttcttgactttttaataatcaccatcctgactggcatgaggtggtatctcattgtggttttgatttgcatttctctaatgatcagtgatgttgagctttttttcatatgtttgatggccacataaatctcttcttttgagaagtgtctgttcatgttctttgcctgctttttaatggggttgtttgggttttttttcttgtaaatttaagttccttgtagattcttgatactagacctttgccaggtggctagattgcaaaaattttctcccactctgtgggttgcctgtttgctgtgatgatagtttcttttgctgtgcagaagctctttagtttaattagttcccatttgtcaatttttgcttttgatgcagttgcttttggcgatttcataatgaaatctttgctggtgcctatgtcctgaatggtattgtctagattttcttctagggtttttatagttttgggttttacatttaagtctttaatccatcttgagttaatttttgtatgaggtgtaaggaaggggtccagtttcaattttttgcatatagctagccacttcttccagcaccacttacaaacagggaatcctttccccattgcttgtttttgtcaggtctgttgaagatcagatgacattaacccacttttctaccaaaaaaaaaaaacccctctgtagtaaatgtgtatatttcctaatgagtactaatttggccatatcccctagttgtgatatctaattttttgttcatgtctaaaaatacatcatttacattttgaatgctttctaagcctcagttatttaatgtttaagaatttcccaggcatgtcatattttgttttgtttttgttctttaactatctttgtagcagtctgggtccactcaggagatgggaaccccagggggagcatcatatttaatagaattattaggtatgatgagagagtagctgttaagaggtggaagttctgtgtggtatcgtgggggtggagggagggggacctaagcaggggcagacctgggaaagccccagggaaggaccagcttgttagggaaggtgtggttcagcagtggagagcagggacagccgctggttcaggcagtccagcactggtctagagatgctgttggtcacaataggccaccctctggagtacaggctggggagcagtggcttgaggctgggcctgcggtgtgagttcgggcaccagcacgtccagaggtgccggacatgcagaaggaacgattgctcaacgcaggactctccagaccacgcgggctacatggggtttgtcgagggagtccagaggtggctggccatgtggagctctgggttcgaggcccaacaggtgtggccccaacaaggctgcagggttgcagaagaactaggtgcctctgtggcctgagccgggaactgcgggaaccgttttcctccagcaatgttgctccatcaccctctgcccagaaagcttaatgtgctcactctaaaggagaaacatgaccgggcccggtggctcacgcctgtaatcccagcactttggaaggcagaggcaggcggatcacgaaatcgggggatagagatcatcctggctaacatggtgaaaccccgtctctactaaaaatacttaaaaaaattagccgggcgtgatggcgggtgcctatagtcccagctactcgggaggctgaggcaggagaatggcgtgaacccgggaggcggagcttgcagtgagccgagatggccccactgcactctagcctgggccacagagccagactccgtctcaaaaaaataaaaataaataaataataataataataataaaataaaggagaaacgcttaagggaattctgtttattcagagaacatattgaggggtacattcagaattgggaggcaatgaattgataactgacacaacctttttgtcattcctttctaattgtcccattgtagtcagtgggtgtagccagtacagattctttgtagaatgtcacatttcttttgtggcctaatgctacataggcagttttggttaaacccatgtgagtatgtgtgtgtgtgtgtgtgtgtgtgtgtgtgtgtgtaaaacctccgccttctctatttgttaggtacggggttctaaataaatcttattgttatttaaatttttatatcccatctcatttttgtctggttaatttgattttaatctctcaatatgaatgtggctattaatttcaccttttatcattatttgcttggtttatattttgaagctatgttgtgaagtttataaaggtacatgatgctcttggtggattatttttgttattaatgggaatttttccttttatgcctttgcatactttgttgtttacattcattttgtctgattaatattgccatatgagccttctttttattagcacttgtctggtgtatcttttcctatacttttatttttagcagtcttcgtgccatttttttcaggtgtcatcagaagagactaagcaactcatggcttaattttctaaaataatctgaaaatctatgtttttcaacagatggactaaaagagagtataaagagcactgcattcatttgctcaggctgcggtaacaaaacacagacttggtgtcggaatccatagaaatgtattgcctcacagttctggaggctgggagtccaagatcaaggtgtcagcagggctggcctcctcgggccgtctctccttggccttgatgcccctgcatgtgttcttccttctgtgcctgttgtgtgcccctggggtctctctgtgtaccccaatttatcttttttttttgagatggagttttgctcttgttgcccaggctggagtgcagtggcgcaatcttggcccactgcaacctctgcctccccggttcaagtgattctctgccttagcctctggcaaaatgcccttttcaatcctccctgccattggctacttttaggatcctgctgattggtgcatgttacagattgctgattggtgtgttttacagagtgctgattggtgcattttacaatcctcttgctagctacagagtgctgattggtgcttttttacagagtgctaattggtgcattttacaatccacttgctagctacagagcgctgatgcattttacaatcctcttgtaagacagaaaagttctccaagtccccactcaacccaggaagttcagctggcttcacctctcacaaccaccccaagaaagttgagggtgaagtgcaggccatgcacaggatgctgtcttgatactgagaaaaggaaggtggtgttaaccacagaatttcatggccaggggtgagagttaatgtagcagaggggctctccttggaagggctgtctagaagaagagtgtgtaactctgggcaggataggaagaggtgacacctccatgagaaaagggactttgtcttttttgcccctgtctccccagcctgtggctggtgtgtgtcaaagaggcagagtcattcctgtgtagtcatgatggttagttttgtgtgttaactttgcccagctctggtgcccagttgatttgctcaaacaccagtctggatgttgctgggaaggtaatttttgggtaagatgaacatagtagaccttgagtaaagcagactgtccttcatatttggatgggcctaattcgatcagttgaaggccttaagaccaaaggctgaggttccccgaaggggaaggtcggcccccagacccccttgtgactcaagactggaatgtcaactcctcctggagttcccagcctgccggcctgccctgcagatttcagatttgccagcctctgcagtcatgtgagccaattccttgaaataaatctctttttatatatcctgttggttctctttctctgaaaattcctaatactgtagttttttcatctggtgatctatttggctatctcactaacttctgagttgggacagcctcagagtcagaagtcatgtgtctcctggaccctccatccccaaagcacagccccatgccaaaatatgcctttatgttagtagcactgcccagccctgttcagttttctgagatccagttcctacaagactgtggcactcagtacttttcatctcattgggttctgtgcctctggggctgttgcctctgagaccagatcccggatcctttctttgtgggctgctccacccctgctgtggaaatcacacagaaggcggacagtacatgtggacaggtcagacagacacactgattggccagctgcagcatggggagcatggactctgcccacagctgtggcgagatggctctgtggtgagatctgggctttcttgtgtgctgaggaatgggagcgtttgccatccttatccaagctgcatcactcagggctggcccctctgaggttgcactgtgggccccaccccagcctctgaacgagaattggcataccagccagatgcctaggtgatctgtgcatgtgctgcaggtggagaaggtctgcactagacatctccagaaggacgatctgggatcagggttagacaaggcccacgtctgctgcccagccctctcctctttgatgtcctttctgcacctgacacctcttcttgacattccctttccttggtttatgtggtaagacctctctgtccacaacaggaatggtcttacccatcttcttctcctaccatgtattaatagttccctgtgccttaaacccctgattcaaaacctgcttcctcaactctccaaagtcagccaagcgagaggttatgggcacagtcttccacaagactgccctcacttctgacaccagccccaaattcaggggtcctcaggcccatccttacttcttaccagctggtcaggggttcccatgaccagtcttaaattagataatttgctagaatgactcacagaactcagaacaccattatacttaacaatgacagtttcattatagcaaaaatttacaacccagaaccagacaaaagaaggaacacctggctgggcgcggtggctcacgcctgtaattccagcactttggaaggccgaggcagctggatcacgaggtcaggagatcgagaccatcctggctaataacggtgaaaccccgtctctactaaaaatatttttaaaaaattagccgagcgtggtggcgggcgcctgtagtcccagctactcgggaagctgaggcaggagaatggcgttaacccaggaggtggagcttgcagtgagctgagatggcaccactgcactccagcctgggcgacagagtgagactccatctcaaaaaaaaaaaaaaaaaaaaaaaaagaagaagggacacctagggtgaagtctgggaggcttccagatgcaaagctttggcgtcctcagagatgcattatcctcccagcatccaagtgtgacagtaatcaaagagtattgccaaaaaaggaacctcacctgagcttcaatgtctagagtttttatttgggattctttatgtaggtatgatgcatgatgaattgaatcagtgaattgattaaattgttggccatgtggttgagctcaatatctagccttcccagaagtcaggctggtagcccgtgtctcctgtctcaaagccccaaccctctagtagctagttggcctctctggcatcaccaacctccatcctgagtcatctcttttgcataaactttggaacgcaccacgaataacaaggacactcctatcacttggagattccaaggatgtagaggctccctccaaggtaccagaaggccagccaagttctttattacacaccaactgattgccatgacttagtggttaataaagagtggggcttggggttcctttagatttcaggcctgacacaaccccttggatatagactacatgaaatgaaagtgttaggaagggtgtatgcatgctatttgtttactttgaagagtgacacttggaaccaatgtcagttttacaggctgccctgacttgctggggcacagactgtgaagtgcatattcagaatgaatgaagtgttaccctacagcagtggctctcagacttgcaggcatcagaatcccctggagatcttttaacatgcagacttcagggtcctgcccctgagttttcattggtctgggggagggcccaagagtttctgtgtttgtggagttcccaggtgacactgatgctgctggcccagggaccacacttcaagaagccctggaatagactctgtggtgggtgtttgaactttggattcttggccataggtttttacattacaatgacagaatgggaagtttggcaggaataaagatgacttccacccacaggctcccggggaggtccttcttccctgggccctggcctggtgtctctgtctagcagctagctagcattcaggtcccaggtctcacattttggctggactttaatggcaattgatgggcaagtgcaggctgttcttgcaggggagggagtgctgcctctgcttgggctgctaggcttggggcctggtcacctggggccactgcccttccttcagtcttgccagacaggcagaggagtaagggcttgctaccggggcagagaacatcgaatgattgcaatcgtggggtcattaggattaattagtaaatagccatcagatcttaaaaaatagattcaggaacagcctgggagggcatttgggtgtggtttcccagtttgaggggaaagcatgaatcgactactatctcaggtagggctctggtgctgggaccctgctcaggccagttaagtgacagtggatgtggcctggaaatcctgtttctctcatgttcagtgagggtggaattaggggtgtgtgtggggaccttgggggcgccatgtgatgattaactgtagtctgtctcagttgtggaagctgctaatgtgtttttctgggacatcatcatgggatttttattattgatttcagcagggagactgctggctcattatgtgacaagaaatcgatgtggtgttccacgttcgaagcaggggttctccgtgacgtgcgggccctggaccagcagcctcagcatcccctgggcatgtgtgagcagtgcacactcccagcctccccctgacctgctgagccagaagctctagggctgggagccagaagccccgcaggtggctctgctgcatgggaaggaactgttgggatgcaaagcaggccagagaggacaggagcagacaaagatctgaagctgaatatggacccctcagggtgccagctgtcaccccggagcgcccccctacctggggaagctttggcaaccttcctggttgcaagccaaggcccagggactccaccgctggtgacccccttacctggccctggctgtgccctttggctcagggctgggcccgggaggctggagaggtgccagggttcattgccagaggctgccttgcccctcccttgtgtccttgtaggcagagccctcacccccctatgctttcccgccacccaccagccacacctccttgcccaggcctcagtgcctgacagatggcctgaatacatatatatatattttttgtcttaaaaaactattttttttaacatatctacagactctccccttaccaggtatttcttggggaagaaaatgttgcttagtagacaaatgtccccaggtctccttcagggaggatgagcatcacctgcattgaggaaggggtgcttcagcagagatgctcacttcaaagcgagcctcactagtagccacagggtgcacagctaggatgggaggcagtgctgctgagccaaggggtggtgggagcagctctggagaaacctggtcgggtggtgggtgaagctgcctccaccccagcaagcgatatggggcctccccactggactggggaactgtgtatgagggtttggggtgcagagacctcaggtggccttcaaaggaggggtggccagaggcccagcaggtgactcccacacctcttttacatcatctcctgctgaacaccccagagttccctgcttcttacagtggtaacatttgtttaggagttgtgcagtaagtagaccaggcatggtggttcatgcctgaaatcccaacattttgggaggctgaggcaggcagattgcttgagtccaagactttgagaccagcccgggcaacatggtgagaccctgtttctataaaaaatacaaaaattagccaggcaaggtggtgtgtacctgtcatctcagctattttggaggctaaggtaggaggattgcttgaacctgggaggtggaggttgcagtgagctgagatcacaccagtccactccagcctggataacagagagagaccctgtctccaaaaaaaaaaagagaaagttttgcataaataaagttaaattatttaaaataaaattatttaaaataaaagttaaattgtttaaaataagctaggagaaacttgctacttaaagacatcttttgggagaatttttattcagaagataatcatttatcaaagtgattgagtaacctgtaatttatccagtggagtttaatttaagcatttgaatttcatgtttacccttttagcagctatcattgaacccgtcttggtagctccaaagcacacttaaatatgagatgcagcccctgcctccattggcttatggactgggtgggtgtgtagccaccgtgtacagaaagttaaagatggttctagggaccaggcaaacagcctggggtgagttaccagaaggatgatgtgaatcatcgtgtgagattacaggttgcccatcaccatggccagtgcctctgagggtttgttgggattagaggggcagcttccaggcctttcaggagaggagggtctttacatgtcttttgtgggtgaggacctgaggcaagcagagagagacagccagagttacgtggggctggaagaaatcaggccagagtgactgggacccttgactctccttgttagagggtgtgtttgtccattttgtcctcttataacgtagtaccacagactgggtaatttataaagaaaagaagtttattggctcaaagttctggaggttgggaagtccaagagcatggtgccagcatctggtgagggcctttgtgctgcctcataacatggtggaaggcatcacatggcaaagagacagagagacaagataggggctaaacttaacctcttatgaggagccctctccctgggtaatggcattaatccattcctgacggcagagtcctcatggcctaatcacctcttcagcatactgtctcttaatactgttataatggcaatcaaatttccacatgagtattggcagggacttctgaaccatagcagagggactgccttccccatggatcctggtgtcctgcaccctgggcccagtccactctctggctggcacctctggttttgccccccaggactctgtaagctctagccaaggcagctggtgctgtgcttgccagctctgtgctttgacaacaacttctgccttccccacactgtctgaactccagggtctcctcttcgttttggtgttgggggactctggctcaccacagagctcctctccaggcacgtccctccacagcacctgggaaatccccttttctggctccaagtgacctatcttccgagggctacttgggaattcacagaacctcagctatggagaagctcagaggattgggggattgaaaccgtaggtcatccttgaatggttagcttttgaaaataattgtgcatttttccgtggtatgggttggtttcctgtcctgtctccacagtgctgaaccaaatcagcaacgctgcactttgcaactctgacagttgagcttcctggtcctgcgattagagccctcaagatagtactgaagcattaggtgaacggtggggacagaagcccagactctgtctggagtaggggccctggagggacacacacccacttcctatttggctctgtcctatatgcaggcattttttttttttttttttttttttctgagacgaagtctcactctgttgcccaagctggagtgcagtgaggccatcttggctcgctgcaacctccacctcctgggttcaaatgattctcttgcctcagcctcccgagtagctgggattacaggtgtgcgccaccacacctggctgatttttgtatgtttagtagagacaggatttcactatgttggccaggctggtctcaaactcctgacctcatgatctgcccgccttggcctcccaaagtgctgggattacaggtgtgagccactacgcctggcgcatgcattttttagaaggaccttgagatgatttactattgttgatcaaggaagaagatgaagcggggagatatgctgccttgaaagtgtcctttgagcatgcagccttatttcagctgtatgtcagggtgtgtgtgtgtgtgtgtgtgtgtgtgtgtgtgtgtgtgtgtgtgtgtgtgtgtgtgtatcagggttgctgctgaggagttgcattgcttccctaaggcccaccagggagattcctgtgagggggtcagacagggcctttgaagttttatgtgttattaaagaaggtcgtatcttattaccacaaagacctgggatatctgcagcagggagtggtagaggagaggctgtcaggccagcccttaacagcgtaactctctcattccttcctcagttcctccttatcctcctggcatccagctccccatcagaaactgtgaatcctaagatatgatgggaccatggacccttcacatttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaatcgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaatagagtttctgtggttgggtttttttccctcctttgatctgagtgctgactgatttgggaaatagcacagtgggcagaggcagcaaaactctgtgagaaacccatctttgtggccagagggttgaaaagaggaacgctgcaagctgaagattaggagggatcactgttttgttttgtcttttcctctctcctggccctgccagacccagagcagtagcacctactaccctgagagaaaatccaactctctggttggaggaaccggttgttgcataaaggtggtgggaagaatccccatttttttctctttctcattctgctttgccctcagcaggggctgcagttgcaagaaactgtgaaagagtgtgatgtgttaggctaaaactctgggagagccccaactttatgggcagaggaaccaggaaaaggtgcatctggtagtagcggaatatggaagaaatcttggagaggggaaatctggaaaagagggtttatttatgtttctgaaccaactccatgtatgggatatacccagagaaccatagcaaaggctttggatttaagctgcaatagaaaccgtggcccgggtcccagacttaatccctgaatagctcgtgcttgaagccaactcacagagcacagcaaagggttttgaaaccgcactgacgttaactccatcccctaacgaaggggaaccagagcttgtgttctcaacctgagtggatttatcgtctgatgaagcagacacatgaaaatcaacattctctacattctcaacattctctctcattcaacatttttaatcagggttaaaatgtacatattaaagcgatctgggatgcaatctacaattatttgggatacaaagaagcaaaaaaatctgactaattcttcagtcaatcaattaaaaatattttttaaatgacccagttctcaagggaaaaggcaattaacaaatgtcaaccctgagatgacatagatgttgaaattatcaaagactttaaagtgactgttataaccatgttccatgaggtaaaagatggacagttctgaaattaacagaaacatagaaattcgcagcagggcaatatgaaaaaaaaaagaaaaaaataggaattttagaatgaagtaaaaatattactggatgagttcaaaagcaaatgtatatgacagaagaaagaatctaagttagctctaagtagatcaatagaaattatcctgaataaaagaaaaatgagtttaagaaatgagtaggccaggtgtgatggctcatgcctgtagtctcagcactttgggaggccaaggtgggaggatcattgagccaggagtttaagatcggcatgggcaatatggtaagacctcttctctactaaataaataagtaaataaataaaattttgctgagcctggtggcacacacctgtagtgccatctactcagaaggctgaggcaggaggatcacttgatccccagaggttgaggctgcagtgagccatatttgtgccactttactccagcctgggtgacagagcaagaccctgtctcagaaaaaaaaaaaaaaaagcaattattaaaaaaaggtatcatttacaatagcatccccccaaaaaagaaagaactacatataaataagaaaatatacaagatccgtatgctggagactaaagaatactgatgagagaaatcaaagacccaactcatggaaagatatatttatattttggaagattcagtatagttgtgaattctccccaaatcgacctatagattcattgcaatcccaatcaaatttccagcaggatttaaaaaactagatattgataatgggattctaaaatttatatagaaaaataagggatcaatagtggaaacaatggttagatccctggtgaaaaaatattcctgattacatgcgggagaatttcccagaagatgaaaaacaagggaactctgaactttgaataaagggcacatgatccttatggactttcttagttctctagggctgctgtaagaagtccacagactgggtggcataaacaacagaagcttactgtctcagttctggaggctggaagtcccagattgaggtgtcctcaggactggtgcctcatgagggctgtgagggaaagtctgtcccatgcgtctccgtttgcttgtggtggtttgctggcgatctttgatgttccctagtttagagccctgccttcatcctgtttgtgtgactgtctccacaattcccctctttagaggacaccagtcctattgggttagggcctacgcaaattactgtatgtcaactaattatatctgcagtaatccccttcctctctctctctcgctgtctcttcttttctttctttcctcactgtgttgccaggctggagtgcagtggcccgatctcagctcactgcaacctctgcctcccgagtttaagagagtctcctgcctcagcctcctgagtagctgggactacaagtgcatgccaccacgtgtatttttagtagagacagggtttcactgtgttagccaggatggtctcagtctcctgaccttgtgatccgcccgcctcggcctcccaaagtgctgggattacaggagtgagccaccacacccagctgcagtgatcctatttctaaacaaagtatattctgaggtacaggggatgagaacttaaacatatgaattttgaggggacataattcagccataacacggatgtggcttattttaaatctacacagtactgtatgcacttggaaatgactagaaaaatgtgaaaatcacagggcaacaagcagaagcagacttttccccctcgagtcttgtggccgcttctctgggggtgacagatttctttgtctctgaggatggatctggtagagggtgtatttagcagtgtacttctttgcacggggtcctggcagctgcagaagctgcgcccctttctccagcatgttaagaaaaaggtcagtgctggtaacgttctgtgttcagttgccctcttatctggaccctcgcttttcccctaaaggcatccaggagcaaacatgacatgcagaggtagactttgccaaggcaccgctatttccagaagttcttgtgggagagagttgacttcttactgttagacgtaacccaggaagaacagcaaataccggccaggccagaagtgcacacagttactctgttcctgttacggcattaatgctgctttcaggcgtggactacattgtgagatattgaaaatgccatttcctggagactagtattgatgatgaaggtctgacagcaattttaatgatgtttaaagggcagatcatcgccctttgcgtatttcgagatgaggatgcagtggggcagatgtctcagcatattgaatgcccagaaggaagaagttaggcccaacattaaccccaagcctcttccaagggctgctgagacttaacacccttcccaccgcagaaatgtcacctgacaggtatggctgcccaaggcttcctgggcttttttatgcttgtcttttttatgttatttgtctgtagaagtactatagccaggaatgactagaggaaggaaataggtaccattgtcccatcactcgaaggcagcccttgctaacgtcttaatgcatttcttcacagttgattctgtgtttatttgttgtgaataaatcataacaatacatattacatgctaagccttttgtaaatatttcagatgccacaaaattgtcttgtggaagtgctaacactgatttatctaggatcctgttattgaaggtttagtgtgtgctcaatatttttgtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtccacacatggtgaaaggggcaaggcagctctctggggtctttttcttctttcttttttccttccttccttcctctctccctccctccctccttctctctctctctctctctctctctctctctctcgtctcgcactgtcacctgggctggagtgcaatggcgtgatctcggctcactgcaacctccgcctcccaggttcgagtgattctctttgcctcagcctcccaagtagctgggattacaggtgcacgccaccatgcctggctaattttttttttttttttttgtatttttagtagagatgggatttcacaatgttggccaggctggtctcaaactcaagaccatgtgatctgccagcctcggcctcccaaagtgttgggattacaggcatgagccaccacgcccggcctggggtctctttcataagggcacagtcccactcatgagctccaccctcatgacctcatcactccccaaagaccccacctcctaatgccatcacactgggggtcaggatttctacatgtgaattttgggggcgatgcaaacattcagtctgtagtggtcagatgatatctattcagctgggaaataggatgtagccattaaaatgatacctatggagagcttgtgttgcttaccgcatgttaaaagagaacaacatggatttgtgtttacagtaaggtctcggctatgcaaaagagatgcacagataaaagactggaaagaaagaaaccaccaaacaaacactggctttctatgggtggaacaactgtgagtgggcatccattcctctctatatttcctattaagaacacagagcaaaacagattgtagtccttgttgctgggaagtaatgtgccctcagaaacagtcaccctctgagtacagaagtctgcccacatcagtttcacaaatgatgtgctagatgattagtcatatctccggctctctcctgccctcctacagggcagctgtccccatataacagttgtatccctagaaggagtatgcagttaaagtaattggagattctttgaccagacgttttgagagtctggcagcccggaaaggtgggatttggcagctatgtgggaccttccttcaggcactaaagggcttcctgaaaaagttgcttacacattgaggtgtgttaaatggaattctttatcataaggctgcaaactgcttctgtgcaaaaggcaatgtgttagttccttgcaggaatatgcttttagtgaactcaatgagataccagaaatccagtaggagaacactttctttgaaagaaccacttgtttctacctacgtttttgcccacctttccttctcacctccccttggccacaccccacttttgtgtcttgggaattatctgctgtgctctgaatagccccgtcctgccaggccacccacctttgcccttgtttgaagaagctggggacagttgtccttgctctccaccccctggagtaggggaagaaggcttggaatgtggtgggcctaggcttcttggtgagggccttgtatttgttgacaaggaggtcagatccattccctgggccgtcatcagagacctgcaagcatctacttagggcagagttttcaagtgcagtctttggacctccaacatgagaaccacctgcagctctagacctggcctttggcccacaaccttggaatcttgggccatgaacctgcacactctccaggtgggccttgtgcccaccaaagtgagcgaatcactgcattggaggagtgactcttggcttttcacaaggacctctccctgctttcctcagtccctccaagatgcacccatatcccactgcagggatgcaatttgcatacatagccagggacagtgtcatctggccacagccactcccagccacctgtgtcagcagagttccccgttcccatctaagacattcacctcatcaggcatctctcctggaccatttcattgacattttccttaactccctttatgtagtgtttatggagttcaggcctgcactggttgctctcttctttaactcgcttcaagccctgcaggcacatactgtcattttcagtttcctaaggaggggaaggccatctctccattaaatatcttgccccaggcctcacagtaaacagaggtctgaattgaaacaaggaccttcagtcttcatctttaacaggcgggctctttgtcttataccaaaagtgccccagtaggttccgtgtaattctgtggagtctttgaagacgtggctgccttctgggtagctgctgtgggtcccttaccctttgcactcatgggaaagagagctggatcagaatgtctgtggtgtcaaactcaggaaaagagctgccattagccagcgctagcattgtagtcatggtgaaaaacgggatcattaccagtccacagccaagccatattgcagcctgaggcaacaggaaaaatcaggaataccaatcctatcttcatttacaattttgatattttgttcatcatggatttattttgccttagttttgatttctaaagcattgcattaaaatattatttatttttgattgcttaggtttttggggcctccctgatctccccctggttcagccatcgtaaagtgaaagcattttcattgcaatgaggaataagtcaagggtgcctgttagtgccattgttaactcctcagggaagtgcagggcagggtagttagacaagatgaccacatgccggaaaggggaagcaaaatggtgacttctgaaagtgacatcatttacctagaaaaacattatcaactaaaaactattaggatttaaaaatagcttagtaaaatctatttttacaaaatcaatatcattttttttctgtatgccaacaataaccaggtaaatatataaggaagagatctattcgcaacagccacagaaatattatatttaagaaaaaacttaatatgagatgtctacagctataaagaaaattacaaagccgttgagagacatttaagacttcaataaataggaagatttttttgggtgaaattgggtaaaaagactcagtattgtaagtatgaataatttctgaggccggggcacggtggctcactcttgtaatcccagcactttgggaaaccgaggtggctgatcacttgaggcaggagttggacaccaacccggccaacatggcaaaacttcatctctacaaaaaatacaaaaattagccggagggtgatgacacatgcctgtaatcccagccactcaggaggctgaggcacaagaatcactttaacccaggaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgtttacactttctgatgggttaaatatttcagtgtcaaaaataaaggattctagacagtgactggatttgcttgctccaagggaagaggtttgacccctcccatgaaaagtctggaacttctggagctagggacaggtgcagcacacagactcagggagtttcaggggagcaccttattcctgtgcctctaggaagggtggacattttccctggaagcaagcagatctggctgaggacagcctatctctgtcatacctaaaaaatacaggcacctcttcacatctcaacagtgaagtcccagatgaccaccctgactgcctccagctcaccataaaatcctctcccactgtatcttacactgcccagccatccaccagtcgctgaaagacatgcactggtgtctcaggggccctttgttgccagcaagagcaaagacaggtcacatgctatatcttgctgaaaagtgagttagtgttttggaaggtcaaatggaggaactaatttataccacacagaaaaaaatgtgaaatgggtgctatgagtgtaaagttcagtgatttggagggcaaattccagagatattccagaaagagaaaaaggccattagggagagaaataaaaaagaaatagcaagaatcttcctgtaactaaagtaagatgtgggacttgattcggaaagggctcaccaaatgaatctcacataaaattaatgagaccctcataaaattaaaaaagacccttatctagacatagtttgctggaatttctgaactctaagagtggagaggaaattgtatcagcttccagacggaaggaatagatttttgtaccaaggtaaaaagaatctgaatagtattaaaatgcacatctgcgagactgtaagctagaagatagtggaacagtgttagcaaattattgtgaaaaggatgcaatacaataatcttatacctagcaaaggtatcattctatgtgagatcagagccattttatagatacaaaagagttacctcctaagtaaacaaaatgactctaacaattatttttacaaaataaaaatgaaatcccactaaatagttcaagagaaagaaatgcaaaaagtataggaagcagtggtaagttatgaattgagtaattatagtccaaattatattgttgtcgtagtgttatacatctggaataaatttttctgaaatcatctgaaggcttggagagctaataggaaacaccagtggaaaataaactcctggttctattgtagttctcctacaatgtcctcagtgttttcatttttgaaaacttgaataacattttaataggatctggactgttccatgttactgtaatgtgtattttagtccttatgtcctatattggcctagagaatattttatttagtgttggtatacatatttatatgtgcatattacagattttatccccccgaatgacagagattttgaagttaagatagcaagagtactgtgtactttagtttgttctcttaacaaggatgtgcataccttcaacgtgcacagcttgatgtcagagcctggcgagaaacagggatgctgtagagatggcaccgctatgcaaggaatgggagctgtgtgctcatgtgccagtgatgtaccatctgccctttgccgtcctgacgtcaagacatggacgtctggttgcatgttagcagctgcattcagcacatgcttctgagagaccgttttgaggaatgtagttactggagattgtgtctgagagttgtggttgctaagtccctgacatcactcctgcagcctctctcttgtggctggctgtcctctgtgaagataagaaatctggtgacaagttatatgtggtctttgaggcagctcagtgttcttgatgtgtcctctgacacatctgggttgcagatgtcttagtgagtgctggccccttgttctcttctagggaacagctctttcgaattgtcctgccagtttcagggtttgcgaatggggtgacgggccctgcagggtccatctcagtgacaattttcctggtgtgggacatctttgctgtctgtgggccactctagggggagtgctgtgaattgctccgcataccagtgatgctcctgaaacacggccatggacaagcctgtgcaggtggcggagtaaacattgcttctttagatgtcaagtgtccttggagtgaattcacacgttggaagcatgtggctccatcagtaattgtgcccacactctgagtgtctggactggatgaaataattatctccttcttcgttcttttgggaatattcatactgctgtaaccgtgaccatctggtacactcagtctcataacaagatgtgttttgggcaccactacaaacaaggtgctgtgtttggagctctggggggatacacaatatggaaggccttgagtttgtggcctaaactaaagagacaagaggggaagaggaggtacaggaaggcaagatgagagcccgggcagtgactgctgagggtcactgatagctcctctttcatcttcacttcctgctcccatctgagcccagatccctttgcttctgccacctaaggtcctcactgagccacttctccactgtcctctctactgttttagtttaagctctccttttttttctttttaaaaattgcagtaaaatagacataaaaaatttagcattttaagcattttcaagtgtgcaagctcttaactggactactggaatatgtttttttaaataattgaactatcatgcaagcaaaaaggcatgtgtaatgtaagagtacagtttaaagaatatgacaaacatttggggaagcaattagctgaagaagtagaacgttgctgggcgtggcggctcacccctgtaatcccagcacttttagaggccgaggtgggcggatcacgaggtcaggagatcgtgaccatcctagctaacacggtgaaaccccgtctctactaaaaatacgaaaaattagctcggcatggtgggggacacctgtagtcccagctactcgggaggctgaggcaggagaatggtgtgaacccaggaggtggaacttgcagtgagctgagatggtgccactgcactccatcctgggcgacagagcgagactccatctcaaaaaaaaaaaaaagaagtagaacgttaagcaaacttttggacgtcctctgtgccactttcctgatgctagccccttgctttcccccagaagagagaatagccttttcactggtctccctgcctctagcctctagcctctgtccccacgccaggcccagagagacagggctaaaagaaaaaatgttgaaaatggctcagtgactgtgcacatgtcttagtctgttttctgttgctataacagaatacctaagactggttgattataaagaatggagatttgtttctcacagttctggaggctgggaagtccaaggtcaaggtgccagcatctggtaagggccttcttgctatgtcatcccaaggcagaggtgagaaggtgagggagaatgagaaagagagcaagagagagccaaactcacttttataacaaacccactctcacaataaagaacttcctcccaagataaagacattaatccattcatgagagcacagccctcatgacctaatcacctttcaaaggtcccacctctcaacactgttgcattagggattaagtctccaacgcatgaactttgggggacatattaaggccatagccgtgtggtttgggggataaagtgcagagtcctgggcactgggtccaggccctctcccagtttggcctgccaggtctctgcagctgccctgtcaccccacgatacctgcaggctgcggctgcaccctttgtcctcttctccccatggccgagcagtgctgtcccctctgctgagccctccagcctgccacgctggggacttgtgtagagcttttctgcacattgctcagcctggatggtccctgcgcatccagttcctcggtgaacattgttcagtttgagggggaagaggagggagaggatgggataagcctgaaggggaaggtacccaagatagtctttgaggggtcatggatttagattgggaagagttattgtccctcctcattggtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtaggaccctggctgtcctggggaagggagcagaggggcccgagagcaagggacctcagggtacaggccttgcagatgctgaagcgaggcggtggggggtgctgggtgcctcacagttctaatggtggctgagctcttcattggtccagttgggagacatgttgcgtggatgctccggccactcttaagctcaccgctcagactcaggactaaagccggttgagggctgagtggcaactcgtgtctcgcagaagacacccctcctcccaccctagaagagaggttcgatttcttgcccactgccctggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtctctgaaagcccgggggccttggcctgatgggcaatcagctgtgaatacctatttggaaaaggattttttgaaggtttgacaaaacctcggggaagaaacgcatgctaatgagggcagtggatgtcagcataactgtattttaattatagcaaagtcagcgtgcattctaataaacacatttgaaaagccaccttccaaaaaaagcctcactgtgagtatataaagaagatgtgattattggacttgtgtgaaggaacttctatttggccaattatgtggacttctgtcatatttttttacagccttaactgttaaatatttttttccgagaagagttcatgaatttgagtgtgtgtgtgtgtgtgtgtgtgtgtgtgtgtgtgtgtgtgtgtactgagagcttgggtttggaatggaaatcattggattttcagcacttatattttaattgactcctggattttcagcacttgtattttaatgtcttgtattctctctaaagaacgttaagtgtcagttgacttcactttgggggtgttcctgtcattcacagcaattccgtgtttacagggggctgtgggatgcataggagctcccatggtactagtgggtgttgggagagttcacccctaaggccaggaggctctggaccctgggtctgggctttaggccaaagcaaagtgtttctttggtctttagcagggcctgggcttgtcccacaacagtggtgaaggcacctcagggattgacgtgggctgtgcagagcgtgtgacatgctgcgtcttattgtgacaaatggcatcgctagccaagttcttgtcaaagaagattatctttagagcgtggtggggagtaagcaagacctgatattttctggttttgtgcttcatgctaaccagatggtaatttgggtaaaaacacagagatcttgcgattggagagctgggaggtaaatgagtgggaatgaatggatggatgggtgatagtagctgtttaaaagggcaggtggaggtaggggaagtccccagccattgtggaggatcaagaggatgtctgttcttcccagaagaggcattgaatgaaaaagtatgtcacttctccccctaaggagaatgtgtccttgaaggacatgctcttgtctgagacactggaaaagttcatttaaactggttaatgattgtatagcttttgttttgttttgtttttccctccctccctcctttctgtcctttcctcctttcctcccttcctcccttcctccctccctccctccctccctccctccctccctccttctctccctccctccctccctcctctctctctctctctctctctctctctttctttctttctttcctatcagttcacaaattaattctgtcaaggggaacacctgctagttccagagttccaggctgacaagtaccctggtgccaggggccctgactactctttctgaagactctaccaggcccgctgcacgtgggcagggtctccacattcttagatttgagtaccccattccagatgaggacctctttgaaacctgaccagaaagagccgtagaattcatcttgaaagcaagattttttatgaaggatgtgcactgggagatttggtgctgccttgcttgaaataacaacctgctttcctaagaacaatccccttcctcccctgggggacagccaggccgtgccaggagccaacaaaggcctggcctcaagcaggtgcacagggtgccatgtgtcccatgctcacctctctgatcccagtgctgtccacatagtgtagtgatccctatggttgaggctgcagtaaaaaaaaaatctgaagggagaaatgggcaatattggtcacttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtcgatacgaaaaatgagttgccggctgggtgcagtggctcacacttgtaatcccagcactttgggaggccaaggtgggcaaatcacctgaggtcaggagttcgagaccagcctgaccaacatggtgaaaccctgtctctgctaaaaatataaaaattagatgggcatggtagtgtgcaccagtaatcccagctactcaggaggctgaggcaggagaatcgcttgagcctgggaggcagaagctgcagtgagccgagatagcaccactgcactccaacgttggcaacaaagtgagactcccacctccaaaaaaaaaagaaaagaaaaatgagttgtgcctgtactaagaagtaggttgtgtggcctttggagccctcctgagctgtaggatgccatgcattttgaaaaggctccagtttgcagggagccctcccacctgtgccactctgctgagaccaagaggtctgcccgggggctgggatatgagaggcacaaaggtgatagagtttctaaaattgtaggaagacaggttggggaacagagatctacacttgaattattttagtaaaataaaaaaaggttatttcaaagcactgcaagtttactgaggaaaatttggaaaatacaggcaaaaaaatcttttgccatgtggcattgtagaattccactgtagagttttcaaatcaaagagacaaacctaggtcaggatttcccaaaacacgctcttagaggtgttgtgtaaacaaagtaccatttgatccttactattcatggatttgatatttgcaactttgttaacttgctaaaattgatttgtaaccctgaaatcaatactcgtagcactttcccagtcatttgtggaggtacagagaggggaagaatttgagtcacccaactctcacgttcccagctgaggttgaacaaggctttgccttcttgtttcagctctcatactgtaaacagctgttcttttcacaatctatttaatgttctttgcatttttgttgatatgtgtgtgtgtgtgtgtgtgttggtgataaaatggccctcaagtgtggtgctgaagcctagtgatcctaagcacagaatggctgccatgtgccttacatgtgctagagaagcttccttcagggctgagcgacagtgctgactcgtctatgctgccactctgggaggtgctaaagtaaacttctgtagcgtatgatgaagttaaggaaaaggtggaggaatggctaaatttgcagattcatgggacaataactgattaaaaaacacatagtggacaggtagaaaacccaagaactttactgtcttgtgatctagggtcagggaaatgttaaactcttctcagctagtgttttatgttaaagaaatattgcatataattaattatttataagaaatctatattaaacaaggtgcgtataaacagaaacacacataaaacaaggttctgtgttgattcattgacaaaaatgtgtcccgaggctcataggaacctaaccctgtatcgcccctaggagcaatgtattcagtattcatcaactcagtgctcagggcagctttacagaacataactatgtgaatgagaattggttgtatttggttggcaaatgactttgggaaactttgctgcaaagtttttcccttcttgggggtttactgatttctcacacacaagtagcataaagtcccacgttcgctatagcggagacaccagccagcctggccagtgcttcccaaacatggtgtatcagcaagcccttttccctccatgcagggtctgtgggagaatacagacccaagctttacaccctggggagtaaaggacccgtacacatgaactcccaaggcctctccctgtatgcttcagttccaagatgattcagcaaccccaaatggtgatgatggaaaggttgtcattgtgttatcatcaggacccttggcttctgcagatttaacctttcttattttgtggtttgtgtaaagtccgtgggtgccggtggaggtggcagcagtgttggcggtgactgccagcaccatgttaggggtgttaggaatatgatcgcagtaaatcctagagcaacccagagagagggagctagggttagtcccgtgttgcagatggcacagttaagtagctcacctgtgaatagactgtggactgtgttatgccaaaacccgtgcctctgaacagtgcataacacagcccttgaagaacctgagaagagaaagcgtccagttctgttcagtccgcgtttgagcctgcctgctggagggtgagtcagtgtgggggaactgtgcagtgttcctcctggagagtgatggtctcttctcctctgttgtctgtttccttgctgttgaaaggcttggcgtgccctgttgttctcagtgagtgggatacggtgccagtgaggtgaccagtagatacggaagcctccggtctgtaaaatgtccccatctcagtgctaacgtgtcctaagttcaccagggctcaggccacagatcaaacaagtcaagtaaagattgttcatgtggcatttttcttaatttttttgagctttgttgacataacgtattgattttttttttcatgcagtgattaaggaatacatgagttgggtccagcaaggctcgtattgtgtgacctgatggaattagtattactacacctacccatgtggccctctactatcaggcagtgaagcgtgagtggagggaggaccccagctgggcactggtacctggctcagtctcacagctccagggatgagcctgtggacctggcacgtccttggtgccttcccttgaagagagtagtttgctcatcagtgctttccctggggcaactcacccacactcctggggggcaccataagagcgtttgtccagcaccaaagatcctagttctgtgggtctgtggggtggccctggatggcatgttctctggatgcctctgggtggcctgtggaacataaagggtttggcgagggctggacggattgttttggagccccatcccacctgttaccttgtgacgtctatcaggagatacactgaaaaggtcagccctgcctgaaattctccctgtagagacttactcctttggaccttggagatttctggagctgcaggcattccttgtccaggacctccatggctaccgagttgaggtatttgatttactcagcaagtgtagaatagctccacaccttggaatggcaaaccaaatatgcgttttgattatttggggttttcatgatttctgtttatccctgacccagctggtgctttctagaaagagccttctgccaatagaaaaaagaagaaaaatcaatacatggtagccaacttaatacaagttaaagggaagcatggtcgagggccccgaggccacatcgaatgcagaattgtgcatcattgctcattgtagagatgctttggccgtgacttggcattcagtagaggcttgctttttgaagaaccttctgagagtgtgataggagtctggtgccaagggagagaaggtgctaaaagcacaggtaactgggtgtgtcccccaggtgggaggcagtggtaccgtgtgtgttctgagccacggcctcacacacatgccccgctgggcagcatatgaagtgagtgtcagtatctgctttacagaagaggactgagacaagagtggcatggggttgttggcacccaggcgccccccctccatcagcgtgtggtggggcagcaggtgtgcagatggggtggtcctgcacagaggggctttggggcttgcactgcgcccaggagggagtggtctggggtttgtctaaacctggcccacagtaggatggaacttgggaaagagcctgtaggtggtgctgagggcagggggttatggggggcattggggcatggtctgcctgggaaggggaaggtcctctccagcccccaggcctcagtggagtagtcggctccctcctttctgcagccatgcctcagattctagtgtcccttgccccgcccacccatggcgtcaggcctagcactcctgctctgcatacggggaggctgcacgggagggttcttggggtgctcctgtgtcccctgtcgtctgtactgaaccccttcccgtgcagctctgctcccagcactgtgacagggtggacaccgcacctcctgctactgattcccaggattgccttgaaaaataaaatcctacgggtgtgcattgacgtttcaatcctggctggctccgcatgagcttctgaacttgatgttcagaagctcagggcccatttgctgagtcagcacagctgccttctttgatttgtatgaagccttttgatgttttgatgacatgtcaccatgggtggctgttattttcagggagcagtttatctatcaggatctgggattgcttcgggtacttttaaaatctaggtaaagccggggtttctaaaacattgttctaaaacattgtcagggcagagcatgtaaagctctcccactaccactaatagtgatctaaaaagtgcctctcccctcaaacacaccctagtcctcggggagaaagcagagtgcggtggttaggaatgctggagccacagtcaggaagccggcatcccacccggctgcagcagcttggggcccgggaacattctggatgggccacctgtgccagcagccccccatctcgtggggctgtggggaggggagttgatctgggtcagtgtctgtatgggtggggaggggagttgatctggtcagtgtctgtatgggtggggaggggagttgatctgggtcagtgtctgtatgggtggggaggggagttgatctggtcagtgtctgtatgggtggggaggggagttgatctggtcagtgtctgtatgggtggtgcggggagttgatctcggtcagtgtctgtatgggtggggaggggagttgatctggtcagtgtctgtatgggtggtgcggggagttgatctggtcagtgtctgtatgggtggggaggggagttgatctgggtcagtgtctgtatgggtagggagggaagttgatctggtcagtgtctgtatgggtggggaggggagttgatctggtcagtgtctgtatgggtgatgcggggagttgatctggtcagtgtctgtatgggtggtgcagggagttgatctggtcagtgtctgtatgggtggtgcggggagttgatctggtcagtgtctgtatgggtggggaggggagttgatctggtcagtgtctgtatgggtggggaggggagttgatctgggtcagtgtctgtatgggttgggagggaagttgatctggtcagtgtctgtatgggtggtgcggggagttgatctggtcagtgtctgtatgggtggggaggggagttgatctggtcagtgtctgtatgggtggtgcggggagttgatctggtcagtgtctgtatgggtggggaggggagttgatctgggtcagtgtctgtatggatggtgcggggcatggagtgcttgtgcagatgatgatgatgatgatgagttttcagtccatgggaagctcatcgggtctgggggaggtgggtgggcaagtccctgcacccagtttgggtacaggccatgctgggcaggggtgaggacactagtggacctgtcctcgggagtgacacaaaggaggtggtgagccctgcttgtgagataggatgagaggaggaccaggactggtcagggccacactggagctgctgggggtgaggtcgggtaagggcctcccaaggtgcccccacgctgtcccctctgcagggccctcctgaatgtggcttgtgccctgctggagaagttctcacatgcctctttctactccagagtcactgatttgggagatggggcaacagctgcacagccccaagggctgccctgattttctcacaccgaatatctaataggaagttagctgagaagcccacacacctcttcttccaggtaggcaagctgggcctgggactacctgtctctcaccgactccaaatgatagccaagcctctcttaaccttgggcaccttttttccagtttccaccccgaattcacactcttcaaagccagctcctcctgctgggctgctcctgatgtggggggccggccctccctgcaaatctctggcatggcccttgcaaattggcacctgccacgtggttggcactgggactgcaaaggtgaaagtggcattatcctgcatttgaaactcattctagagggagacggatacatgagactctccccgcccccatccaggtgtggccaggctccagacgagttccaggcaggcttccaggacaggctccagagttagggacaggcggagaggctctgtgactttgagaggggctttgggaagtcagccgacaaggtggggatgaacatagaggtgtgtgggtgtcctcagcatggaaggggctggaatcgtgatgtggctttgagcctgaaacaagacaaagggaaggcgagggacatgggttgggggatggtgatgagagagagacagagggttccactgggggcatggaggggagccaggagagaactggggagctgaggggagggacattaggaaggccagatgtagcagggcagttaggagatatcttactggggaagaaagcacccgttggcggtggccacctgttggcggggtcccctgagcctgagcagctctggtggattgggaaggcagaggcatgggaatggtagatggacagtgtctatagagacttgcacggagggcccaaggaggtgccagcaagccgaggtgctcatagtgtgtgtgtgtgtgtgtgtgtgcacgcacgcttgtatgtgagatattgacttgcattgtactcatctgccggtggggtgtctagggcagattgtggggagtgagagcattgggtatgggacccaggctgtccacgtgcgtctgcttcttgaggccccgtacctcccgttcttgggcctccgtgacacctggcatcatgcctctcttgcaccagaggcttgagagacacccagttggcaaaatcagttagtctgtgacattccctaggaagtgcagggctcggtgcaagaagttatagaagtatctgtttaggaagaaagatcgcatggctgaacacgctgagatgcgtaatgtcacccatggtgtgcttgcccaagatgtgatagcgtggtgatggcagacatgggagttttaccccaaagcattcagatcacaaccagtgccagtcagttactatgaagacatgtgactatggtaatagggggctgacctattagaataactcctaatcctatgtcagataataccatgggcagctcaagaaaactacgcacaactcagacatgtggagaaaggagatgtggaatggaatggagccctctgggctgatagaggcctccaggacttgccacacccacgtctgcccccaattccccagtcagccttcacagaagagaagttggtctctctccagctgagaccaagccaagacccaaagtgctggagctgaaggaagtttgggctaggctcacagaagctattgtcccctcctccagtgtcaacagctacccatggtccaggcctccatctggtcctggtccttttaagagacactgggtgctgactcacttctgggtctgtcccacgggtggcctgcctggtctgctgtgggtgcagccagactgtgcaggttcgggagcccgaggtggacttcaggtagggagacgctgctccccaagagctgctcgggtgtgacgtcagggtggaggctgttgctgtgtgtggcggcatcagtcatttaccctctttctcattagcccctgtccttcggcccatgtgcttgcaggtggcctctgattctgcttctggagactgtctgccccctctgattcattcattgcggccccagttatgtgaaagatagcatgttcattattcattcattgggccccacttttagatatacttgtgttcatcttcgagagagggaggtcatccagccattccccagtcctcaaaacccactccacaggcaaagcagtggtgggtcagggctcctcttgctgcattgcggccttgtatttgctcttctgagccacaagcatagcgagaaagtacaaaagaaaaggatttcaatggtattcaccctgaaaaaggaagaaaattgtgacacaggctgcaatatggacaaaccttgaagacgtcctgctaagtgcaatgagccagtcacaaaaggacaagtactgtgtgattctacttctgaggcacccacagtagtcagagtcatagaaacaggaagtagagtggcggtggtcaggggctggagagagcagggagtggggagctggtgtttaatgggtgcagaggttcagttgtgaagatggaagcattctggaggtcatcggtggtgatggtcgctcaacagtgtgaatgtacttaatgccactgaattgtacacttaaaaatggttaagatggtaaattgtatgttatgtatacttaccacaataaaataaataaagaaaagaagaggtttttcagtgaataactggtttgaaccaatttggatcctctaaaaccaagttgagccagtctgaacccatgtagccattatcacaccgtgttaggctattcttgcactgctttaaagaaatacctggggctgggtaatttataagaaaagaggtttaattggctgacagttctgcaggctgtagaggaagcataatactaacatctgcttctggggaggcctcaggaagccttcaatggtgacagaaggcagagtgggagccagcacttcacatggtgagaatgggagcaagagagagagtgggggttggagggggaagcgccacacacttttaaacaaccagttctcttgtgcactcaaagtaaaacctcacttactaccaaggggatggcccacatcattcatgaaagattcaccccatgatccagacacctcctaccaggccccacttccagcattggggattgcatttcagtatgagatttgggcagggacaaatatccaaactatatcacccacaaagaagcaaaaacattttgggccaaatcaaaactatttagatgtagccacagtggggatgaactgtgattatacccattcaggcctgtggacctgtggacctggcgtgtgtggtcgtgaggcggtgggtcggcacatccctgggaggtttcaggaggacattcaagaccaaaatgagccatgagtaaataacacaaccacatcctgagtgggagtaggggagcctccccttctctcctaggtcttgtatgggtcatgatcccgccttggcaggagtggaaggaacagatcccacaggctgtggcttatggtaaagtgattgtggtcatgccttgtgagtgtcattaaaataaacatatatcgttaaatccaccatcaaataacagctatttctgccatcctctcgccttttccacaagtttaaatatcccagatattctactgtgtatattcctaaaagcagacaggtagatttagtaaagttaactggatcattggtaccttctttatagatcatctggtgaaacttgtttttcaaattatgagttgtagggctttgttttaatgtctgtagccttaggcagttccattgagactaagtttttttcttattaagactaatcttattgactggaactgtggactcctcgtattaggagaacagagatgtggcctacataaattagtggaagttaaatactgtagaaaatgctctctggaaaccaaagtctaacatcgacttactactggtcattcaatttccttttggcttgggcaccatcgttacattcatttttcagatgtcaagctagttttctcagaatgtgtgcagggctcgaggccaagtgtggaggccacaggggaggtcacaggtcaagccttctgggagaactgcaagcttgagcctctgataaagtcacgcgattgaattttagccccagtaggttgctgtcgttaaactgtgcacacagggcttcttgcttttaagttagcaggatggaaaaattgcggatgtttgcagcaaatgtgtagaaccagtggcagaagcagccatgctggcccctaagcaatggtattagaaagggttgatgaagattttctcatttgagagttgaacaaaaccaaatggaattctccctagttccgcagcactggtgggtgactctccctgggccggtctcagccctgcagaaaggggcactgtctgcttagcttggtcagcgcagggtctactgcagcagagtgccaggtggatcacagccctcttgtgggggaaggatgggcggagctcccaccttccccacaaatggacacagaatggcacctggtatgtgaggcaggtgcaggtgaccaggagaaggggctgtcagtggttgatggacagctgcctctgctgcctggatgacccaccccctcccctggaccatctcccactttgcctgggtgtcagtcactggagggttagctcagtacaagctggcggatgacctccgtagagcttaggtgaaggggctctcacagggcagtatgtttgagacccttagagggctctctttactcttgcttctcctattatttttaaactgtagtaatacacacgtaacataaagtttaccattttaaagtgtacaattcagtggcatttatcacaatgttgtgcaaccacctctgctctttagttccagaacattttcgctgcccccagaggagaccctgtatttattaagcagtcactccccattcttccctccgcccccagcccccacagtgaaaaatctgttttctctcactttggatttgtctattccggatattccataaagataggatcagacaatatgtgccctttagtgtctggcttatttcatcatcatgttttcagggttcatccctgttgtagtgtgtgtcagtactttgttcatttttgtggctgaatgatattccactgaatggctattttacattttattaatccactcatccactgatggacatttgagttgtttctaccgcatgattaatgtgaatagtgccactgtgaccatatgtgtacaagcttttgtgtagacacttgctttcagctcttttgggtgtatcactaggagtggaattcctgggtcatgtggttattcagtgtttaccgtttttaggaaccacagatgttttccacagtgacagaacattttacattttcaccagcaatgcatgagggttctgattactttcaaaggaaaaaaattaagcagccctgtcaccttgatggtttggtctctggcctcaccgcttcagctcctctggcctgatctcccagggcctgcttttgttcatgtgtgtgtctgtttataccctggctcatcctgtggagggtctgaggctggcaggatcactgggttctgtctccacattggaaggtgagctgtcctaggtcagggtctttgttgcatgcatcgtcctgtccttagcaagagctaccctgtgccatatgggacatacaacaggcacctgttcaggcctggccatgtgggcccacctttggatggtacttgacaaagcctcaaaatgcagtgacaagtttagataaatatgattctgttctgaaatgctgcactggacacagccatccactgcctgccctttacagggctctgtgaagagacagtgaacaatgaagtggaggacgtgtgcaggtggccccagtggtcggtgatggaggagagatttcagcagaccaagcacggagaataaagccaggccagagtgtgctatcagcctgtctgccccctagagctgatggactcagcaaataacagtatagggtacccagttacattcgaatttagacgggtataggattttggtttttcaagatgaaaaaacttatagtggtgagggttgtacaacattatgaatttaataacactgaactgtacactcaaaaatggttaagatagtatattttattgtatgtgtattttaccataataagcaattgaaaaaataagttgtatttcaggtagatagcgaataattttttagtataaatatgttccatgagatgtctggataccgggatgcaggagggactccccttcctcctcccattcacaggcctgcctagagatttgtaagtacagactgactggctgtttttcccagtgtgtcttgtcgtgatacttttaagccacagatccgctttgaaaagatatgatctcccccaggggagtaactattataagaacaaatactctatccaagcttccattctcctcaagataaacatcacaggagtgacctgaattgtaaagaggagtggaaggaaaagaacaataccgtaatgttttctgagccacgcagatgtcaggggacggatccaagggcgtctgaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtgagtgtgcactagtttggtgttgtttcatccaaagcaatgtgattatattgctgtactttcagtttcatcaagcaggcaaaatgagaattgacactttttaaaatccaagctttagtttcaccacctggagccaaggtgtttattagaaagatttattggcattagtgtatttttattacaagcatttatctctgtgctgaacagttgcccctgagtcccgtgtgctgtgaagagtctgtgccacaccacacattaattttctgtcctcagagctccggggacacacgctgattctcatgctgtgcctgccgccttctccgagtgatggctgatgtgggtttcaggccccactacagttactcagcgacagatgggaccccgtgtcctctgttggctgtagggagttgaggcgaccctggctggcatcttgttttgaggggtggctggctgctgtactttggggagggcataacaggatttaaatagtatctttatctaggatgcctggagccccaaatccatgtgggcctcccactgtgtgaatttcagatgctgccagccccccaaccccgccacccctgagatggaaattagagcaccagatgggctctcccaaggagaagcatcacaagcccaccctcctgcctctttggaaagtaaccctggctgtttattgtgagatgtggttgtcatggtgacaagtggacacccgcttgggagggagatagaggaaacgctgttatggaggaaaggtcacccctagagacaaccttgtgttgcccgtggacaccccatactatggcctccgtactggggagtcccatgggtagggcatgggggtgcagccatcagtctgtgtccccagccaagccttgagccctggcttgaagttgcatgaaggtacagtggctggcccagccctaacccgtggtggatgcagcccctgttgtgtcccccaacccctgacttatctggccgcctgatgagagtctgtcgccctacatctgtggcgctccctctgcctgacaaattaaatcccgcccagcttgcaggagggatgttgttaacctgatttcatttgctggtgggctggttgatttctttggggtttttttggagatgaccagcacctgtccagcaactagtaaggcagggaaggcctccaggaacccaagtccatgcagaagggcactgtgttggggaactttcagacaagtgggtaaaataccgacgtgtgctatgtgcaccttgaaatagcaaagtgtcctcaacagagctctctgggggatgtcccaaataaggtttactttaggagaatgtgagcggcatctgaggcgagattctcttgttgcatcctttggaagcttttgcttggtgttccttggccatagcaggaagatcagtgccagggatgggtgaggggaagaaaccttgcaggagcggtacctgggccagtctcagccctgcagaaaggggcgctgtctgctccacttggtcagtgcagggtctactgcaacagagtctcgggtggtcacagccctcttgtagggggaaggatgggttttgctcctgggatgctaggcttcgaaaagcagggcagtgtgccagcagtcccagacaaaccagagccgggcctttggtcatgccaggacagcagggtgtggtctggctaggcctgtgagcccctgtggggctcaggggtaggggcagcaggactgggggaggcagggaccaaccagacttcagaactgctgggtcccagctgcacccctgcaccacctcagctctaggaagggcagccccatgtagctttcttgagatgtagcagcagtgctctcccttctccctcgccatccttaaagcccggtgcccgctcccctgcatcccccactcccattgcctctgaaatccggtggtgtctgtgatcctggaggggaggcttagccagcaatcattccaactacctggggcacggcatatctgcccccatcagtgctgggagggtgggcccagatcctttaatttttctcaaaaccccagagaggcagagttccatcaaagagcaagacactgatagactaggacaggggatagggctggcagccatgcctcgtggcatcacctgactccgagagaagccagcccaacacttggggtctcagttttctcacctgtcaagcagggggaagaatattcattgtgtacacaagaggcttttgtaaaccctaaggtgctaggtaaattaggtaaatgtaactttttttttgagactgaatctcactgtgttgcccaggctggagtgcaatggcgccatctcagctcactgcaacctccgcctctcaggctcaagtgattctcctgcctcagcctcccgtgtagctgggattacaggcatccaccaccatgcccggctaattttttgtatttttagtagagacagggtttcaccatgttggccaggctagtctcaaactcctgacctcaactgatctgtctgccttggcctcccaaagtactgggattacaggcgtgagccactgtgcccagctggtaaatgtaacttttatcatcagtgtcttccttgccatcatcatattgttatttctcgataatttatttccagaaagttctggaactggacttaccatgcaggctccggaacctcctctgggaggtggacagggatttaagggctatggatctggcttctgtcttctggatgatataaggaactaaatagagaaaatatacctaaccttaaattttattaattgaagtagaagcagttgtagtttggtgtcttctttaagagaagacttatgacatgtacttggggcattttctatgttgtagtaacagattggctaatttgcatttattctcatccaagaatttaggttttttaaaaatatggcttttaactttttgggcactcttggtgggaacgtaaatagtactactgctgtggaaaacagtatggaaggtccttaaaaactgaaaaatagagttatcctatgatccagtgatttcacctccaggtatgtacgtaaaggaagtggaagtgaagactcaagagatatttgcacacccacgttcatagcagcaccattcacaatagctaagaattggaagcaacccaagtgtccatcaatagatgactggataaacaagaggtggcatgtacacacagtagaatgtgattcagcccttaaaggaaggaaattctgccatgtgcttcaatgtggacgacccttcaggacattttgctgagtgcaataagccagttccaaaagggcacatactgactgcttaatcactccacttacatgaggggcatagagctgcccaattcacagaaacagaaagtagaatggtggttggcaggggctcaggttggggttggggttgggcatattgaggagtttgtttaatgggtacagagttttagttttgggaagaggaagacattctgaaggtggatggtgaccatggttgtacgacagtgtgaatgtacttagtgccactgaactgtacacttaaaaatggtcaaatggtgaactttatgttatgtgcattttactgcaatcaaaagataacaaatttcaaaatgatttaaaataacttttttagaagtatgaaaatagaatattaagtgcatagcagtttaagtataattaaatagacgtctgcacacacacctatacacatacagacatacacatgcattttacaaaattgtatcacattgcatattcaggttttgcatcttgcatttctctaacatataaaatcacgatctttaacttccccgtttccaggtttgcaatggtctggagcagccaaggaagcagcagcgctctgatctcaatggacctgttgacaataacaacattccagaggtaatttttttcaaggatgagagttctgggctggaacactcatctaatgatggagtggcccaccgagttgtggtctgctcactttgtccatgatgttctcatcccacccggtgcctgggggagagggagtccaggtcaggccaagttggtgtcaccatatggtgaggaggtgagggcacactggcctgggaggagggaggagagggcctccctgatgttaggaccatgccatggagtgctcttgtgttgcagatggtgtgtgtgtgggggtgggggaccattggtactacttaattttataaaaagccattctattcattgtctgataaccatgttctaaactagggtttctcaacaatgacaccattaacattgaggcctaggtaatactttgttttggggactgtcctgtgtattgtagttgagcagcatccgtggcctcaacccactagatccttgtacctaccccatccccatccctgatttgtggtaaccaaaaatgtctccagacattgcctaatgatgtccctttgggaacaaaaatcatcccagttgagaaccactgttctaaatcaacaacaggttttaacaaacaatttcctataagctaacagtgctatgatggaagttatttcccctttctggtaacatagtttagatgagattatttaactttgatgaaataacgatggccaccgatggagtggtatccagtctcctttatcttgcttttaaagatgggcctggatggctctcatgccccctggttggagcgtcattgtgttggatggtccctaggctcccttctagtcaagatatgctagtctgagggcccctaagttttagatgatgggcttttgggccactccccaacatcatgttgcctgcagcagactggtttcctgtatggagctgacatcttcagaacaccatcactcatggggggtttgcttttctcattatggctcatatcacagccctgcttagccttcaccttgtgggctacctacttaacaattgttatgtgttttatttttccatatttcctaacagacaaagaaggtggcatcatttccaagttttgtggctggtaagtgactttgaattttatttctcaaggggcagttgcattttacatcaaaataaatggtgcttttagtttgggcattcacctgcaaagcttgtttacaaagcgtgcctacctaccagcaaggtgcttggccattgtctgtttgaacactgtgtagccccacttagtggggaggggaggtccagctgatctgcccgctttgatgcaaggaacagtagacgatctcctttaattataccctcactaattgcatcacagacgacactgatgactgaatagattgagatgtgtctttataagcagctggttatagctaacacttctgatcagggtggatataatgcattcaaattcaggctttttttttttttttagatcctttgtttttctttaccgttccaccctttttgaggaggttaatagtgcatttcaacattcagtaaagaatgaaactggtcgatatgttctgtgtcactcttggggatggggagcacacttgcctggctttgacggagctgagcatctggagaccttgcagggcccctgtaggagatccactgggtttgcttctagtgctccaacctcagagtaaagagcttgttcggcaggatttctgtctttgccaggaggatgtttcctgcccctgctaatgtgttataataaacaatgtgaatttcattaattctttcaataagctggtaattaattcttataaatatttatgggagcaaggtaaattagttttcagaaataaatgactttcagcccttcccatgctgcttttctttttttagcaaacaactaaagcctggggaactgaagcccccaaattcgcctttagagaactagtttgaaccaggctaatccagttccaattggttgaaactggattaactggctcaaatcaattttgactgttataactggcttaatgctgctcagattgggtgagaatctgttttaaaccatcagaattaatatcatgcaattgagatagacttggttccattttgaccaattcagataggctaaaatgggttttgcccagcagtttacatgtggttttaggtacattttatctggttcaaattggttttcttcaggccacagcaggttatgatgattcctggaagagaccacactccccacattcccgcttgtagtgtttgattgggttcctggtttataggagctggcacctcgtgagcagggcgaatgcagtacgtcactgtgccattttccttggcaggcagaagccagggtggggttgccagtcacactgctccagtgaggcagggtctcctggatccaagaagctcacttgtcagtgtatcatagtgtcatctggacagaactctcacactaggaggtgatttagacattaaattccccgacccttgaaccaatctcatatctgcagggagtgggatcgtgagggatcgggaagcagtgtcagtgcctggggtacctcggactctagctcctggcatcccagaagacttggttccctgcaccactcagactgttccaaagcaaatccaaacaaggccggtggcttaaaacaattcagacaggctaaaactgctgtgaccagctagaaccaatgtggaaaacctgaatttatagtttcttctgtaggagagaagccctttgattgttatgaaaacatagaaaactgaagcaaaacaacatcctttactattacagcatttatatgcagcgaggccttcatggaccaaaatcttactcagcaacaggaagagatcatcataatggtgatgccaaaccctagaatataatggatatgggaaaagtttctccaaattaaacaccgttatcagtttgaatgcctttgggtacaagtatcaaaatccccacctaacgttacacaaataggtgtgtgtcttacataaagaagtccagggttggacgtggtggctcacgcctgtaatcccagcactttgggaggccgaggcgggtggatcatgaggtcagcagatcaagaccatcctggccaacatggtgaaaccccgtctgtactaaaatacaaaaaattagccaggcgtgatgctgagcacctatagtcatgctatttgggaggctgaggcaggggaatcgcttgaacccaggaggcggagattgcaatgagccaagatcacaccagtatacgccagcctggcaacagagcgaaactccgtatcaaaaaaaatataaaaaaaatattaaaaagtctagaggtggccaggcacggtggctcatgcctgtaatcccagcactttgggaggccaaggtgggtggatcacaaggtcaggagttcaagaccagcttgaccaatatggtgaaaccctgtctctactaaaaatacaaaaattagccaggcatggtggcgtgtgcctgtagtcccagctacttgggaggctgaggcaggagaatcacttgaacccgggaggcggagcttgcagtgagtcaagatcatgccactgtactccagcctgggcggcagagcaagactccatctcaaaaaaaaaaaaaacaaaacaaaaaacaaaaaaaaaaagtccagaggcaagaggccgccggttcgatggctctgtgatgtcaggattggcgctgttgtgtctcttggcctcctcttcaggcttgtcacctcatcgtcacacagtgtgtgggcagccccagccattgcttctcgttctaggcaggaagaaaaaaggagaagggctgaagtccacaccagctggacgtcctccccttgacattaggaaagcaaaggttttctgtggattaagaggtgatgacttctctgcatgagaatcggaccctctgttacctttcatagtgtgctccctgggtaacctgaaaggcagcgtgtcagctgtgtctccaggcaacattgcttatggtgagatgctctttttgataaactgtatctagatgggaaaattctaatgcttgcggggcagggcatccagggctttgagcttctcacagtggtgactttcgtgactggcatgtctcttgaaggtgaccctggaagctatgccccacccatggggtgattgtgagagatactggctgctgggagcatgaggctcttagaccagatgggttccacatgcccttcttggtgggagttttgtacccttgcagctgacccatccagggagttctgtaccattgcagctgacccatccaggggcccatgagactagctgtgtgggtgcagtgtggactcccatcagagagtccaggaggcaaactggcgtctgtcttgttcccttggagtagacggccccatgtctagctgagccttaggacactgcatgcttctgaatatctagttgaaccttacttagaagacccagaagcctcttcgacacactgcttatttctttgtggccagagctgtgtcacatgaccagcctctcagatgttagtgttggccagacaatcaaaccctgggctttttatgaaggcagggcaggtctggaatcagccctgggtgcctgccgccacttcccatcccactgcgggcccttccagcctcctggcgtgtccagtgctgaggctgagtatgtgagttcctgggaagcccctgtgtaagggaggagcagctcctccaccctatttgtgtctgagaagttgccctgaagggaaatgttcctggagtattcatgagtatttggtctcagcttatgccttatttcatatcagataattgttgataataatgaaaaaaataatagtaacaatgcacatgataccgtctgaaccctcgttggggcctggtgtccactccctgtgccatgcagcatctctctatttcatgtcgcctggtcaaccaccacgtgaggagtaagtactttcccccgtctgataggttagaaaactgatgcacagtgaggctaaagtcacttgtgtgcagtcccatggctgtgcgggggacagagcctggacttggacccatgtcttggtgcttgacacataaactcgtagccgaggtcattcctccctacccagcatgccttcatataccaggaataggtaagacctgtcaggtgctttctttgagccaggcccagatctaagtgttttaagtatatcaacttaacaatcactatatccacagctcagggagagtgaatcccgggccgaaggtcaccaggtagcaagtggcagagttaggattcgaaccagtctggaatctgagctcatcaccacactgcactgcctggcgaccctcacgcagtgggtgaggaagaaccttcacttagagaagacctaccatgcaggtgccagagagttcagtggaggggagcgttccagatgccagagctcctggccttgtcaggcgcaggatcacagccttctctcagcagaggcattgtgaggaagggcctgccacaatcactgtctgtggaaagttctcggggtctagcgaccctctcagactgggaaggttaacgctgcagagaaaacctccttatgaaagtgcggattgcacagaggatgcactgcctgtcctgcggggaggaatccgaaagcagccaccctcaagatgtcccctcctacaggacgtggtgtctggcagcagcttgagcccaagctgcttagagggtcactgcctctggatgagtatatgtgaatgaccagcttttctatacaggtaaacacgtgctcattaaaaccaaaaggctgatgttagtcccaagcaatggggcctaacagtggcagcttcagtacaaaataacaaagactggtaaatcttactctgctttttgtactttgttctcctcatccaaagctcatacaggatgttttgaaacccaccaccccaccagcagcttgaggcttatgccaaaatgctgccaggccttagggtcctggggtcctttacagcctgtctatagctcatcaacttgcccagctccgtgtggatcatgtggaaggcatggagattacatgccccagacctggagctgagctcacctatcaccccttccttctctcaggggtcctcacagtggtaaagctgctttgttggtttcatacagtgggcacatgggatctgagacttagtttgctcttaaaataggcagttggggtgaacctgttcagataagactcttaaagtgaagacatctcccacctcctcctctttggtgtatttgggtgggggatggacgggaggaaggtcaccctgtgggaccagaggggatgtggcgcattccaaagaggagttatggaaacccagatgactttcctttttctacaaacaagatcatgtttctcctgtactacatgcagtcagcaggaatagggattcgtcgttttaaaatctgaacttttattcactaagtagaagttgttaaagatttctcagaatagtgcttgtatcagaccaagagctgcaagagttaaaaatgagaaatccccacagtacctcttgttctgcctatacatcccagatccctagtccttctgtatagtggaagccacttacatttcttgtgaatttctccaggaatttctcagctcatccataggcccttttccttaaatagacattgcactggccacatggctctgtacttagctttttcctttcttgctagatcttggaaacagcaataggtccacctgattatttaagcggcagcacaggatcggttgagtggatgtgggatggggtattaaccagcccccttggactgattgttgggagatttccagtcagtgcagcagtgaacagccttgtggctacgcctttgtgtttgggtgtgggttcttttatggaggcggttcctggctatggcaggggtacaggccaggagcacagcaactctgatagacacgggcagaatgccttcccaaggggggacagcgtacgctgctgttggtcatgtatgagagttggttacgtatgaggttcccacactgttaccaacactgcatgaccggctgtttgatataagctccaggccgatgggtgcaaagaggtgtcttgttgatttcacgtgtctttcataataagtgaagccaaacactatttcgtatgttcataggtggtttttcttttcagtgcactgccagtttgtttcctgtgctcattcctctgttagattttcacccccagctttattggcgtataactgacaaataaaagttttgtatattaagtcatacaatgtaatgtattgatataagtttacatggtgaaatgactaccacagccaagcgcattaacatagccatcacttcacatagctacctttttgtgtgtgtggtgagaacacttcagatcgattgtcttagcagattactagtatacaatacaggattattaactacagacatttactcatctcataactaaaggtttgtaccatttgaccaatatctccccatttcccccacccctcagcccctggcaattgggaatttgggtgtttcttattgatttgtattattctttacatataaaggaaatgaaccctttggtttgtactgtaaaagtttaccccagcttaccattcttttcttcttcttctttttttggtatgctttttactttgctaaacatgtcatttagtcaaatatatcagtctttttcctttgagcttactgagtttttgaggttagtgtgaccatcacactcctaagattatttttgaaaataaagttgttggccaggcacagtggctcatgcctgtaatcccagcactttgggaggccaaggtgggcaggtcacctgaggtcaggagttcaagaccaggttgggcaacatggtgaaactccgtctctactaacagtacaaaaaataaactgagcgcagcagcacgtgcctgtaatcccagctactagagaggctggggcaggagaattgcttgaatctgggagttagaggttgcagtgagccgagatcgtgccacagtgctccagcctgggcaacagagtgagacaccgtctcaaaaaaaaaaattaattgattaattagttaaataaaaagctgtcttccaggactttggtattattttaaattatttaaataattgatttatctggaatttatcttggtgtatttatacaggaaaagttacattttaggcattttgtcccaatagctagccagttatgccagaactatccaaggaatctttcccttgcaagtttgaaatgctgcctttaccgtacccaaatcgtcatgtgggtctcggtctgtttctggatctgttacagggacggtccattcaggttccagatccaggctgctttatttactggggatttatggtgcattttattacctggtagggctactttcagaccttgccaccatcattccatttcagatttttttcctaggtatttttgcacttttatttttccatagtaactttaaaactagcttgtctggttattcactgcaaactcttttgtttgttttgttttgttttgagacagagtctcactctgtcgcccaggctggagtgcaatggcgcaatcttggctcactgcaaccttcgccttctgggttcaagcgattctcctgtctcatcctcccgagtagctggaattacaggggtgcaccaccatggccggctaatttttgtatttttagtagagatggggttttgccatgttggtcaagctggtcttgaactcctgacctcaggtaacccatccacctcagcctcccaaagtgctgggattacaggcatgagccaccgcgcccgggccactacaaactcttactggtatttttattaggcatgcttaaagtctgtccatttaggggaaaaaatgtcagctttacaacatagtctttctagccaacaaaggatttatctgtccacttgttcaagctcatttatcttcatcggtaaagttttttcataaaaattcaacacatatcttgtttgtctgtttcttgttgttttatcccttttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaagtatttggttaccctgaatattgttcatataagaaaagcagattaaatgcttgatttcttctcttttttgaaaaatttaaaaattaatgagttggctgggcgcagtggctcatgcctgtaatcccagcactttgggaggctaagacgggtggatcacaaggtcaggagatcaagaccatcctggctaacacagtgaaaccccgtctctactaaaaatacaaaaaattagccaggcgtggtggcgggcgcctatagtcccagctactcaggaggctgagacaggagaatggcgtgaacccgggaggcggagcttgcagtgagccgagattgcaccactgcactccagcctgggcgacagagtaagactccatctcaaaaaaaaaaaaaaaaaaaaaattaatgagtttccccgacagcctttaaaagataaccggtgaggttgtgtatgttgttgttagcacagttgatgtgttttgtgtgtgttaccatgattattggtgctcaagttttctatggccaataagagcttctttaggttgttttctgagtcccgtcaatgtgaacccagtagtctttgattgtttcctttctttctggtatattccaggatcatcttaaatatttcttgccccaggtctggaaccagttggttctttctccatggagccctgtgaaataacatttagagactgtaatctgggtagtgtggttgctcgttgttgtagatttggtgagagtgtatatgtctatgtggaaggcgcctcctaaatggcccccaaggacccctgcctcttggtattcatggctgtgagtccttccctccccctgtgtgggggatggacttactgagctgcttctattgaatagaatatggtagaagagatgggatatggcttccaagatcaggttacaaagagatgtggcttctgtctcagcttgtcctttcttgttctctcttacttgttccctctgaaggaaccaagctagcctggtgtggttggcagttgccccatccagaggcccacgtggcacaggactgatgtttctggccagcggcctggtgagagaacttggaagtggatgctcccctcttcaggcattcagatggctgcagcatcactgagtaccttgctgcctgtgacagacgagaggtcctgagccaaagtcacccagctaagccacacccagattcccgatccacagaaactctcagataatccacggttgttgttttgagccactaaattcccgagtaatttgttatgcagccaacaataactaatacacaacatattttttaagatcaaataacgtcatgattcctaatgatactttgtcaggtttataggttctaacatttgtagtttctttttcctgtgccccaaattcctgttctcaaggacaccagcataattttgcattggttttattccattaagcttacagcagtctcagaataacaataccaaacactgccaaggacacatgattgtagatacagattatgatttatttgcatttacttttgtgtttagaatacatcccacaagggatgtacagtcagacaactgtgttttaaaatattttggaatagatcacaactggatacacttttagattcattggtttcatttttctcttagttatttggactttgctttttccatttaattttgttttataattatataaaataattacatggtatgaaattcaaataaacaacacaggatgtatgcaaagaggtcagtttcttcccctatttatccccccacctcccaatttcttcccttccactataggtaaccattttgagcattttacatatttttattgtaagcatgtcttcccctttcttaggtaaatggtagtggattagactcccatatctccatcttgccttcttcacttcacactaaaccctggcggtgatgccacagctctgtgctgttcacaggagcatggagaggatgttctgcagaactccactgtgtggatagatgtctcctgttcaggagtgtttgggtggtttccaggtttttgctattacaaatagtgctgctgcagtgaaccgcctatgcatatgctttttcccatttttgccatttttttttaaaaaaaattatttattatgctttttctgggaagtcattctccccactgcaagggttaggatctgtcttgggcaactctgtgcgttttcttgagcttggctttgaccttccttccctgactctctgttgtggcttctcttcctcccagcatccagtgacttaatcttgctcattgggtgtctaaagttcaacactgtggaacccccaaatcccttttatcagtgacaaagcctgtgctgcaggcccaggtgtggccactccctggtgaatgtcccataggtgtgattttcagatggtgtcttctctttcgtatcagccatattatagggtcaccttcagtgggggcatctcaaggcacaggccctggcagtactggagagtcgggcctggaggccacgccttagctctgcagcagaaggtctcacttgagacgccagttacacgactctgatactcacccactcctgcctcctttccccactccagacctagggggcacttcagggggcaggctctcctgctgatctggtggctcgcctcctcccagtcctgtcctgccccattagagctgcagcccctcctcccagttgaggccaggtcccgtctgcactttggaacctcacacgatctgatgtcgtttgtctcctgtcccttttgctcgcccctccactggcttttgaccacgtctgtcccaccctgcatctatccacaccaccccgctctacctgccccttttctttcacagccggaatctgggagtggcagcctcattgtctgcacctcccctgcacctctcagccccctctctggctcctgccccggttcctctgaaacagctctttgaggtcacgactgacttccttgacactgtgcccaatacacgaggtctccttgtagttggcctcctgctagcatgggtgtagatgggcaggcctccctttctaagccccttcttttcttggtacttagcagagcagagtcctggggcttcatcctgcccccttgcccatgaccttccttgcagactcatccatgcctgcagcttcacttggcacctgcagatggttcattcccaaatctgtttttctaaccgggactcccgagtccagccgcctactgagcatccaggctcctgccactaaacttgcctggaatccccaacccaagctcagtcctcttccaggcaccctttctcagtgaggggcaggtctgtccatcgagctctgcaaccattgtctagcgtcctcatcttctctcagactccagtccacctttccgtcctgttgatggacccctaaatccccatctgttgctgtctctccatttccgttgtcaccctgtccgtaccatcatcaccactcatgtgctgggatggctacagtagcctctcagctgctctcccttcttcctctctgctgcctgcccctctgccagagttcatttctaatgaaggagtggttgggccacttccctgatggataccctggagtgacagtccttatggcctgtcacccgtggccccagggtcctcacatctggccagcgcttcctccccaccctcgacttgtctcagctgctggcccatgccctaggcctcggcagtccagacatcctatagatcttctaaggtgtcattgtctctgcaccctagggcctttgcacctgctcccgcctcagcctgggaggctttctcctccttttgccttatggcttgttgattccttctcctcctccagacctcagcttaaacagcagccacccccaaattcctcaccagagcagcctccctgtcccttccttcccagggccatagcctcccttttgagcattcaccatggcccatcctgatgcatttgttctgtggctgtgggactgatgtcagcctcactgtgtagcctgtgagctccatgtttctgtcttaacaccggtctttatacagtgggttcagaaatgctgagcacctgaactcatgacagtgaacttgggcaaagccacgtgacccacttagatggtccttatttgtaaaattgggaccctgagattgcttcatggcgtggttgaggactgggtggaactgtaccattgttgcacagaggtctggtgtgttgggcatgagggctgcactccaagactccgtgcctttgcagagagcagcgggccttgtggatgcacccccacactcccacatacacctgtgctccagctccacccagccacctcctcccagacccccaggatatacagggacaggtcttggagctaatgagaccccctggggccacactggcaccttagaagcctctgtccaccacccatgttcaggataattttcttcaaaggtggcaggagtggagaccctcaggcttgaagctgtgggactcccctccccttccctctccagagggcctagggttttcctaagcggtgtttcaaacagaggcttcctctggcaggggagaacctggagcgccttattcttctccagactgtgcagatacactgtgcatatgcctatgtgagtaagatatacggtgtgaaaaggataaatcactctctggggagacaagatctttaaacctgtatcttgattatcttgtcattttgtctccctctggtggtctcagcttagggtcagtgcaagacttgagcaaaataacagcaatttctacccaaacatgtagggctagctgctttcattttctaacgaagctgttagatttgggttctgcgtttcctgcggaagttgagagctgtgcccatgaatctgatatactccccacaccatgccgcccccactggactcttctctgggtctgggttctcctcccgtggtgcgtgtgagtgggaggcaggatgctggggccaccttggactcgattgtttctcgctgaacaaaagagcaaggcaggcatggaaggcccccaggcagaggtgggtggtggctggagttgcagcaaggcccttgagtgcttcactggcctcatcccggaagcaggcatccgtgggtgccagtggtgaccccctgcctgggatggggcatccttcacacacagcagtctgtgcccagatgggccccagagctactgacgctcacttcagggggagacgaggccagtctttcccaaatctactcaaggacatgggtcaacatggaaatgtgaacctcagaagggtctggtgcactgaccagggccaccctgggggctggcgagggagaagccaaggggcagtgcctagaaaggtaggagtcagattccaaagggagggctggcctcccagcctccccagggcctggggctgacagggtgccaggcagcccctgccacagaggggacataaggacactcgcccaaggccctgctcacctgctggggctgtgaggctggggtacctggggcgcctggaagaaccagagctttcctgcagaacaaagtgacgccatctagtggtcaatgagagccactgcattgggccccactgggtgactggggcttcactggggggtgcctgttgagccatgctcactggggacggcaaggtggtgtgaggtagtagaaacaggcctacctcaggcgctgggagccttcccagccccacagccagatgccataaaaggcagcacagggcatgtctggcgagcctgtggcagccagggctgtcatacacgctctccaagccccccagctaggcagatgtgcacacttcactctgaagaagcgccagggtatggtgggggtactgcattgggatagatgggtcctgttccctctgtggggctgcctctgattctcctggtgacaggagaatcccggtgtaccctctgagagacaggtggacaggggttcctcccctggtgccacccctgaatcccgcagtcccccacattggtgcctgcagccctgcccagctgggagaaggtttatcggctccagggcaaggggtgaatggaggatatttaaaagccgtgggaggaccccattgataggactcagttagatgcacaggggagggatgggggtccctgtggggagagacggctgggagcacaggtgatcctctgaccccaggggcacgcagacccactactgcccaggaaagcaggaaggagggccaagtgggctgagcaccaacgcgaagctccccacttggtctgtctgagcaggtgagggaggggcagccaggagtttgaggcagtggaggggtctggaataactcttgcatggaggaagagtctgagtttcccagagagatagatgagagttgtgaggttgtttggggggcatttggggtcaagaatttataatacatttatcatggcactcatttgccctcttgggcagctttttccagcctcaggtccagagaaaacaggttggagatttgctgaactcctgtgggcagatacacaggactggggtcagggaactgaggatactgggcggatgttattgaagtggtggatggcagcgcccaagctgggccagttgatgattttagcaacagaatgggttagaggtgagaccagggatcagctggctgagggagggaagaggtcaggaggttgctggcgcgagggctggggaagtgcaggatggctgggcccgtgatgctggagggactcagggaggggccagctggagcaggaggggagccaggaagccagggccaaaatccccagtggaaggggctctggccaggaggtgggcagtcgggagggataaagcaggtgacatggccaacatgggtctgagaggacagccaagccacggtctaggatagctcagaggtcggctgactgcagccccaatcgcaaatcctcctggccccctgattttgcatataaagtttccttggcacacagccacacctcctgttttacatactgtctacggctacctttacgcctcaggtacaacggtgaatagttgcaacagagaccacaaagcctaaaacacgtaccatctccccctttacaggaaaggtttgcccacccctagctggagccttattgtctggcataggagccactcaagattggtttgtgggcaacatggacaggacttgggggttggttggatatgactctaacatgtggctctttatatttcaattaattaaaattacatacaagaaatgggtccagtccctcagctgcaggagcctcagtgccagtgctcaaagccacatgtgggtagcggatcctgtattggacactgcagagatagaaccttccattgtggctggcaggaagtttgttgggtcacgatggtctaggggcagcagatggaacaagcatgatgttgccaagcctgggcctgcggtgtgatgggtgtgaggagctacacgggtgtcctgagaggctacagacaggcaggagcccctcaggacagatgcacaaggacaggccaaggagaagcccagggcacagtttcaggtcaccagcatgagttccggggctgtggggaaggcatggaaagtgctgttgtgtttgggatgtgacgccttctggatttgcagcctgtgattgtcatcttgagtgacagtcaactggaatgctggcattgtcctcctgacactgtttgtgcagagttttctggcccaagtgttgatttcgcgcagttacttgcagcacggggtagtgagggaagcagaccggccgcccgtggctggctgcagatggcaatggttgggcccttctagtttgccccgcatcctggctgccgtgttccttgtgctatggccaggcatgcaagttctttgttcaggggacttctcctctaggaagactctgactctgtgccctccttcagttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaaggtagaggtgcttcgagggcccctcgcggatgcccgcacactttggggggcactagcaggagggaatatggcggggcgtaggccctcttccagctcggactgcacagccctcagcacagggggcaggagcggcccaggtgccaacgaggctgagggaggcttgcgccttggctgggagaaagctggctgggcagaggcaaccagctccttaacaagaggcccacggaatcccagaaatacgacctttaaagatcatcgttccaaagcattctagtcatcaaacaatcccaaatcccagttcaacagtatgtgtatttttagtgccattcagagtgcttcaagaaagggtgaaaaataaatcacgttttatttaaattcaggacctcaagaaaaactttgacctgcttgtagctctaagtgctcattggattgtctggttttgaacatcgggtgaggccgggcaaggggaagatgaggccacgtcagcaaaattaaatggggtcggcggggaggggatgcagccatctgaggtctcagctctctgagcaagacaggatctgcagaggcccgccagcccaggggtgagaaatggcagcaacctcctccccagccctcaccatacacaacctcctctaacagaagcagagaagcaccatgaggccatccggggtgggcaggagaaagccaggtaacccagggcagtgctgagccctgctggccagtgcctctcagcagaggcccggccctcccatcccagacccttgccttgctccgctgcctggagctcagctccccttcctgccggctgatggcatctttcctgtcctccatagatggggtggttggcagtcatttctagcgctccagggacacctgtgtgggcttctcttggtcagtgtgtgtgcttgaagtgggcaatggctgtccacccgtccctgctgggctttgctaggcaccagacctgagagtgggggcatcaaccaccaaagtgacataacctcacgcaccttccttctctctgtgccaacttgtttttcttttctcttccatgctgtcagaggatgcaaaaggctgctaagatcaagaaaaaagcggtgtgtagggccttgaggccctgggacagtgttgtttgcttgtgtttccgtggcttgtcctgggcagtgggggctggggggttcccctggggatctaaataatgttgcaaagcagcttttcctcttcccttggtaggtgaatcttagatgtttgtaaatgaaactacagacacttcatttttttaaccacccatttatggaaggatttattaattcttctttcttagcatctcctgtgtactgtatggataatgctgtgatgttcctgttttacgtggacattttaaattgatatgacatttagttgatatgacaacgtggtgggtgtagggtctgggcctcctgtgcagtattactgaattgttctgatagttaaagattccttaagcttaatttactaagtcaggagggtgagtagctcagtttgcccgtgtggtgctttctttattggaaatgagtttttgggctgggtgctgtggctcacacatgtaatcccagcactttgggagacagaggcaggaggatcatttgagcctaggagtttgagattggcctgggcaacacaatgagaaccctgtctccacaactttttttttttttttaattagctggtcatgatggcacatgcctgaagtcccagctgcctgggaggctgaagtgggaggagcacttgagcctgggagtttgaggctgcagtgatctgtgtttgcaccactgcactccagcctgggcgacagagtgagaccctatctcttaaagaaaaaaaaaagaaacaaaaaaagaaaataagtgttgaaacactggcagacttttaaaaatgggttgacactgaggccgggcgccgtggctcacgcctgtaatcccagcactttgggaggccgaggcgggcggatcacctgaggtcgggagttcgagattagcctgaccaacatggagaaaccccgtctctactaaaaatacaaaaaattagccaggcatggtggtacatgcctgtaattccagatactcgggaggctgaggcaggagaatcacttgaactcgggaggcaagaggtcgcagtgagccgagatcatgccattgcactccagcctgggcaacacgagcgaaactccatctcaaaagaaaaaaaaaaaggattgacatcgagtcatttgtttgtcacctggtcatttagtaaatgctagagcttttccaatcctcctcatacagaaaatatcaaaatagttggtgtcacaaggcctggggcaaaccccggggtccttggcactggcttattgcccactgttttcttctgtttaaacagcaggagatttagttccccctccctgctttgaagtaatgccattttctggcgctttggccagaagacccatgtggggactccctcttctggagtgagactttggtccacctaggatgtctgccttttgcccagcagcgtctcctttgattctgctcaggagcaggagaggaaggatcatgctcatgctcctcttcccgggctgatttcctccaggcaaggcagaatgtgccacacattgcagacttgcagttggggtgtgcttttctcaaaagagaggggccctcgcttgcagcctcctagtccagctggagcagggagtccctacggactgcagctggcttctgggacctgcaggtccagcaatcctacagagtcgctgccgcctttagaggggttggtacaggcagacccagctcaaaaaggcctctgcggccagtcaggtggccgcctgattacatttaattacggtttgttcttcctttttggaaagtgggatgctcagtgtcattgctgaaggtccctttcctggcccggccacagccatggggatgactgcaggtcatgccccccatccacagacatgccgaggcccaccctgtggcctgttctctggtgtctgtaggatccgtactgtcgacaccctcccttcttctgccaaggaggatgatgggtgtcctctccctgccctgttactgatgggttttccactggaggctgggtggcttcaggctgcccctcttctcccatccagggatcccagcctcaggtttcctccacaattgtcactaatgccaaggtccacctgcaacttttctcacttctggcttgacctactttttagcaagaggattttgagccacaacccatgaatataacctttaaatgcatgctgatgctgaatataacccaattttaaaaaacagaaaaagttcctccgcggctgcggattgtcagctgcactgctttcaactcctttctctttctaatgagttaaaagcaaagaaagcccaaaagaccctttcccttgaaaattgagctaaaatacacatttattattacaataccgggcctctctaaaactcaaaattcttgaggaattgtcagcagggagatttcttatttcagattttctagtgaataattaaatcatagtttttgctgtttcgaaatggaaaatagaccaccctgggctccccagtgaccacggagaattattcacctcggtgggcaaaccaatagaacttgaaattcattgccaccgtgcagtggtaattaggattcttacaaatgtaaaaaccaattaaaggctatcctagtttggggcagactctgaagagttcactcagctcagaagagcccatgaaactcgtctcacaaccatatgccagacatactacagtggctacaggtgacgaattaggccatttgtgtggcacctctcttggcttctctctgtcgctgtgaggacagcacttaggccagccccagggctcagtcccccaaggacgctgtgggatggacatggtggtgactgattaaatcagaaggaaaggctgacattttcattcagcttctctgacaatgtcttccccatttcttaaggatacttagaatcccaaatccaggaaacgtaacctgagtctataaattccacaggggtcagccagagggccttgcttgccactggcaggaggggctgtggcgacagacccaggcgtcccgccccatctcggtcaagctcccgggggctggccctcctccctcccaggtgcctcttacagactgcctcgagaactcacacttagctagatgatgcggccggtggcgtgcaggtagatttctgatggccagtagcatttccttctacgtggactctgggtaattgttaaaattgccgagccttccttcgagttattactttttacattgacggataaaattgtatgtatttgttatgtacaacataatattttggagcatatacacattgtgaaatgactatatctagctaattaacgtgcattacatcacctagttttaatttttgtaatgagaacacttcattcactatcttagcaatttttaagaatatgaaatattattaacggtagtcaccatgatgcacaatagatctcttgaactcatttctcctgtctagcaggagctttgtgtccgtggaccaatacttcccccttcactcctttgccccagcccctgataaccaccattcagctctctacttctgtgagatcgacatttgtagcttccacctgagtgagatggtgcagtatttatctttctgtgcctggctgatttcacttcacagcatgtcctctagggtcatccatgtgttggaaatgacatggctttttctttgtgaaggctgagtaggcctccagtgtgtctgcgcgccacatttctttatccattcatcgtgaatggacttcgggttgatcccatgtcttggctgttgtggatagtgctgccgtgagcatgggagtgcaggtgtctcctagacacgctgatttcacttcctttggaaatatgcccagcagtgggattgctggatcacatggtggttgtagtttgaatttttggaggaaccgccattctattctccacagtggctgcactgattcacaccctcccacagtgtaccagggttcccttttctccaccccacgccagtgcttcttatcttttatctttttgacgagagccattctgacagatatgaaatgatatattgttgtggttttaatttggatttatctggtgattagggatgttgagcattttgtcataatgctatttgcatgtcctctattccgagttggtttttggactttaacaatatccactgtccttcttagaattctgagggggatgcccagacgctgacggaagtggacctcttcatttccacccagaggatcaaggttttaaatgcagacacgcaggtaagcgtttaagacagttgttcaaaatcaggtaaactcctaagttcgactccttcttgtcccatggtataggccctcgttctcagcagcttctctcctgtgctctctgcgcccatcaacccaaggcccatagcccgggctgcgggaggagcaaggagcgcacagcaggtagcagtcgtgctggcgtcaccccagggctctgcgggcgggaggtaggtgggaagacctgctgggctacctgggccctcccctgcttccccactcccgggtagcctgacctctggggacagaggaggcagcagcccccactatgtggctcacactgcagcccaccactcccaacccagtgccgtgccctgaccatcctccaggccctcacataccctgatacgggcacaggggcgcccttcctcatcccatgtctgtcctgtgtccaggcttgcaccttgtcccactgatctttgtgtcctgcacccccctaccctggaaccagccccctcctggagcctggcacttggtgaaaactcagggagacaggtgccagggctcaggcactgggcttgcgacgcttcacagactttgacttcattttctgatcttttgtgggcaaaccatctggactagatccccccaccaaccctccgagccccatgcctcatcacccacctgtgctgggtgtccccaagaccaccacaggctgggtggtttggaggactgacaggactcagtgagctcacagctgagatttatttcagcagatggctccagagcagaatcagcaaagcggatgcaggcttccagagccctccccgcagtcacacaggacacactgaactccctggcaaggggctgtgacaacagagaagttgtgtctaccagggaagctcatagacactcagcccaaggtgtttactgggagttggtcataggcaccctctgcctggcagctaccaaaattccagactcccagaggcaaaagaggtgtccagcctagaccacgttgtttgcacaaacggtttaggcaaaaggaaccatggttgtcagttcgggtgctgggtaccctcctgagatccacgttcccagatgccagagagggccagccttgcaggcgggcctttctgggtacagctgctaggcctgccccagtacctcttcttgccagtgtacatggagggtgccacacctggggtgggaggatgggcttggggattgaagctgagccccatcctcatgagctgtatagccttaaacaagttcctgaacatctctgaacctcctaatacccacagccccagctgaaagagtaactcttccgctggatcctgtgaaggagagatgagaaatctcctaggctggcccagttcagggttcactccactggccccttctcccttcctttcctttcccttctggatctttggattctggacagggcatgcaaattaaagctgttggggcagaggagctggagaggagggaacaggtgagagactgggaaggccaaagtagccattcagagcaggagagcagatgcggccatgttggtaggcagcctctgtgaggaggaggagggatctgccattgataggagctggggaaggaacatgtttctgacacctggggattgattcaggcatttatgacagtgacagaaatcaggagatgctgaagagccactccaactgtttcctttcagtgtccctccctggaaggtgactcttgtggttatgaaacagcctcatggctttggccagaaaaaaagtcagcagctgagacaaaggtgaagcagcatgcactgcaaagtggattctgtgaggaagaaatgaggtccagaggttgcagaaacactcgagtttcttttgtgaacagaggacaaaagcataaaagaccagttgattagtttttttgagctttgtgtgcagtcttgttaggtaggggttgtgggcaagatgctggctggagattcctgtccaaggacaaaaaaccatcaagagtcatgggcctgccagaggccgagggaattgaagtcaggtgggctaccttggtgtcttttgacccaggcccaggctgtttgggctccctgggaagagctcattgaatgacaaacattggccttgatgctttcctcttctgcacagcaggaaggccaggccaggccactcttgggcccataggagagcacctcgttcagaagggacccttctccagagccactggtggcctctcatccgggaatgtatgggtttcactatatggcaagcccctgctccagcagagacagcccgagagctcacctgacatcacgcctccctgggttctgcacagtccattttggaagctgggactgagatgagggcagagtgactttgactgtaaatcattaccctaaaacgctctgttaattagggccgtggttctcaaccagtgtgatttttgtccctcaggggacatttagcaatggctggaaataattttcattctcacacttgggaagagggaggtgctactggcatctcctggggagaggcttggaatgctcctaacaccttgcagtgcacatgacagccctccacaataaagaatgatccggccccaaatgtcaggagaatcagggttgcgaaacccgaataattggagtgccttttttttttttttcctttctttttttttgagacggagttttgctcttgttgcccaggctggagtgcagtggcgcaatctcggctcgatgcaacctctgccttcacagttcaagcgattctcctgcctcagcctcctgagtatctgggattacaggcacctgccaccacgcccaactatttattttatatttttagtagagatggggtttcaccatgtttgccaggctggtcttgaactcctgacctcaggtgatctgcctgcctcggcctcccaaagtgctaggattacaggcttgagccaccatgcccagccctggagtacttttcaatggattgtcccagtagtgttccctgacgtggcactgtctccctcccgacaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagttcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctcaaaaaaaaaaaaaaatctatccttcaggggcagttggccagggcgttctttttcacataaggacttgaggctgtctcagggacctgggcaatagggaagggtccccatattgtcatgatcctgacatacagcatggaaactgaagacagggttcaaacctttggctggcgcagtcatcttcttcctaagaacttgggtccacttgaagtgcttcggcgcaatggcagatttacaggagggagagagcatttcaacagcgcactcacacattccttccaccgctacacggagacccttcgaaacctggatgggtatttctgtgtgactgagggccgaggatgtgtgagagacctggcttggggatgggccacaggtactggcggaatgaggccaggagcaggcccggtggcgaagggtggcagtcagctggtgagagtttccaaggggcactgagagcccccaggtgcagccgatgcggagggttaaagccagggtatgccgtattgggtagatgaggccgcagggtggtcctgccagcaacagcagcctcctcttccccacctctccagcgcctgcaggctctgcccacagcccacttgcaggaggccgcttgagccctgaggtggggcctgggctgggctcctggactcacagcagtgaacgcccacaggcttggctgcgagttggggccggcagggcgaccccttctctgaagcgccagccgcagagagagccccctgaaccccacacctcccaggaggcagccggtacccggcgtggagtgacggggaggcggcggctggcggcacaccagcggcccagatgacaccggaaggaggcgcagccccgcggagccggctccccgggcttggagcttccgcgggggcggaggatgtcgtccaaggggaggaagaatggcggtggcccgagggagcccaagtggagtccgagggccgtgggtggtggagccgggcctccggggctccagggctctcaggccgtccttcccagccaggtggcctcgtcaggcggagacagaagcagaggcctgggggccgccctccgctcttcccaaaggcccgaccctctcctgcgcgggcgctgcccccggccctcctgccgagccccatcagctcgccaactccgcaggccagcccggcggcgccatctggcggtccccgggcgtcgcgcctccagctgggtctgtgcgcgcggcagagatgctgggcgtgggaaccggcaagtcctggaaacggcttagggcccgtcagggagggcagttccacgcctgctggagggcaggccgcctgctgcgcgcttctaatccggcccagcttgtctttcccaatgcatacattcatctgctgctcttacatcctgccacgtggagagtgggaagggaattgaggccaaagcccttgttttcacctgttttgggatcctgttgagtaggagtttgctgggggcgcccgtgcaggacccccttgagggcagttggggaggcacgtgaggagcaggacagcgcataaggagggctcacacagcccagagcctggcgggaggccccgctgtgggctgaggcgtcaccaaggccgccaagagccccgccgcgctcccagggctgcacagctgccagcctgcttggcgagctccgggagctcagtacagccctcacctcccactgtctcctgtctgcgcaccagcaggcggccggccaggccctgagtgctgtttcagtgtccaggcctttgccatgtcagagtcggtgatgtccactgaagcagctcagcggaagtagaaagaagtgacgtgcttcatggggcctgtgtggagtcccaggtctcatgtcttgcaggcctggcctggcacagccacacatccctagaagagcagccaggcacaccctctgcctccagtgggcactgggttctgttgctaccgataaatacatgcggggtagacaactagcagcacgatgctcccggaaaacacactgaaagtccattttcggcatcagatgagtggaaaggaaatacagatggggtcaggtgcagtggctcacacctgcaatgccaacagtttgggaggccaaggcaggaggatcacttatgtccaggagtttgagaccagcctgggcaatatggcaagacccctatctctacaagaaaactttttttaattagctggatgtggttgtgctcacctacattcccactccagtctgggcaacagagccagacctcatctcgaaagaaaaaaaaagcaacaaaaatatgacatgtagtaaataattcattgttgtcccagactttctttgaaacagctttgacctggagcatctgggccgtgccacagcttaggcagggacagtcaggagtagaccctttggggttcagggcaacactggggttcgctcacggtggagtgctggtgggagacagccttcatcagatgagggagggcccccagtttctttcttgttcttctaagcccgagcaagggctcccttgaaggcttatgggtgcatcctgcacccagccctgccgcagccccctgctgaggaggctgcggggagcctgtgccacgtgcctgtctccagctggcctgccctctgcacaggcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggaggtaagccacacccaccagcctcagggaggccacatttgccagcttctgctccctgagctcctgcagagcgagccttcccggggtcctcacgcacacccttgccttcctatcagactccagtggggcccggaatgtgcacctcgctcctgccttccagctgagcacttgggtgtgaaatgaggtgtttgtaacaaagaagctgattacagtcagctttaatgacctcgaaaatgcgccttttaatgctgctattatcatcaaccagcactcagcacccaggagatatttctgaaaagcatgtggcatctctaaagggagcctgggggctctggcagaggaggctggaagccaccagtagcagaggccttagctggtcccagtggcttcccccaggggactttggaaagttcttatgggcagaggagcaaattccctggggatggcccatacctggactgtttgttaaatggctgaatgattgtgtctgctgtggatgagtggatggtctctgctgcttgttgaatgggtgaatgcatgatcctggtttcttgctgaagacattccaggcagtttctgagacagtgacctttgagaggaaataaaagtagaaggacttttccaacaagagtgaaggccgggggcaggatatgggtatgggagcctgagaacattcctctggcctctgtgggtgtggaaggagcaggaaccaggacactggagccctgcttggggtgggaaggtcagtgttgggcacgggtggggttggggtcaatgccaggcacgggtggggatagggggtctgtgcttccaggttcccaggattgctgggtggaccccaggaaggtgtgggagccagactggggtgaggctgggggtgggtgggcagggctcccagcccaagacctctcctggctgagatgagccagccttggatcccagggcagggcgggatgtgccaggacagggtcagcctcatcctcctgtgggtccttggcagaggcctcggtccttgccgccagcccctctcacactgctgatccctttgcagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaaggtaggcaccctgggatcctccgcccaggggtcacctcaaccctgcctcacttcatccccactttgctgcaatccccacttcactgcaatccccacttcacccatggggaaactgaggcccagggagacccacccggtgactggtcgatgatggtatcagaatttgaactcaagaccattccccatgtctgaatcagaggtggacccgggctggcctggggtgggaagggaggggttgtctgagccctgtaccgagccatgtggccctgggcaagggcccaagaaccagtgagtatagggtgaccagcttatcctgctttgcctgggactttgccaggttagcactgaaagtccggcttctgggaaaccccctcagtgctggtgggctggggaggtggggcaccctgcatgggttgggttctgggacgcaggttcccttaagtaaggaggccaccctgaccgtcagactcgtgagcttgcagctttgggaggtgctgcctgtcgctgtgaggggtcaggcagaagggtcaccggcagctagggtgggggccttcacactggccgcctgcgaaggaatgggttctgcctgctgctggcggctcttgtgacccagctgtggcctggcccccagccctctgtggcatgttcctccccaccctgctgtggtcttggtgctggaggaagcgccttcctcctctttgttcggcatgagagatgaagggcattccccaggccagagcatcccatagactggctctcggagctggcccggcagagcgtctgcccgatgggcagccacacagagagacatgggagaggcctccaccagtggcaccagagggctcagcagttgaggccccccctcccagggctgcagctcccaggtggaggcttgggttcctccctgtgcctcctcacccccaccggaccccggcggcctggcgcacccgctgacaattgcgtcctcactcacagagatttgctgtgtggtcactccctgccctgcaggaggtccgtccttggagggcattgggttttgaggaaggtgtctccacatccttccgtaggaagctgtcccgaattcggcatgatgatggccccctcgacaccctgagggtgacctggtgccaggtgcgttggttctgcccagtggcactcagaacctgggctcgctcctgcagtggctaatcttccccagggcagaggcaccctgcgcatggtgggacagagggcgcagtgctgccctggaaacctggtagctctggtaagggccagggcgaggcttgtccccgctgcacagaggggctaccgaggctgagaggggactgcctgcctctcccattgtgtgttctcactgcccccggcctccaccaccctgccagcctcgctcatcctgggtcaggcttgatgtctaaggcccagcctgtgactcctgtccccgtgctctgcagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcctttcccaggctcccttgtccccatggtggttgtcccctgctttggagggagggcagcagacttcaccagccactgtagcttggacacaaccaattgtggcatcacttactgtgctcaacaaacagacgttcactcattcattcattcatgtactcatcattcgcttgttcactcagccattcagcagacatttgtgaagtacctgctctgtgttaggctttgtaccaggcaatgggaaggcaggagtgctgcctggaggaggtgatgctgggcttgagtgagtgtggttctggccaaaaacctgtaccagttccccaggccagagttctttagcccagagtttccaccctctcactgacctgcatttgactggcctgaattcttttttcctttgtttttcctcctgcaaaagacccagagggcagagatgtggccactaagtggagtaaagaagaaaagggctggcaatacccaaattgtttaaaccagccctgagtatgaaggagcccaggaggagagacactgcgggctggagtgggagttttgtggaggtgatggggagggtgtgtgcccacccacagtcaggaaagacagtgggagaacattctagaaggactaccaaatcttctccattgttttctggtgaagcagcatggagggttacacccaccgtcagggtggagtcccagggcttgggtttagggtccatctctgaccctgctgtgtcagagcaaatttgctgctataaaaaagagtctgcaaatctccatatactgagagcttattgcttattcatgctgcagtttaatttgcagtgggggcggtgggggtgagcttcactccacaaagccactcaggggcccaggctctgccctcagctgggctttggcagcccccactgggtgctctgtgtctcgctggcactgcaggaagagaggcagctcagaagaccttgtgaaggttttcagggccagggcagaagtggcccttgtcatttctgcccacagcccactggccagatagctcagccacggacccatggggaggctgggaagtgggggccagctggtgcccagaacgaagagggacaggggcatcgccagcgtcagccataccttccctgctgtgtgaccctcaacaagtcactgaacgctcactggattcccctcaaaaggtgcttgtgaagatcagctgagaaaatccataaagtaccccaagctatccaaggtgggcccgctggtcctcgtctctgccaaggaggaggccccgtggcccctggacctggcacaggtgccaggacgagttgtctgcaccccacttgggacttcaggacagtgcgcctgccgcaggagctcgccagctggtggtctggcctggtccggctctgcctgactgctctgcacacatgtgacctgggcacaagcagttgccccagctaatttgggggctctgcagaaaatcagctggagccctgtctgcagctgctgtgcgcactttgtggatgggcatggctgggccccagggaggagggctgggacatccttctgggctactgcacccccgaccatcaccaggccctgcctgtgtgcctcccaccccagcactggggacagtggaggaagctggggactgacagccctgcagccctcatgaggagccgtgctgtgcagagcctggggtgctgtatggtgtcccctgggctgcccctgcctggctaaacctggtgaccacactgcctttgcctcctgagtggcactggggagctgcttgtcctgttcctgcacccccttgcccagcctaggaggcaggtgggcctgggttggtggccagtgctgctcactgacagccctgtcgctgtgagccctgcaggagaggctggctttccccaccatggggtggcctgggggctacctactcgtagggcctgtgaatatagccctgcccgggatgagtttgatgccccctcagtctgctggtcttccccaaactataaccccatgaggagcacaggaactggagaagctggggcacacagaggtttagtgacttgccccaggtcacacagccatgtggagcactggtggggagagggggagaagagatgaggaagggaaggactccggtttgtgttttgtgggggctaacatgaatgggaaaggaggggacagcctggagcagcccagccaagcccaggtgcagggttctgtgcctttcttcccagagagctggagagtgcaatgggcaggtgtgaagtcaaggcggagggcagcagacggggaccagggctcgctccagctgccttctggggcaggtgcagaggggtctggagtagctcccaaagatggggcaaggtgggtccgagtggccaggaagctgagggtggtggtgcggaagggggtttctcagaagatcagggggtgcagggttgagggcagcagcagacttgcggggcctgcagtgaggaaggagtcatgtgcaattctgaagacaacatctccggggtggcaatacgaaagagagggtgccacccacggctcggtgtctctgccctgggtctagggtctgagttccggagtgatggagggggccaagcgtctgtgaaacttggggggtggtctgggtcacgactggggacgaggagggtctggaggtcccagccctgcttgtggatgcgctgttgttccaccctctggctctgcctccctgtctgtgaaatggggtcccacttccttgaggcctcagtgctcaggatgcaggggagatgctggcagccgaggagaggggcaaatgctggctgtcaggggctttctccaggatacaggacagctcaccctgagagtgccagggagggttagatgaagcaaatgaataggcatggttatgatccatctccccagtgatccagaaaatggcatgcaggcggccatatggatcagtcaccatctctgagtggctcggctgcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatctgcctctctccacccccttctcttctagtcctaattctccttggacatccatttttccggtttttgttttcatttaaaaaataactgtggtaaaatatatctgtaacttaaaatcgagcatcatagccattttgaagtgcagagttctgtggcagtcagtccatctgcatgtcaggcagccatggccactgcgctctcctgcacgtcttcctcctccccaacaggaactttgtccccactaagcaccaccgcccatttctccttcccagcccctggcggccccccacttctactttgtctctgtgattctgactaccccaggtacctcatatcagtggcatcacacagtgtttgttcgtgtgcctggcctgtttcatgcagcatagtgtccccgaggtctgtccgtgttgtagcacacttcagactctccctcctctccagggctgagtactgtttccctgcaggcctagagcacattctgtttctccgctagtccgtgctgtcaccctcggctgttgtgaacactgctgctgtgaacacgggtgtgcacggcgcctgttttccattctgtccagtctcgtggtcacaggcgctcccaggccctcctgtccatctgtttggcgtcacttttaggctggaatggaagcccccaccgctgcactccagcctgggtgacagaatgagaccctgtctccaacaaaaccagaaccagtatatttggcacaaaatgcccttacgtcacttggcgggggggggatgtaggaataaagtgactcttccctgtcgatgtagaccatttgggcatccggcaaacagagccttcccttgacagaacagatgccccacctttctggtggccaggggacaggctgcctctcctttcccgcccgcccatcagctaagtgcctgtcttccaggatggtaaccaggctgtgccgtaggaggccaggtggcagtggccttgggctgtgtcaccagtctctagcctgaccacaaagggagcggccctgggggaggtgcagctgggggacaggttccaccgtgggagtcagaaaacttggtggttccccacacaccatggcattaactctcttgttttaaagaaacatactgcatatcataaggatctctgtctgtgagtcagcgaattgcacgtgcacgtattcatcatgtggcgcttttccctctgcatgtcccatctttggggacgtggtggagcgcctgtcgggtgtggcgggaacacgtgtgctgacctggccatgtctgcttagatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagaggtaaggagggactttgagtgtgcctctgcatgccggttcccacgtgctcccgcctgccctccatgagcctcccccgctccagaggacacagggcatctgaaggtcagccaggctgtgtctcccatcggggctgctgtgacaagggtgaatggagcggcaggtgatgcggagccatcccggtctggctctaactgagcaaccgggagggcacaggctgctgggggtgctccctggacactacttttgggactggacctgtatgtccagttcagaagctctgcagggcacacagctctggccaccctggcaggcttgcctctctgcccttgctggccatcccctcccacagccaggctgcttgccctgtcccacttcactggctgaaccccccacagtccagttctttctggcatcgcttccacggcagtgtgaggatggtgtgggggaggtgcaggttttcctccagagctcacaaggaggcaggatcattgggaggggggatggtgctggggaggtggcacatacaccgggggaggcctggccagtgcgcagcgggtgtgcgtgtgtgtgtgtgtgtagtgtgagcgagtgtgggtgtgtgcatgtggatgtgtgagagcatgggtgtgtgtgggatgtgatgtatgagtgtgggtaagtgtgggtaggtgtgggaaatgagtgtgtgcgtgcacgtgggtgtataggggtgcatgagtggatgggtgtgggtgtgtggctgtgtgaatgtacctgagtgtgcgtgtggaggagtgtgtgtgtgtgggtgagtgtatgcggatgtacgtgtgtgtgtgagagcatggggtgtgtaggagtgcgagtgtgggtgtgtgcaggggtgtgtggctgtgggtgtgtgtgagcatggggtgtcaagcatgagtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggggtctctagttcctgttcttcggatgaggtctccaggagccacatcgggacactggtattttgtgcactgcagggtcggctgggagctgggaggcctgttttccctggactggtgggggcaggggtctggctcaggaggaggaggggccaggcggacaccagcctccctttgatggcttcaaagaaaggaaaagccagtgttcccaagtagatgctttgaagcggccgcccccacggccagcagccccacacctgtgaggaaatccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtggggaggccagcatgcctgcggcagctgaccctggcagtgcgagggccccccatccggaggccgcagcctagcacagtcccgggcaggacaggggagagcgtcgtgctcaggagaggagaagtgggcagtagagctccctttccgttcttgaagcagacgtttagagtctgctccttcccagtgtccgcaaagaaggattacaaggcgcgccacccacacggttggtctccctggggcggtctgaggccttgcttgtatacccagctcctttggagtcagggctcgaggccaggccccaaagggtcatttgctcaccgatccccaaaggctaagaacttgaggtgccctgggccccagcgagcctgttcccagcccccagcacactttcctggcccgtgtgtgttttgtaagaaggggtgtaggccgggcgcggtggctcaggcctgtaatcccagcactttgggaggccgaggcgggcgtatcacgaggtcgggagattgagaccatcctggctaacacggtgaaaccccgtctctgctaaaaaatacaaaaaaattcgctgggtgtggtggcgggcacctgtaatcccagctactgaggaggctgaggcaggagaatgacatgaacccggggggcagagcttgcagtgagccgagattgcaccactgcactccagcctgggcgacagagcaagactccgtctcaaaaaaaaaaaaaaaagaaggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggagggcagcggctcagcctcctgtttctgtccgcagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatga

SEQ ID NO: 37340 - DNA, 10691 bp, Homo sapiens
ggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggtaggcggtggggacagcggcggggatggcggtggcggggagaggtggctgcgggcggacgtgatagtgtgagggcagaggccgcagtgaggccggctcctgactcaccaggcctcacactgagtcacacaccccgccccaggggcgtggggagaagccatgggtggggctgccctgtccaagcagggaccccggggtcctccaaagactgagcctggccaggccccacctgtgcctggagtcctggagccatccctgtgggggatgacagggaaggttggcacatggcaggcgggccaggccactcggtcggcaaacccggaacacgcacgcgcctggccccggtagcacagactcacatagggtctcagggacacccagacacccacgctcctcccatacctcacgggaatgagcagaacgggaaagcggggagaggtgtgggggtgctggaagtcctggaggaaagccaggcctgtctggaccaggggctccctgaggaattagaggggagggcccggctggagtgacctagatttctctgtgggaacagcaggtggaggagcacccctcggtgccagccagacccacctgtggcggaatcctggccccactcacgcgagtgtgtgtgcatgcgtgtgagtgtgagtgacaggagcacagacgctgtgagttgaaggcagtggttctaggaacgccatttcctccttcccaggctacagcaacagggattaaggttagacagtaagatggacctcccagaatgccagggacccagatgccagttcatcatggtccacttggtgtttagaggggccttccccaggactggcctccagccactggccagggggaagtgaaggtcgcccagcggaggggccggcccggcggcctggactgtggggtcctccctccaggggcctcagccttgctggtgaccaagtcgggtgcccaggggtcatggggtggaggacggtgagggaagggttaattaccaccctggctgccctgccaattagagggaggtggattataattggggggtgggggtgaggtccccaggctggggcgtgcccccactccgggctgggcctcacgagcgtcagagggttaatagccccggcccagaagccccattaaccagggtgaacctggggcctctgccatgggggtgtcccccacagagcatccagctctgggcagagttgtgggagggccacggcccctttccctgcaccccaccctgagcccctcagccaggtcgctctggtgggccttctcatgcccccaccatcagcccatcctctctgcacccatccacgagtccatccctctgcccactcaccatccaaccatgggaccctgtcgtcgacggctgtcccacccctccatccaccactctgtccatccttccagcagtcacagcagccctcccatcctcctcctgcctgtccctccatccaccctccgccctccaccctctgcccacccacctgtctgtccactcactgtggagtcgggctgacgcagctgcccttggcgtgtgtgtggctggacggggtgggtgtggcccctgcctcaggctctgccgggtgggacagggcactgcaacagggcatactggtccagggagacagtgtcactctcctgtgaccgggcacagatgaggtttgggcacaggaggggctcaaaaggagtcagtgtgggccggggcaggccaggctggcttcctggaggaggctgggcactgtaccatggcaaggattggagaactgatgtcagaggccctggcacattcctcctggcgaccaggaggtcagtgggtgagcgtatctgccctctcgggtagaggaggcacagctggggggtgggctgtggaagatggaccaccagggctgacatgtgaggagaccaagccatggcaggaatggggaggcactggccctggtgcccccctggcctccctgccctggattggaggctgctcctagggttgccaatagcgatggagtggtggagaggaggcaggaggccagtgctttgctgtgtggcagagctgggctaccaccgtccctctccacaggcacatccagggggcagtaccacaccctgcaggctggcttcagctctcgctctcagggcctgagtggggacaagacctcggtgagcgatgggcccagcccgagggggacgatctgagctctgcagtctggagagtgggaggctctgcagcgggcccggacacaggtgagcccaggcacgccctcaccgccccctctcgacccacagggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcgggtgagcggctgggcccggctcagggagggggcttctaccacgggcccagcctgaacccaaagttagcctgacccctgacccctggctccgcagttttgatgacattgacctgccctcagcagtcaagtacctcatggcttcagaccccaacctgcaggtgctgggagcggcctacatccagcacaagtgctacagcgatgcagccgccaagaagcaggtgaccaccccgaccacccactcgctgccccctggtgacctccttcgtgggccccaccacctcccactgtcctctgctcactgagcacccctcatgatccccaagctgactgggtagaccccactctgtctggagccccctcagcagaggaagagcagaaggatacaatttggatacaccagtatcacctgcatcacctccgtacccccacatatacctcatcacctccgtacacccgcacacacctgcgtcacctccgtacccccacatatacctcatcacctccatacccccgcacacacctccgtcacctccgtacccccgcacacacctgcatcacctccatacccccacacacacctgcgtcacctccgtacccccgcacacacctgcgtcacctccgtacccccgcacacacctccgtcacctccgtacccccgcacacacctgtgtcacctccctacccccacatatacctcatcacctccgtacacccgcacatacctgcgtcacctccctacccccacatatacctcatcacctccgtacccccgcacacacctgcgtcacctccctacccccacatatacctcatcacctccgtacacccgcacacacctgcgtcacctccctacccccgcacacacctgcgtcacctccgtacccctgcacacacctccgtcacctccgtacccccgcacacacctgcgtcacctccctacccccgcacacacctgcgtcacctccgtacccccgcacacacctgcgtcacctccctacccccgcacacacctgcgtcacctccgtacccccgcacacacctctgtcacctccctacccccgcacacacctgcatcacctccgtacccccgcacacacctgcgtcacctccgtacccccgcacacacctgcgtcacctccctacccccgcacacacctgcgtcacctccctacccccgcacacacctgcgtcacctccctacccccgcacacacctgcgtcacctccctacccccgcacacacctgcgtcacctccgtacccccgcacacacctgcgtcacctccctacccccgcacacacctgcgtcacctccgtacccccgcacacacctccgtcacctccgtacccccgcacacacctgcgtcacctccgtacccccgcacacacctccgtcacctccctaccgccgcacacacctccgtcacctccctatacggctgcatcccctgcatatctacatctacgcacctggacacagctgcacacaggtgcatagtctgcatccatccacatgcgtctgtgcacccccatatgcctgtgcccgcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacaggtgctgcctgtcccctcctccacctgtccttcctccacctgcgcccctctgcctatcccccctgccttcctccccacctgcccccctccacctgcccaccatctgccccccttctccacctgccccctctgccacctgcccccctactcctcctccccccctctgccttacccccccacctgcccgccatctgccccactcctccacctgccccctcctccacctgccccctctgcctgtcccctactcctcctgtcctccctctgtgtcccccccacctggcccccctcctccacctgccccctctgcctatcccccacctgtccccccctccacctgtcccccttttctgcctgtccccctcctcctgtccctcctctgcctgtcctctctcctccgttctgacccctccacctcattcggttcccctccgtccctttgtaccttttgccggccgtgtttctacttgggcctccactgcccgcctctttcctggacccccggccaccctgtcctgtggttttgtctccttggagccgcctgcactgccaggcctgctcaccaccccacccccacatcttgtcccctcttgcttggtcccagctctatcacctcaaatgccaccccagggtctccccagtggggctcgtgggtgaggcacagaacaccaggccagcccctggggagaggcgggacctcttcacaccatccccagaaacgcggagggggttggagggcagacgctgatagcagcctcccccgtcctccagggatcctgtggaacctttcatccagcgaccacctgaaggaccgcctggccagagacacgctggagcagctcacagacctggtgttgagccccctgtcgggggctgggggtccccccctcatccagcagaacgcctcggaggcagagatcttctacaacgccaccggcttcctcaggtgcgccagcctcgggcagcggggtggggattgcaggcgcgggtcactgtggggactccgcctggcctggcgttcgcagcccacacaccgcacgcctcgcgctggggatgggcgtgcgagggcccacgatgggttggggcaaggcccgggatgcggggtccctggggggctctgatccacctcggtccccaggaacctcagctcagcctctcaggccactcgccagaagatgcgggagtgccacgggctggtggacgccctggtcacctctatcaaccacgccctggacgcgggcaaatgcgaggacaaggtgaggggcgcggtgtggaggaggggccgtgcccccgggccgccgctctgacccgcgcccctgccccgcgcccccgcccgcagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgaggtgggcaccagcctgagcggggcgtggggtgggtgctgcgaccccggccccgctgaccccggccccgctcacccccgccccgctcacccccgccccgctcaccccgccccgctcaccccggaccccgctcacccccgccccgctcacccccgaccccgctcacacccgccccgctcacccccgccccgctcacccccgccccgctcaccccggaccccgctcacccccgccccgctcacccccggccccgctcacacccgccccgctcacccccgccccgctcaccccggaccccgctcaccccggaccccgctcacacccgccccgctcacacccggccccgctcacccccgccccgctcacccccggcccgctcacacccggccccgctcacacccggccccgctcacacccgccccgctcacccccggccccgctcacacctgccccgctcacacccggccccgctcacacccggccccgctcacacccggcccgctcacacccgccccgctcacccccggccccgctcacacccggccccgttcacacccgccccgctcacacccgccccgctcacccccggcccgctcacacccgccccgctcacccccggcccgctcacacccggccccgctcacacccggccccgctcacacccgccccgctcacccccggccccgctcacacccgccccgctcacacccggccccgctcacacccggcccgctcacacccgccccgctcacacccgccccgctcacacccgccccgctcacccccggccccgctcacccccggccccgttcacacccgccccgctcacacccgccccgctcacccccggcccgctcacccccggccccgctcacacccggccccgctcacacccgccccgctcacacccggccccgctcacacccggccccgctcacacccggccccgctcacacccgccccgctcacccccgccccgctcacccccggccccgctcacccccggccccgctcacccccgaccccgctcacccccgaccccgctcacccccgccccgctcacccccgccccgctcacccccgacccccggccccgctcacccccgacccccggccccgctcacccccggctccactgaccccggccccgctcaccccggaccccgctcacccccgacccccggccccgctcacccccggctccactgaccccggccccgctcaccccggaccccgctcacccccgacccccggccccgctcacccccgacccccggccccgctcacccccggctccactgaccccggccccgctcaccccggaccccgctcacccccgacccccggccccgctcacccccggctccactgaccccggccccgctcaccccggaccccgctcacccccgacccccggccccgctcacccccggctccactgaccccggccccgctcaccccgaccccgctcaccccagacccccggccccgctcacccccggctccactgaccccggccccgctcaccccggaccccgctcacccccgacccccggccccgctcacccccggctccactgaccccggccccgctcaccccggaccccgctcacccccgacccccggccccgctcacccccgacccccggccccgctcacccccggctccactgaccccggccccgctcaccccggaccccgctcacccccgacccccggccccgctcacccccggctccactgaccccggccccgctcaccccggaccccgctcacccccgacccccggccccgctcacccccggctccactgaccccggccccgctcaccccgaccccgctcacccccgacccccggccccgctcacccccggccccgctcaccccgaccccgctcacccccgacccccggccccgctcacccccgacccgctcaccccgaccccgctcacccccgacccccggccccgctcacccccgacccgctcaccccgaccccgctcacccccgccccgctcacccctgccccgctcaccccgggccccgctcacccccggccccgctcaccccgaccccgctcacccccgacccccggccccgctcacccccggccccgctcacccccgccccgctcacccccgccccgctcaccccgggacccgctcaccccgaccccgctcaccccggaccccgctcacccccgccccgctcaccccggaccccgctcacccccgacccccggccccgctcacccccgccccgctcaccccggaccccgctcacccccgccccactcacacccgacccgctcaccccgacccgctcaccccgacccgctcaccccgaccccgccgactcctccccgccctgcgcagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcagggtggggcacccaacccagacccgagggggtcccaggggttcatgcggttgagggggggacagaggagggagagggaggggaggaggaaggggacgcccagggtccgcggagcctcggaggtcagcgtcccggtggcgcaggccttgggccttgggaggatggaagtcctgccctgggtttgaagggaggcacctgatccgggctgcggctgattccccccggctggggggcaaaggcagaagcagaggcccccctgagggtggcgagaggatgcagcgaccccattgtggcaggaccccctcaggtgagggtctgaggcctccgggtcacggctcacaccctccctccccacagtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtgtgagtcgggcagcccctcgtccctgccctgctggacccacatgtcaattttgtctttaagtgtgggcttcagaccactggggccagtccagctccctgggggaggcaggggaccccaggtgcccaggtggccaggagtaggggtgcagactgacccccggcctcccacagccacgaaggtggtgagccacctgatcgagaagctgccgggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacaggtaggggccgacccagccgtgcagcagcctggtcaggggtcctcccagtccaccctgctttctggctgtgtgtcccctcctgactgccctccaccctcagccccgacagtgagaagtcctcccgggcagcatccagcctcctggccaacctgtggcagtacaacaagctccaccgtgacttccgggcggtacgtttcccgagcccagggcaagcagggacccgggtgcagggcatgggacgccgggggagggtcagtgaagaggcccatgggaggatggagaccagggacccagagaggaagggtccgggccacacccagcacactgcaggagggacagcgggcagagggccacatgggcagacatgcaccctgaccttgggcctctctccactgtagaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtc

SEQ ID NO: 37341 - DNA, 10691 bp, Homo sapiens; identical to SEQ ID NO: 37340

SEQ ID NO: 37342 - DNA, 9316 bp, Homo sapiens
catttccgcctctggcgaatggctcgtctgtagtgcacgccgcgggcccagctgcgaccccggccccgcccccgggaccccggccatggacggtgaggtcgccctctgaccccgcggggtggcatcgccggggccgccgcggctgtggcgggagcccccgcgccgctttccgccccttcctgcgccgacgggcgctgcgcagggagcggtcggcctgccggatggtggcgcggggcggggcaggcggggaggggtctgactcagtttcccctctgggtggagggggtggcccttgactcagcatcctccctgggtgggggagcagagggaaccttgactcagtttccctccacaccgtccatgggggcagctctggcttcgtttccctattaggggagaacgcatctgattcagtttcctctctggagggaggtggggcgtgccctccctcaattttccttaagaaagtacaacaggccctgattcagcttccctctggagaagaaggattccttaccccgttttccctcaagaagcaggtgtttctggttcctttcctccaccccttagtttcaccgcaggttctagggagcaggtcctgactcagttcccctgggagggagcctggcttctcctctccgtggagagcagattcctccttgtgagaatgggcattgggtgtgtgctgaccctgatctccctcccctttcagaactgttccccctcatcttcccggcaggtaagtggcccccgcggcggtcggggaggtgctccctggggtagggcagtgggggcagccgcctaatggggctgcggtgtcccctggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaaggtcagcactgcgccagggtgtgcggggaagggactgtggaaccccagccctctgtgtttgggagtcaggtttggatgtctgggcctctgtactttggacagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacaggtgaggtccctgcaggctaggaggcccagcatgaggggacaggaggcgggctatgaagtagccgctacagtgttactcctttctggacccagggcagaattcctcactccttgccctgactcagctctgcaagtaaactgcctttgtcttgaaattatctatttgtacgtttactctagcagatgagttccaggggatacggatgggtccctaatcacttctgaattcctgacccctgtagctggaaggacaagtccctcagagtcacgtctcttgtttgaggaagaaaaccattgaaccagcactctcccctggagttgacattgcagttgacagagacaggctgtaaaaaaatatacaggccgggcatagtggctcatgcttataatcctagcacttcgggaggccaaggcaggaagatctcttgagcctaggaattcaagactagccaaggcaacatagtgagaccccatgtctacaaaaaataagaaattagctgggtatggtggcatgcgcctatagtcccagggaggctgaggtgggaggatcgcctgagcccaggaggtcactgctgcggcaagctatgattgcaccactgcacttgggtggcagggcgataccttgtctttttttttttttttttttttttaagaaagagtcttgctctgtccccagactggagtgcagtggcgcgatctcagctcactgcaacctccaccttccgggttcatgccattctcctgcctcagcttcccgaatagctgggactacaggtgcctgccaccacgcctggctaattttttgtattttttagtagagacagggtttcaccgtgttagccaggatggtctcaatctcctgaccttgtgatctgcctgtcttggcctcccaaagtgctgggattacaggcttgagccaccgcacccggcccgacactgtgtctcttaaaaataaataaatacacagataaataaacaaggtgctgtcagagtaacagtttcagtcctgaaaataaaacgaggtcataggatagaaggataacctggggtgggggagttaggggagctggtgtgtgatgactttagattgggaggtcagggaaggcctccctcagctaagacttgaatggtgagaaggaggagagaagtaggaaaagaacattccaagccgaccaaacaagtgcaaaggccttgaggtgggaatgagtgtcctgtgtttagagagtggaaaaggagccccggtggctgtaagcagggagcccacagggaggctggcaggggcaggggcacggaggtgcttgtcagctgagtgaagggacagggttcgttgcagcacagtaggaagccactggagagggttaggcatggagcgatgatctaggggtgggcagagtaggaaggagcaggctgggcaaggcaggaaggtctgggctctgtgagagacagtgggacagacgactgggggcgctcagtttccagaacctgggaatccagtgtgtgaagaagcgggacctggagcaggctatcagtcagcgcatccagaccaacaacaaccccttccaaggtgagggcaaacctgcctgccacacccgcaccctctgtcaccctccccagcccgcctttcctgcatctccctcactggccaagacacagtaaagctggaatcttggtgcccattcagtactctcccactttaccactgggaaactgagtcccaggaggggacatgacattcaggccacagtggagtcagtgctgggttctgcctcctctaggacttgtgtttcacacacgcaccagcggccctcccagcgcagagctccctgcccccactgatagcacctatatccccacttcccctgctctcctgatcgcctgttttcttggcagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgagtagcgagggagacgcaggaaggggagagggtgggcctgaataggaggaagggggttggggtgagtgtggcctgcaagaggcgctctggcttcattcaatcatcttgcgtatttgtctactcttctctgcccagctctttgttggctggggagagagggcaaagaagacccagagctgtccttgaggtgtagctctggcctggcaggaagtctagcagagagtctgatgggagatgggcattttcagtattgtgtgatgagaaggtggtgtgcccacaactgcgataatgactctaggaaatgaactcccaggaacaagatagtgttcgagaatgatgattcagtgatggaagcccacagatgaattgggctgactgatcagctgcagtctttagttaagtaaccagcaggatgaatggaaataaaacgaatctggagccccaaggatgggaaaccaggataaactgggggtcaggagggaagggctcattgccaaggtgggtatggactggccttaaagattgctttggtcaggtggagaaagagtgtgatcagattggcacccactggactataagctccgggagagcagagaggtttgggttttgtgtgtggtcgtattcttgcttagatcagtgttgagtgcacagtaggcaaatacttgttgaatcggttggggtgaggagctaataagaaggtctgactttggctacaaaggtgtaggtggcaagctctgggcaaccttgactctgggctgggcagggaagttgcatctcctgcaggccaccctggggacctctcgtggctcaggtcatcctcccttgttttcactgcctcaggtgcccccaacactgccgagctcaagatctgccgagtgaaccgaaactctggcagctgcctcggtggggatgagatcttcctactgtgtgacaaggtgcagaaaggtatacatcaggaggcaggggtgggctcttgggagcaaggggtgaagctgagcagagaagtggagtgtcaggtaactggctttggatacttcctcctgtgcctcgggggcctcaggtgggccgaagggtgatgtatcagaagacaagcatcagaagttgagggggagaccatggagggttagacacactgacccacactgccaccgcatctcctgcagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacaggtacacagctggggtggcagcatcagggcagctgggctctgtgccgtgagagagaggccaagactgcatgtctggggctgtggttgagggccagaagctggagtcagagcttgggatccaagaaactggaatccatttcttgcctcatttaataataatgatacctcagacattgagctagtactacacatctgcccctattccaggcacttcactggattacctgattttaatctcatgacccttttgaagtaggagatagtgtccaacttgcctgggttcacgtggctagtaagtagcagagtctagcagagtcagcgttggaacccaggccatctggcttcaggatccttttgccacactggttgtcttgtcactaccatacagcccagccacattttggtcgaggtttgagtgtccacttggtaccagggcctgtgccaggtattgtgaatacaaaaaatgagtaagacatgctccctgcccttcagagtctcagtcacttgaggaagacaaatgtgcaaaacagatccttaagtcacggaatgacatgtgaaatggaggtgtgcgcagagaagcacgggggcacagtggcctccggggagctggagacagctgcatggagaaggtggcattgaagctggagaaagacacagaagtgtgttctccaggcaggtggcccagcacctggaagggaaggggtgttggcaactgcacggcctattcagggccaccttcgtggtttgagctgatgttgggcagtgagcaggctcagagattggagggcctggttaagctgaaggcctctaagcagagaggtgacaggagcagatttggaagttgactcaggaggccacgtgtagaagatcagagacagacagactcaaagcagggaggccattctggaaatgttgctgtagtccaggaagagaagatgcggcacaaaccttacagaaggaatagcagagcaagatcacatctccaccactgtcctcagttacccttcagccctgcagccgttttgcgtcttacagaccaagctcagtctcacctcaggacctgtgtctagctgttgcctctgcttggaatgcccaaggttttaatgcaagtggctcatgccagtccttccctgacctctaaattagcccttccctctacatttagactgtcctgacctcacttccagtattgttacatcaccatatcgtccctggaccaccgtcacttgagattttctggtttggttttgtttgtttgtttgagacagagtctcactcttgtcgcccaggctggagtgcagtggtgcaatctcggctcactgcaacctccacctcccgggttcaagtgattctccctgcctcagcctcccgagtagctgggactacaggcgcccgccaccacatccggctaattttttgtatttttagtagagacggggttttcaccatgttggccagggtggtctcgatctcttgacctcgtgatccacccgcctcgacctcccaaagtgctgggattacaggcgtgagccaccacgcctggccgagattttctggtttgtatatatgattgtgtccctctcactttttcactaggatgccaactttttgggagcagacaccttgtgtgcatactcacggccacatccccagtgtctagaagggaggctggcacatagtaggtgcttgataaatatatgtcaagttactggcggggagtgagagaaaagaagataatcattccaaggtttctagctttggtgacagggcagatggcggatggtcagggaatgcaggagaaagaacctagtttttgagggatgatgaggttgtctttgaattgatggaattgaagtgctttggagctactgaaataccactgtaattagaaagacagttctgaaagctctgactaaaatatgaaaccattagagataagaataagagtctctgctgaagtcttaaggcagttgtgcctcagctgccccagagtgccaagaaattctcgccaggcctgggtggaggctgacaatgagccaggatgtgagcagtgcaggaaggtgtgagctggaggctggggccccccaggtctcctctttgcccagagcatggcccctgtactcggcctcaccatgtggtcttagaggggcagattcagccaacagaggcctccaaaagctgtgggattctcagaactgctgagtgtcacacatcccttctcattggcagagaaggttgggagaatgggtcttgggaaagcctggctcctccccttcctcctgagggacctttgagagcgtcggggacccacctgaggagagcaagtcccacttctcccccttactttcccagacgatcgtcaccggattgaggagaaacgtaaaaggacatatgagaccttcaagagcatcatgaagaagagtcctttcagcggtgagatggggactgggaaagccagagaggaaggcagcgggcagggaggggacaccctggggctgagaactgacctagcccttgccctacaggacccaccgacccccggcctccacctcgacgcattgctgtgccttcccgcagctcagcttctgtccccaagccaggtaaggatttccttttgtcccactggaacgacaggttcagctctgttcagctgaggagcagtggagatgaagactcctgggccccattacagacctactgaatcagaggctttgaaaggatggcgcaggaaccagcgacttcctgggatgctaatgcacactgaagcctgggaaccaccgtgccacttaaattctatattgggtatcttgggaatcagaagttaaaaatgcagaatctctgctctcatctctcacttgaattgggggaacaaaaatcacctctaaattagcaagatgtgtgtgcctgtgcgaggctcaaaaactgacaagctctgcacttcaggccgctgctcacttggtgctccatgggctcattgcctctcaggacttagtttttcagctgtaaactgaggagtccagcttatctctccaagtgtcccttcctctaaaaggctggaagagtttcgtgggcttgagtagtcagggaggactccaaggtggaggtgtggctagaactggaccctacaggctgggtcagatggggtaagaggaaggagatagggtgttggcagtgactccctagagagggattgagcctgagcaccatgaagaggggctggggtacagaggacggggtggatctctagggctttctctgacccctgcctctctgtctctctcctccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctg

SEQ ID NO: 37343 - DNA, 101893 bp, Homo sapiens
cacaactcgcggctctagggaaggccacagacctcagctgtacgagcggaacctggactagaggaactttcctcaggactcagggcacacagcccctcggccactactgtctgcgagcccgaggcgcaggggagcgccagcggctgcaggtacgctgcgcacccgcactggggcctgggcggtgcagcggcggcgggagggtcctgggaaccgcagccgccgaggccagtgtgtgagccggccggccgcggcaagccgcatcccccggccgcccctcgcagccccttgctccccggcagccgccgccgccctcaggcagcccagccgggcgctcgcgccaggacttccccgccgcccgcctcggcccggaacatggctgcgcgccctgctgccaccctcgcctggtcgctactgctcctctcctcagccctgctccgcgaaggctgccgagcgcgcttcgtcgccgagcgggactcggaggacgacggagaggagccggtggttttcccggagtcgcccctgcagagccccacggtgctcgtggcggtcctcgcccgcaacgcggcgcacacgctgccgcacttcctcggctgcctggagcggctggactaccccaagagcaggatggccatctggtgagcgcgcacgggccccgggccgccgcggcgggacgcgggggcggcctgcccagcgcggacagcgcccggagcagcagctgcagggcgagggagccgctggaggggcgggggggcacgcggaaaatctggcgcacacaccccctcgctgcccgcgccggtggctggcggatcgggcggtcaggctgcggagggacgcgcgggtcagtgtgcgcagagggtgctgatggggagaaccggaccgctggagctctggagggtagcctgcgaattggggctttgtcccacaaggggcatgggggacacccctcaaggggactttcagttccctcgcttttaactctcgaggtttcctctttccccacctcatactgctagccctgacgtgaggggatagggtgcctgtcgccgtattcccatgtagatacgacagatggaacgtaactgcggttggccaggggctccgcagtggctggggcgccgcagtgcgctgctctgactttccggtgccgggctcctgctccaggctggaaatgtgctcctagctctcctagggggacctggacctaggggtggagattgggcggagcccgcggagtgtgcccaaccatggcaccaccgtgggcctggtctcctgcgagcgctccgggctgtccctgccggtgcatcggggttccacgtcccggggagagacgaagatgccctgggaaagataaacagccaagttttgtccccggaggaaagaagcttggacctggtccctgtgtctgctgcggggagggccaggggataagtgcgggtgcctgcccgccccaccttgtagaacttggtcgtctcgcaccttttataaacgcgaggatccgagggcgagaagttagttggtggccaggttagccgctgagtgggttgtggaggacaaggaggtggatgctggccaggggagatgtgctgtcaggtaggtactcggacaagaagactctggccccctgaggaagacagagcccaggtcactctggagcaatttctgtcttgtgttgataaagggagctgttctcaggcgagacacatccttaaagcagcggttgggcaaagagaggaagaggagtaaaagcagcagctagaattggcagcctcagagtacctggtgggagaggtgcaaaggtgcgaaagcaaacatgtgatatagtacagctctgtgctgtacactgctttactatataccctgccatacgtgaccgcctggcggagaagggcatattatgtggaaagagagcactgggacagccaggctttaaaccagaaggaaggatttttttttaaccacttcggtaccaaaagaaattcacacatatcagttaccttagttgttgtgttttttttaagagatattttaaaatatggttttgatctttatgcatgatttagttttttaaaacgttacagtatttaccataagaagttggtgagtggtgaagcaggtgtcaggcacatgctttgctacctgatttagagacattacctctttttatcatacagtaaacttttaagaggatgctatgatgtttattttgcaaagaaagagacagacttgcatcagttcagtaagtcacttaaagtgacagaattaataaatggtgaaactggaatttgaacccaaggccaccctaaaaaggcaggaaacatgatataaacaaaatttacataagcctataatctacaaattaggagacttgagttgtttattactagtttgatatgtgatttggggctggttgcttgggatccataggcatcagttgcctcatcaataaaacgagggagttggaataaatgatttcaaaaattctttatggctcttgaattccatagattttgcaatataattaggatcaaccagcatcaatgtacatcctaagttccctgtaagttccagatggtatggacactggtgtcttacttagatgagagaattccagttctgcatagacctttgaaatctgttgtcttttatgtccagcattggcaggttaagcaagaagtgcaaggccatgcttgcgtcagtcattgaagactcttctttgaaaaattttggttctgtctttaaaacattgtgtaattctttaggtaacaataatacaaatcccagtttctaaatagttcttttcagctcacaaaggagctgtaaagaacctttggaaataacttccatgcactgttaactcatttgattcttactgccattctgtgaagaaataaaattatctctatttcccagaagaagaaatgtgtttaaagtgattgacttactcaaaattacatttatttataaattccacacataataataagagctcgtggttcttctaagaacttcacattcattttctggtttaagcttcaaaatgaccctatcagatatgcactgttattataccactttacaggtgagagaactgaggtacagagaggctgtacaagcatattcttctaatgcattttttaaaataagaaccagccagatcagggctgaaaaaaagtgtatttagatatgtgtgtttttttacagataaatatgattcattttactgggcagtgtaaggtgatctgaatggcttttaaagggtttggggaagaaccaaatgatttataaatcagattggggcagttgtatggatatggatgtcttcttgatgagtggacacttagtttgaactcagttttgaaggaagagtaaaaatcaactaaaacctgggaaagaaggatggctctagaaaaagggatcagcaaggcaaaaaacaagcaaaaaaaaaaaaaaagataatagggcatcaaccagagttttctctcagggagttcaagtgggtggcaggtctaatgactgcaagtctccaaacagattgtattgtaccatagaatctctttggaagtgctgacttctggtctggccctaggggaatatttggctgggaagcttatgagatataacactctgatgggaggtggtacctcagtttaggatgttacagatttgaggtgcttctaccgattgcttgcctctagtttctcattcccaagctctatgcaacattccaagatgccaaactgattagtatccattctgcaaagccagcacatgctgatgtcaaaaatggctgtgagctacccagaactttgtaaaatagaaccgcagtgaatacagagccacacagaattcagcttcctctgaatctgaccacaataactcactctgtgcagactcactcttctcattcatccactcacaggctagaggagcatctgatttctgtcccagatgggtcagtgagagacctggcttattgatcacattcagactcccctgttatgtgataatttttctcactttaagttctggaccagatctgcactgcacatacagatgaaatgagtatcatcaaattgacctggaagatactgttgttgaagaatgtctgcagttatctcagtcagcatcaagtttattcagattagtctgaacaaaggaaaatttatattttagagatactttgtataagcaaaaaggaaagctttttacatttacctgtctgatctcaaaatccaccaagctaattgttttccttcaaatatcacaatcctgtgataaggacctaaggaagatatctatttcatgtgtcctaaaacctgcactaagttttagggaattgggaatatgctgagatgaagggaactgtgaggcattgtgacaagtggtagtgtacttcagtgggttctccttaattcagtggaaccatgagcaagtagccttagcaacagagggaaggctgacctcatcctccttaaacctatgattagggagagtggggccaagtaccatgacagtgaaaaccgaagcatggcgcagggaaaaacatttgccccaaatgaaacattaagtttttcttttggagagcctgctgttgcttgtgggaagacagttgggattcacagagtctgtgcaggcacaaggcagtaactgctatgtaattacagaaagatttgggcattttgtttggcagagttttgaaaagtaacatactaaattgggaaccgctttatggatttttaaataaagagaggagcttctgttgacataaacataaacagtgatgagctgggggatggtcctaacattttgcatactactttatttctgcattgtttggggattatcttgaatttatctccacattttaatgtccaatcagtagcattttcataattgtttaactagaaatactaatatactttgtgtttataaactgttccaaactagtatcagtgacatttttcagcaccagtggtaagaatgatgtcatattttatcattacactcttgatattaaatgttgtatgttatccctacagatagaagtttcggtttatggctgaaaaagcagatgatgccttaggccccttctgtctgttagtctgttttcctcacctttttcctcctttcctcattttcccaatctggtagtttagcgtggagggcatcaaccagagttggaggaagaaatatacaagcttagggtcagatagactagagcataaatcttctgtgtgattgtgggcacatcagtaaacctctaagacatagctgccttatcttcaaataactaatagtaacacctgtctcaaagagttattgttacaagtaaatgatataaggtatgcacagtgtcttttacataaatgctactaacaatgatagttgctatttcttttgaatcttttcctttttctcctatctcctttacctttacctttcaaaatcaagattttaaaaaatcttcaaatggaaatttgtttagtttcttctttccaacaacaacaaaaaatattagtataggaaactaacatttatctggatgcagtggctcatgcctgtaatcctagcactttggggggccgaggtgggcagatttcttaagccaaggagttcaagaccagcctgggcaacatggtgaaactccatctctacaagaaatgtaaaaatcatccaggcacgatggcatgcacctatagtcccagctacttgggagactgtgggtggattgcttgaacctaggaggtggaggttgcagcaagccgagattgagccactgtgcttcttcctgggcaacacagcgagaccctgtctcaaaagaaaagaaaaaggaaaaggtaagggaagggaaaaataaagaactaaggaaggaaggaaggaaggaaggaaggaaggaaggaaggaaggaaggatacattcatggaggcactgttctagacactttggtatcaaaactgatttactccagacaacaaccctaggtgggagatgccattacattctactctatcactttacacagaaggaaaccgaggcacagagaatataaataacttgcctgaggtcactaggctaatgcatggtggagccaggatgtgacccaggcagctaatgttgcagaccgagtacagatggtctgcttaagattgtgaaaagaccaattagttctagtttttgcttctgtcggttgacccaacttgggaagataagaacgctagtgtttctttcaaataagaattgtcatttccacttgaatgatgcaagggtcttagtggttctcttccgctgtcttgataatttcatcacttagttcaggcactttttagtgaactctaatctgttttggtatatttcatagggacagattatgactaaaatgtgggttgtacataaatatgcaggtcacttgctgtgatcatagctacataacagtagaaagaaatttctcaagtattattagtggcaaatgattaaggtggcactaatcatacacgtattggctacattttcagttcatattggtaaaatagagattccatttttcaggctttttaatcagtagtcttagatttggttgtcccctaaattcagcttcattccaaatgattgaagaaattatcaatcctccctgcaacctccaatttcaaaatatgattggagctcagaatatttcctctgggtaaaaactgaagtgactaataaatgacaccaatcctgttgttccagttatgacagcttaactacagaattagtaagaatgcctaagttgccctggttttattatattgagttccatgatgaggcatctaaagcacagggcagttaagagattcccatggtgattatggaatgagataactgatttctagatttttaatcctgtgtagctgttttaatgctgattattttataatgaatatccttcttggtttaaaggagcatggggagtattttaagcagagtttggttttctcagatctgtttttagctcctttatccaagtgattaggccagggagtttctttgtgactccaaatacataagcatgtgcttcttaggttccttttgcttgtctgtttctggtggtcataggaatgaacaatgaatgccttgtaactgagaaggctgctggttgtctcttggttctttttccaacacttaaacgtgcacttgggtcatattgctgtgtggcaccgtctccaagtctatggcacagtatagtaggaccattataaggcttatataggactatagtaggacaataataaggcttgtttctgcatatttcttgacatagcataacaacatacagtaaagtctgaaagaaaatcattagcctatggtatggccactacacctattccccagttaccatatcatgaagaacttttaccatatgtgtttaaattatagctattattcatcaggaattacaaaacgtatgtattctatgttttgacatttttatttcaaaagagtgacttgttcatttaattgcatttaattgatatgttgttagcatatcaaaaattgttagtttttaaaaatttgaatcccttagggtctttatggatttttaatagtacttcagttattttaagaatttgctcttctgacttttttaaatgggaaagtaataaaaaaagtatgattgggaatatcacaaaaagtaaatctcccatctactctataccacctgccagtgaccaatattaacactttctttcatatttttctagaaactttctatacatatacatatatccttttcattttaacccaaatatgagtgttttacatatccagttctggataagtgtgatattttaaaatccatctctctatcccatgttctttaaacactgccagcctatctacagccatgccctgggtggcacaataaaagccagcttcatataacacctgttccaggcaggtactctgaaggcctctctgataacacccgtcctgctctcttgtccttgtctctctggcctctagaaggtctggccctaataaaaaaaactttttgatgaggtgtaatatttatccaaaagttcatatatcataaatgtataacttggtaacttttcacagacaaaacatgccatgtaaccagcacctgaccttgccaggcctggattcatacacagcaactattgttggagctgagtagctgctgtcccctggattttgtccaggcagcccagtccccatcagacccacactgtgtgcacttgcagttagtccccgctgtctttctttgacttgacttgcctgacccatgttgacatttgggtggtgagctttgctcccacctcaggctgctgaaggaaccctaggacccaagcagtaactactttggggaaccagcaggcttggcaagctgccagcgagtgacctagtggtaaaaggatcaggattgtattacttttcccttagctctctactcctctggtaggaaagctgtgcattaatgttcataaaaataaaaatctcattataggtaataattgaaaagtcaggtagaatataaatagagtggctgtaattaatttgctggaactttctgtagttcagatccgtgaaaatgcagcatttgtggtaggtggcattagccaagtctcttgcatgaattaaacctcagatttggctgcagggcgtttcttttcctctctaggagcaccatacagaaatcctttcagagttagactttgaataatagctccatgacatcttgctagggctgactttgtaacgtgtttcacttaattgaagcaacaattattattttagttgtttgtcaaattcagcaagctaaggcctgtcccctgacttgttggtttaactgataagattttgttcctctgcaaacataatgcaaaataatctccttccctccagtgttttctgattaatgtttgaagacatcttagaagatatgtctttcagaaacacaaataataacataaataatgatcttagaatagtgatcttgggctgtatacccccaagagtatggtagaagatgagtctgggacaagctgctgagctgaagcattttcatgagtacctgatttcattcacacattggctttattggaatagttcattaccttccaggttgaatcacttcaagacctattgagggatacatcaggctgcagagaggaggttccttacatagagctttccccatttggactgccaagcccaaagtgcatacaattgctgccaagagggaagtaggactgtttctttccagtcccttttctttctgagagtgattgtatatgttttggagatggggagggcagtggtgaaggcaagtatctcattctcacaagagagagacataactctaagacaggagagtctgtggaggtacattgattggtgttctccctgaaagccatattaagtgagaaactgctgcattttagagtcttgggaaaggtagaattttctagagactaacagtagaacttaaattcttgggatagttgtgaaaagtgtggttgtagacatttggggccatagcattcccgacacggagtcccttgctggactaatagactgttttttagtttcttggttgccagccagccccataatcctgtctcagcaccacacaccacaatgattatggtttacacccgccaagatagtggaaagttgctgccaagtggaatcaggatttttcatgtcatcactgcaccattgaacagtaagcttatatgcagcttccacgccactgctttccttgtgctagaaacaggttgggcgggagagtattcagacagtcagaccatctcttgtgttgcaaatggattttgtggaattggcatgtaaggcttgaaacagccagcatacgaaaatattttagaaaagtacaagcctcttctctgcctttcctcaatcttgttagattttaataaaatttattgggtacgttggtttccattgtaagctttttatttagcaagacaaactatggatttctaaaacaatggatttttaaaatgttacatccttttatttattccaccatcactgattgtctatgtggataaatccaggtaatcatgttgaaattagtaattgaggtggcctaaaagtgacttgtccccattggtctagttcattgtccatgagtggacatggtccttaccattgttctgccaaccctttagtgtaaggctgctggattcaactagtgtttcccaaatacaggttcagaggccagttgcatcacaatacctggagcatttgttagatacatggatttctggggcccatttcagtcacattcatcagatggtccacagcggggtcctaggaattggtgtgttaagcatgtacataagtgatttggatgcacttcttcttggtttgggaactgcagaagatgagctcctagaaggctatgtatgcacttaaagtacagatcatgggattttcagagtttggaaagttggcatactctggaatattctaaacttcagattccagatgcttaagccatcaaaaagaccaaggggttttcttattaagagaagtagtaatgtacaggattacataggagaaacccagccaggcatgcatcatttgtgtttttttgttattattattaagtcaagcacatatgttccatctccatctaatagtgactatttttttaaaaagattttttaaaagacaatgccccaaatgttttacccactgtatgaagctccttgcactggggctcagtataaaacgacactccctcacattctttcttcagtgtatcttacacaatgagttcattaagcctttagtattgcagaagaaaaaatacctactaatgaacatcttagagtacagggaaatcaaaccagtgcatttctttaaactaagtagaattcatttgagccacttcagtccttatataccctaatcttggtttctttgtttcttgtatttaattttcttagatttttcccgttggcataccattaaaaattcctcccctcatttgtgacaaatgtaaacagtctactaaattagcctgtttttagtagctggcagttcagccttaattacatgatattacaaagtccctaaccctggtgtcttcactagctatgaactcaaaatatggctttttagaaattcacacagttctgttctgctatacagaggattgttctgagtttgttgctgctgcacaacaaatattttttaagaagttgatatagcagcattattataactgcatgtacagcagcctcctgtggggaagattgcaactcagttgttaagtcttatatggttccataccctattttcttgtgctcttttggtgacagggcaaaaattctacaataaagttcttaagtttatgcatccactttatttttgtatcttttatccttctcaaaaatgtgaactgcataccacagcttagcacatcccaccaagaaaataacaatcacctggagatgaagtgaggctggtggcagtggggtctccaggacagtttcctctagccaaaagcagcgtctttcatttttccctagtgtgcaaatacgctatctgtgttgtcctgtgaaaggtcttggaagcattgctcatgctaggctgctttgagcaagtcacttagtttctcctgtaacataagggaaatgtgctaaaattgtgcttttcaaatgcagccacttattggaatcatttgatgatccagggcaattgacgtattttgaaaacttcccaaagggtggtaatatgcagtcttgcttaaaaatctctagatgagatgttctctgagtcctttcctgacctaacactttcctcttcatggggataaccatatctgaagaatgttcacataactgcataatcgatgcttcctggaccctcagcccaactttagatctctgggggatggctttaaaaaatccttttctaggaagctcgtggtattttatcctgttttatactgtgcgaaaggtgtttgctaagagtgttgtctccttgggaaggcacgtgcttgatgatgactgaactcccaaggaaagtggcaacatgagagctagccttgcaatggcatatattagaccttcttatgaaggagctgtgtgcaccaggtagagaagcagcagctgcccaggaggtccttcctttggcacacagatggttgcctcttgactaagggagctgcatatatcaagacttctgagcacatctagccaggctctggccagctcaggattccttcctacagtatgtgttttggtgtgttgcccagctttgcttttaggtttcctatttcatactggtctagggcctctaatcctctctgggtattgaatttctgatgttacttctgatggctttggagattagcttcttttgtttccagatttgcataaacagtgctgcctttgtcccctggtcttgacccagcttcaaagctttgacgggcatcaaagacacactggatcctcatttcttaggcatcagatggcagcaatgccagcaggtgactgaaggttatagccccacttttgggccagttttctgtctctcagtcagaaaagattaggttacattctgccaagtcctctgacaatggttctgaatcttaacagctttcataacgcctgtgcgaataccattgaactaaaggggaactgctggtgtttgtctaaagtggaaagggcagtaactccctaatatttgctgaactctccttgccctatgagaggcagattattaagtgtccctctggaaagcatggaacctccaagcccattggccagactttgctactgataatcttcttgtgaggcccaagacctcattttcccatgcatcttatcaaaataacagcagtagtagaactatcagttgtctatgcatggattgtcagtatgttggatatgtagaagccagttttgataacaggtcagcttggtccaatcatccaacaaacccttgagctgtatctctgtctctgtgttgcctgatacttgtatgtttagagaacggagcctaatttttatctctgctcagaaaaaaaaaaaaaaaaaagctgaggctgggtgtggtggctcacgcctgtaaacccagaactttgggaggccaaggcaggcagaacaccaaggtcaagagtttgagaccaatctgaccaacatggtgaaaccccatctctactaaaatacaaaaattagccgggtgtggtgatgggcacctgtaatctcagctactcgggaggctgaggcaggagaatcacttgaacccaggagatgaaggttgcagtgagccgagatcatgccactgcactccagcctgggcgacagagtaacactctgtcaaaaaaaaaaaagaaaaagaaaaagaaaaaagctgaaaggtattcagcaacattccatacagagcattccagtaccagtaatatctgatttcttaactgctcttttgcattgtctatgtcatgtaccactgtattttcaaattttcttgaattctttgccttgccttgccctcctacctgtacaatgagggttgcataggctaatctttcaagacttttctagccaccacatgctatgtatttgaagttccaccactaatgccatgaaaaatgaaacaactcacgctattgccacattatttaagatggcattttgagcttttttcctttatttttacttagatttgacttcttctgtagttttgacttatccatgtctcaaatccttggtgattagactgatgattcatatctatataaaaattgtaaaaacttatttgccctctaacctgagtgaaaatgctatcttttttcatgaacaacagaagcaaaaaaaggctgtgatgagaagaaaaaaagcccagagaattatgtcagaactatgtcagaggagatagttccaggtctgaaaactaggaaatctattgctgttgactccactaggagtggaatatttgcagcataagtgtacgtgttgcaggtatttggttagatttaattttatcatatatgcaaaataagtaagtgcaagtcttccctagaatgcttccggcaccgccccccccccccacctcacgcacttttggaaaaagcaaaaacagcagtttgacatttgccattgtgatgggaaacgatatgtgtgtttgttatttgcaaaagttactggtgttttttgctcagtctgctgtgtaaggaaagcagcctgcatttgcactttggaggttagaagaacctgccagttggaattcaagtctcaccaagctagtggattatcacactgaagtgatagctcctcctatggaaaggctttacttcacagtagtgtcattatatagaaatactaaacattggcaatgccttcagaggccaaaagcatgagtgccatgaaaggtccttgtaacatgaagctggttggggctacctccctccttgctgacactttaggagcaaaacaaaagtcaaaggaagtagagatatgggagactgaaaatcacttgtctcctgagtttgagtttatatgctacagaaaagtcaaaatcaagaaggcaaaaactttctttttcaaggagtcttccccttagtaactctttgacttacactaggggtttagtttctaaaatcaaacgcttccctttccaagctataactaataaataaaaaagcacatccttctgctagatcagaattatctcgagaaaatactgctctttggctgactccctcatccctctccagtcttggctattcagctgatactctccagctgtaggccagctgccttgtttccctgaaatgtggtgccagctgttttgagtttcttaaggaaggtttctcttgggtgcattggtaacactagggctcaagcatgaaagcataaaatgccctaatgagttttcactttgatatcatagtcaatgtgatttaatggactgagggtgaaacgatttctgccctgaggcaaaacagattttgaagcttttctctctcttctttgtaatagagtatctgagatttagtgttgcttcccctaagctatatatcagttgtcaagtattagataacaaattgcctttgtgttctatagctttgagccagaaagcaacagtttcccttattattttgatgtcaaaggagcagaagaaccatactctgtgttttaccttctgaaataatttctcctgaattgattttttggagtgaatttagagttctcatttttatttaaatttcactcctacttgtactaacatcgtttgtttggctccattttctcccttctaattattttctttctgtgtttccaaacaggcatttttctaggtaaatcttaaggcttctcacattggggatcaagtttccaacacatgaactttggaggacacattcaagccagaggagtcactaaaaagaaattaatactttcttcaggctccttagttaatttattgatggattgatctatttatttattcacgtaattagttttagtcattgtagtagaaattcaactgtcttatctgaaataattgggagaaggtgttcttcctttcaccttgtacagaatgattatgacttaaaaaatccagacagataactcttgtcttcagcaactttacaaatatatttgccttccttagtttttgagccctaagacgataagggttacacatggctacagcctgccccaagtttactctggctgccagaataatacagtatcctttccagacccctgaacaatcaactgttaacaagtgagatcatttttggtagaagaattgcatatgtcattgtctcaaaagagacatgggctgcaaatcctgtctggggacttgcttccaaatacttgttcaaactcctcccagctttgtctgcacttggcattaatcccactttgacattcaaagagcttgagtgctgcacattctcaactaaatagatagtaaaacaaaaccagtaacttgttattaaatacatagtgaagggggcagtagtcattttattattcttttcatttattctgtcactgtcttagtctgttttgtgctgctataatagaataccacagactgggtaataatttataatgaacagaattcactggctcatggttctggaggctgggagtccaaaattgaggggctggcatctggcgacggcctttttgctacatcattctatggtggtagggcaagaaagggtgagagagaacaagagaggccaaacttgtccttttataaggaactcgctctcatgataacaaaccccctcattcaataacaatagtagtccactcatgagggcagagctcaagtcccacttacctcttgaatgtcccacctcccaacgttaccacattggggatcaagtttccaacacatgaactttgggggacacattcaaaccatataagtcactaaaaagaaattcatactttcttcaaatgtcttagaaaagtagaaagctttaatgagttttttcaagtcctttaaatgttgaagtagtgtataaaaatacaaggttttggaacctcaaaggcttgctttttaaaaacagtgaactgtaacagcaccaacctctcccgatggacccagtgatccttgcctcctggtattcactcctatagtctcgtgccatgctgaatcatgtgacttgacaggataggcagaagtgagatcctgtgacttctcaggccagattataaacggcacttcagtttctgctatggattgcttgctctggggaatgccagcccccatgccatgagaacatccaaacagtcccaagcagaggcccacatagagagaaactaaggcttgcaaccaacagccagcactgcatctaagtacaacctcatgagagactccaagcaagaatgtcataagggcttgacccatacaatctaagaacataataaatgttactgtttgagatgctggtggtacagatgtagaccctgctctcacagagtttatggtgcactgggaaagacagatgatacacaaataaatgaacaaaaaagatgatttcaaaagatgtgttaaggagaaagtaaaccagaataatggggtagagctctgataggagagtacgctgtatataatgtgttcagagaaaggctttttgagaaggtgctatttgagccccaaggcctgaatgatgagaaagagccatcttgtcaagatgttgaggaggggaggaatggagaaaggggaaaacaacaaagaaggtttgtatggctgagtctttttggacttaggtcagatttgccttcagaatagcatgcgattctttgagcttcttgagagaaatatggtcagttttcaatatcatcaacaacagtatatagtattttttcattttaattcttaccaatccatttaactatattattcaacatctaccagttagtggaatgaaatattatttgctctgttaactcttgtttattatattagcaaatctgctaccttaacatcctctgcatccttatttcacagtggaatattttcaactttttcttggctcttctgtcatcaatggcagtgtcattactaataggattcgggggcaggggcagtatatatgaaaaaatgctttatttgaaaataacaaaattagacaaaacataccacttagacaataaatgaagactttctacactgccatccaataagtctaaaaaccaggcgagtgctggacaccaatagatctgcatttatctcttttcttacttacagcacaggttaggagttttggaaggacctgctaaatttacagcatgcatcactgcgttttaggtgaattttttgctgttcccttatgcttctccttgtttctttaggcatggagcaaacatatgcagaaatatatagatcagtgttttggatcctgctctgcatcttcccacagaaatcatttgaatactgtccacttttgatgtttctgtttccttggttgacgtcacagcacatctcatcttgaataaaaagagcgcttctcagattggcactgggctaaacagagcaatttgttttgggtttgcttcagtttgtacttaagttctgagtctcaacaatggagtgttattcctctgaaaagctcttctatcatttttgattctttgaggctttgatttctgcatctcctaaaataggaatgaggccaccaaacataaaaatgtgtattaagaacaatctgctttagttgaatatttattttctatttaatctagttcatcagttaacataacagagaactttgtcaggcccaagtataggtaaagggtactcattactgatttaaaatgagaaaccccgtaaatcaatatttgagctatgtttcgtgcataaacccattagctctgtcctgaggaaaagtctcaatgcgtaattatttcaaaccagtgagctcatagctgtctgcttggcacagctcagcctggtttcttcatgaaaaatgagataactgccaggattttttctgtctcctacctgagccctcacaagtactgcttttcacctcagtggacttcgattccttaagtcaatggtatttattgtgcctcccatagagtacaaccaagaagtgagttgctattgagaagccaaaaatcggaatagaaagcaatgatttgtttctttttgaaaggagaggcacatttttagggaccatgagaaaggtcctcagccgttcaaattcaagtgttgaaactcaagatgtttgcaagtctaatctctaataaaacacgaattataatctggtttgctttaggcagatgtatggtcccatgatgaaccccatttgatttttaaaacgcttcccctccttccctgcatttggcatttttactgcttgctactggcaggaaatatttcttccttctcagtttattctgatccctgctgtctggagaatcttgcagcatactaatttatgactttgaaagattgtatattcatttatgtagaggcttctgtgtcaaatttgactctaaaatacctcatgctttctcacttagatattttgtgcagtattacctattacttaataaatatttagattttcaaggtaaaaaaagaatttgtatagtctgaaaaaagtttatagtgttcctagattttattagcaatgaaaaaatttcctatgaataaaattattgttaagatttgttttccattttgtttactttgcttctgaagatgttttgaaaccttgatttctgggaatggaattctttatgtgcttcctaggaaaggaaatataacacaccagttagaacaattaatactagaaaagaaacattcttcttcctcctaaaatactatagggcaacaaatcacctaccccaccccaaccccatttcaaatatagtgagatgggaagaggtggtattccatctgtacaagttaaatctctcagatataattttttttttctttttgaaacagggcctcactgtgctgcccaggctgaagtgcagtggcatgatcgtagcccactgcagcctcgagcttttggtcagatataatttttaaaaagtagttttgttgttttcaaatatatatagttatttagggtaataataaaataggaaattagctttaactaacatgacaattgtgtctgcttaatgtctttattgtttgttggtatatgaattattcttctaaccaatttgttatgtagtatcctgcaatttataacatcttttgcttaataatgaaagctaatatttattaaacatttactgtttaccaagcattatgataatggttcccatgaattaactcattccgagctcacaacagccctgtgaaacacatagtagtagtagtagcctcatctcactaaggggaaactgaagttcagacaaattaagatttttccggagtgccatgcttaggacaaaacagtgacctgcccaggcccagaagtggttaactgtgatgctaatgaagcttgcactttagtctgcctgctccaggggcccatcacaatgtattcacatttgttttggtaaaatctgtgaaaagaaatattttataagcaattggctaagaccacttagccaacttcccctctatcatacttcttgttttgggtggcactggagtggccctggacgtatctgtgatctggttgaggggaagttaacttggggatgcatttagtttgcagtcggtggaataatgcggcttatagttacttccatatgtaggttattactcttgtggttcacttgacacgtgggaaaggaccaaaggctctgccgtctggctggtatcaaaagtaattgagggccggaggagaaacaacaattgaaacttgtctcgggaaaatacttccaatcatcagacatgaaaaatttcaagtgaatgacttaattctctctatgccttgtcaaaacaaaactgccagaaacatacttgataatgaagtgaatacaatttaatataattataagtacatcagatgcatttcttttttgctataaaaatcacatgaattagaagatatcaggattgctgtgtttgaagagcacaaacttgtggcagtactatgaacagagagtatgtccaagtacataacattttatacattacagcaccttaggttagactgtgttctaacagatcaaatgcatgtagcctgacaaagtttggcggttccatttgaaatggcacataacactgtcatcaacacagtgaaatggcttgaaacttttctaaactgttagtaaaaccaagtttcaatcaactttggttgagggaagactaaattatattgcttttctttctatacaaaaagatatagatatttgctatatgaagaggttgagagtatataaacaacaatataaggaagtaaattaacagcaatatgtcaggcagttaactaataaaatatttttctgagttttgaatgcttgtggcattactcagcttttaaaaatattataatttcttttctcattttgaacaaatagttactttatatatttttatataaaaaattcacttttgaaatttaattttacattttgaattttgtatccttcttcttaaaatgggctcccccaggttatataagcttccagccccacaaaagctagattcaatcctgcctaggtctttagctttaaaacacagcacctgcctgctgccccacccaatgccacttgagtggtagaaatattccttttgaaaacttgtttttactttttattacctcacacaccagctgttcttttaaagttctatgttagtgctttctgaattaatgaagtttagccttaacactgaaatctcgctgctgataaaattagcatgcctaaatttgtagttatacatagtattttaacacccacatttatttcccacaataaaatgctttgcaaacattccatatggctgcttttgccgcattgacttagacaattcttagcatgagaagtcccactccagatttgctatataatttttactgaatctttggtgtaattcagtgaatgataaaaattttagtgactgataatttataatcaaagtgaaaaattctaaatcattttgactctgagataaatttaataactaagggttatagtgcatgaaaaactcattctgtcacattttattaactgtgtatggcctcagaaaccactatgtgtctataaataaagccacccatgacagtttgatgcctggagtaagaattcatttttataacatcacctttgacattttaacttcttcagcatattcactaaagctaatagtgactgtcaataaattacagtgaattagaatatctaatatttaatagtttgccacatctatggcatctacagctgggacttagggactccttatagtttcacgtagatagctttttactcaatttaccaaattctctacaccacaaggtgttctgtgaactccctggcttgtcatctggcactaaagcatcacctctccttcacatcagccccacagttccttctagagcatcttccctaactttcaacagaagaacatcatggcagagggccagggatctgttgcgtgggatctcagaacttagaatactccataggtacctacacagggagagtgagcacaacagtctacatttcaccaaattagaagatgtgcaaacatgcggagacattctttcatttattcattcactacagatatcaagaatgtctctaatggcgggaattggactctcagagtgagtaaaatactgcatttctccccttgggaagcccagcatcacaaaagaagcacagtgggttgaggaacaaggcactgttctgagagcctgggggcaatgagatgaggttggcaacgttggttagagcacctggtcatggtagccagacctaaaagcaacaggatagatgtgtatttaccttacattcacatagaatatccctctataacaaaccttcagctctcattctgccatgttccctacaatctgatctgatcttctttaagaccctcttgatactttacttgctaccaaagtttcctttggtcttcagttccttctagcgtggaccaattgcaaatatctgagattcccttcctctggcatctttttttttttacccactagaaaaagcccaatcccagatccatcctcctgcagtctctagttctgaggactgttcatcccccagccccatgtctgtgttaattttgtcacacagggtgaatccctccaccctcaagtgggccctcagctgcccactgatctttttgtttcccttgcaaagcttgctatttactcttctagatctacttacttcatcatttccatggacattttcagtagatcaccttgcttctgaattcatcaataaaactaaagctagtggatgaaaattatttcaattttgtgacctcttctactcctgttcttctggaagagagatttcatcctgtctaaagtaaacttctcatttttactctcaatctcatccttttccttgacccatcctcccagtagcctttgcctcatcttcttcccttgtttagaattaattcaacagatatttatttattacttgttgatattatacctcaggatacaacagagaatgaggcacagtgccagccttcaaggacttagagtcaaacttcttgagagaatggtcgacatttgccagtttagcattctcacttgcattcatttctcatctggtttccataatcaagtttccacactcaccactccactgaaagtttccttgccaagatcaccatttaatgagtaatccccctcattaaatccagtgtcactttgacttcactttctcttcagtcccctttctgctgcattcaatcatgtggaccagtttccttttttataacagtgccttcgctcagatccatggttccaccttcctaattttcttcttaccttgctgtcttccctttggcttactcatttctcaatacatgtttcttaaaagtggtgttcccctgggatctagatttggctttcttttcgttggaaaacctcacctcaagtagtctggtccgttcctgtagcttcagttaccaaatgtatgcctatgactcccaactctctattctctccctgatggtgtctctccagctcaagacctagagatctcctgacattttcatgtgaatggtccagagattcctctaacttatatctcagactgatctctccactttctcattccttttctcaaccagctctgtctcctatattcccaccgccatgcaagcatttgcccaaaacagaaacatggacctctcccccatcatccatatcaagttattaatcagtttttgtcagttgttcctacttaatcctctagatttttttcactttttcctatctgttctgccacttccttagttcaagtcaccgccatctcccatttcctaatggattgctctgcccctctgttttaccccccctcccaccaattcatccattatacacactggaagctacatgacctttctttaggtaaaacttggccatattactcccaaaccttcaaagacctttgagggtaaaatccgtataccttggaatggcatgcaaggcccttcaagatacaagggttctgccagtttctcccgccccgtccttccccattcttccctcatgctgcaatcatgttgaactgccttccacagggccacaactctctctggcctctggacctttataaatgctcttttttagattcagactacctctccacaccacttgcctattttttaaggtttgtaacagaccacaccttctttgagtagattcttgcaggtattgaaatctgggctgagacctattgtgtgctttaccgaatctcccacaatgctgttttgtttgtttgtttgttttgagatggagtctgactctgtcgcccaggctggagtgcagtggcacagtcttggctcgctgcaatctctgtctaccaggttcaagtaattctcctgcgtcagcctcctgagtagctgggattacagtcgtgcaccaccacacccagctaatttttgtatttttagtacagatgaggtttcaccatggtggccaagctggtcttgaactcctgacctcaaatgatccacccgccttggcctcccaaagtgctgagattacaggcgtgagccaccgcacctggcctcccttaacactcttataactattcttaattatgtttacttttttggatctgccccctaggctcagcttcttgagggcccgccctcttctttttgaatctccaggttctagcactgaggtgccttataggaagctgctcggtaaatatttgggaaaaggtaaacaagttattgtaatagattttcacatcaatagccactttatttatttgcattttatgataaaactgagatcctcaaagacaactgattgtttcctcctccaagttcctcaatggcctatctggttacaaagttaggatcaaaacagagatcacatgcttttctcaagaaccagaaaaattgggattctcttctgtgggaaccattttcttattttgcttttttgatgataggaatagactgcctttgaaatgcacagtgaggatgaattttatgtttattagaatttccatgtacacactgaaaatgtacagtttcttgattatactgctaagttcagtaaaaacaaaggttcattgtttccaagagtcatccatacttattatgaaaatagattcaatcttttttctctctcttttaagaaaaagaatttggaaatgtgatccagcatcatgttttcattttgtttaaaagaaaacatatttttcctctaataatcctagatgctgtgggaataacacacacatggttggctttagatttggtgactatcaaaatctctgaataaatagtttcttttctgtgtttgtattactaatacaatattttacagtgtttttaaatacttagagagacatttgcacaaaaaggcttataagattagtggatttgaaaaatcatttttactcatcatcctaaagaaggaggcagcagaaatgcagggttgtggaccatgatggtctagatgcatgagagattgtgggaaaactctattctcttttatttgatatcctatttttctttattcttttttggggaaaaggagaaatgtcatcctcaacaggcatgagaaaggacaaagaaaaatcattccttttctgcccttttccttcccttattttcttatagttttcttggagattacacaattatgaattataataaaatattctatggtaaaagccagtgcgagtgcagagaatgtgtaagattttcatttccagccaaaccctgctggtcagttacatttattattggtttatgtcacagtctgggaacatattaaccaactgcccagattgacacccacttacacctcacatgtaggttttacatatagggtttacaccatctaaaagtaggcagccgagagagctgcctactgactataactacgcaatgacattgagagcaaaggaagagtttgagatggtgaccccttgaattactaagagaatgctccctgaccacacgtttaaatagtgaagaagcataacagccgattggaacaaggaagccgggtttgcacctactgtctggctccttaaatcagagtagtgaggatggaggttgtctgggtttcctatgtagcagatggcagtaaacaaggaaaaggttttcagcagacagattggaaggtaactggaggttggaattactctggagtgagttggaaagaaaaaggaggttgtgcatagtaatctctctctggataatttatctttcccagttaagttgtcagacaactatgttggagaatggccctgaaatgaaagctttactggtcccaattccagctttcattaaatcggctcccaaagcaaaccacggggctggcacctgcgagctagcattcactttacagctgtgaacagtgtcttaacgtgcttgactctaggtagggaaatgtactaaggagaaagaggaaatgtggattttattctgacaaggctttgaattgtttcttgaaaaagctgaaatagcccttggatctccattagcctctttggtagattgctgccactggtaattatatgtcaagtaatggcctcctccccattcagagtccctcactgagccacagcatgatgccactgagaattaaaaacaggccttcctccccactggcctgttgtatttgcttcctctggctggagggcactattggcttcctactctatggctgtcatccatctcccaggagccgatgatcctttatttcagcagcccaaaatctggacaggagattccattgatgccgttgtgaaaggtggccagtacttttggagcaaaggctgactgagttcaaagaaaccttgaagttctttcccccagatgttgatcaaaagcagggtatttggtggccctcagtttggatctgtagttactctgtcatatttcctttctgtcctcacagtagccactgttctttggtcatggttctaggagattgtccttcactcaggcctgtgtacctcattctttgagaggacagaagggaagactggtaggaggaaaggtggggaaaaaaatctcatcatttctagaaaacatattatttgcctctaaatcaccatgatgtctttggagttcagttagctccttgcccctctgtgcctttcaagatttggagacatttgatgattccatagcgaagctctcccaggctgccagactctttagtgaggagacacagttggtaaatacctgtagacacagttggtaaaacctgtagcagagatcctaaactaggtgcctgtgggccagattgaacctgctctttttaaattgccaatatttaaggatttcctataaaaatctggatttctgccttctctttaagaattggaaactttggtattactgggcctgaatttctaaatggcagaataatggccataccttgagtcggggtatgtagtctctcaaccacattattcacctgcatgactggctggtccctgtagatttttaggtgaaaaaatctagaccccagagccatgctggaaacctctctgtatccagtggaagattttgcaggatcctcccccttgatgaagtgacagcaactggcaactccattggtacctccaggaatctacagcatggacatagtcataactgatgagtgtatggaaactggacttttctttgggatgttcagtgctttcgtgttacttagctctctacactgggcagagccttggcatgagatctgtgatgcctacagaacacaagcaaaagtagaataaatagaaattatgaccaagaggcaggaagagaagtcagatttttaaaataccataataattgcaaattttaaatttaaacaaaaatattttgtcttaactctctctgtctccattaacttcttggaccattactaccaggttctgggcattcagtgatttggaaaaaagtggtattgtcttctgtcaacaatatgaatataatccccaagatgatctactcataattctctgtttaaaatctgaaagaatcataaaaactgttattttgaggtttagaggaagtaagggggattcatatggagaataagacaagaaaaaacagaggataaaataagtagacataatctgaagagctgccatttacaatctagatttaggagctttctggcataattgaccaaatataatacatactgagaaagggacaaggtaagaatcatgcatctattaattgtacttatacctcacccttttccaaaaaggattgaaggaaattatgttgattacgaaaatgtcaatctcttaataaaatgcaatttcaggatgttgaaacagaaggaaaattttgttgttcttaattcacatttaacaaatcatgtttaatgctgacaactgcctctctgatcttgactttgttcaggttcatttctcaggatgtggagattaatgtgtcagaactcatagcactgaagtttgcaggcttatttgtctatacttcttgtctattagatcttattttttactttaagaacagagttctctttaattgtactacaaccttacaaataagtatacacagaagactttcatgtgaattatctattgttttactttttattttgaaataatttcaaacattacagaaaagttgcaagaataacacaaaggtctctcatataccaacattttgttatatttgctctatcattctctctatatgagtgtttttatacatattattttttaattatttgagatagtttgcaaacctcatgcctctactaaaaatacttcagtgtatttttcctaggtataagaatattttcttttacatatctgtagttcagttatcatattcgggaagtttaaactgatgcaatgtattttttagagacaggatctaattctgttgcccaggctagagtacagtgacatgatcatagctcactgcagccttgaactctggggctcaagggatcctcctgccttagcctcccaagtaactgtgactacaagcatgcaccaccaagcctggctaatttaaagaaaacttgtggaggtggggttctcaatatgtgctcaggctggtctcaaacttctggcctcaaatgatcctcccgcctcaacctcccaaaatgttaggattacagggatgagccacaatgcccagatctgatacaatactttcatctacaatctacatgtcatcattttatgaattgttgtaatgtcatttatagaattttctttttaaaacaagatccagtctaaaatcatttatggcattaagtcattctgtctctttagtctcctttaatctgaattaatatttaatttcagcctttctctttgatactatcgatcttaaaaaaatacaggcctgtcatttataaaatattccactgcttctccaatgtttcctcatgattagcttttgtttatccatttggaatactgtataagtcacgtgtctttggtatcacatctgaaggttgacgtctgtttgcccctttctagtgatgttaattttgatcacttggttaatgtatttccaacttctctagtgtatagtagtattttccttttgagattaataagtaatttttcccattagacttttagttcttagttagcaggaagcattctgtgatcctagttcatgtccagtgccaagcgtgggccctggtaatggggggtgatgaatatttgtttaataaaatggatctgtttatgtattctactttaatagttctgagagatttttattgagaaagatgaggtaatgttggtagaggaaagattaaagaaaaacagtagggtagagctcttttcaaaatgtttgaggaacctgggataagcttgaggaccctgggggccatggccactgtgaaccaatttcacagagctccacaccaaatggaactgtggtcttggttcttggagcagctgcagtccccaggaaatgtgccctattctaactcttctctaaggaggaaggaacatattaggagggcaagacctacccacagattaaggtaaaatctacatgatttgttgcaagtattatgtatcgtttgaaaattacttcagtttccattattgtaaaatactctcatattttaaaatatgatatttaatcaagtctgatataccatgattttatgtattgtagaaaaagaaaggaaagccgcaagttaaactatggcataattatttcttatcacttagaatttttatcttatgcttatcaaaatatctcttttagagttgttgagacatagatgtttatctcttgtgaacacatacaataataaaagaaataaagggattgagatttgccgaaaacttcacaggcagagtccaactctccagaatcacctttttcccaagagtcatagaggtctgtgctttgcacatggtgttattccctgtgccttcatgagcttggggttgcagcattgcattgtgctctgcttttgtttctaggattttcttctaagccactgacacccatactgcacattttaatgctgcctctgctttgatcttaccaggatgtgttagcaaccatggctaacactgcttcctcaaatggtccctaagagctttttgactgaaatcttgagggatagtagttgttcaatggtaaaactagaatgaacaaccaagttcactcatcacagataactaagtggcatctactgactggtctaaagtgattggcagatgccaggtattgcaaagtgccagtgaattcagagatgttaagatagaggagggaaaatacgttattagaatcagtgaggtacaacttgtatatgggttgtttaaaagtaattagcaatgttaaaacaatgatattatgcagggttggtgaagatgtggaatcaggcctgggtattcctagtactataagttattacttttctgaagggtagtttaatataaataaatagcctcagttatgttagtatcctttgccctcataatctttttattattattattattattattttatttttattgttttttgagatggagtttcgctcttgttgcccaggctggagtgcaatggcatgatctcggctcaccataacctctgcctcccaggttcaagcgattctcctgcctcagactcccaagtagctgggattacaggcatgcaccaccacgcccagctaattttgtatttttagtagagacgaggcttctccgtgttgatcaggcttgtcttcaactcccgacctcaggtgatccgcccacctcggcctcccaaagagctgggattacaggcctgagccaccgtgcccggcccatactctaatttttttagctctagtctaagaaaataaccagagttgcagttaaagatttatgaaccgaatattcaccatgcattatttataaaaatgaaaaattgggaacaagttaaatgttcaacatatgggagtggaatgaaagaatgttttcaagctttcttgaaattatatgaacaagtgctccctagagcatagaaaactgtacatatagtatgctcccaattttgtttaaccacatactagaagggagagagaaatatagcaggatggggaaagaaactggtatgaagatggtttctttccaataactctcctccaacagcaggggaagagcttttttcttccttagatacctaaaacccttcccaagtttctatgatagcaaacagattaaaatttgccaccgggtcctgttgactttctctgacattctcatccatccaataacttgcactttctgtcttgtgttggggttcaggcaccactggcctcatctgtgaactcatgagacaggcccagtggaggagaggtctcatgattcgcaccagggctgaggtgtctcctggggaataagtcgagttctatcagcactcaggggccagctctgcagagatatgactggtgacttggtggagtgaggacggagaggcagagtgtggatgggctgtgcagagtgctgagaaagcttgcaggagaaaagtcttcctgtcaaagagttccaggcaggaagggcataggtgggaattctgagtataaccaggtagctcttttcaaattgatacctaggctagatcccacacagttgtctgggccttagagaccacattctgtgacacactgaagcctttgctccactaaccagaaatatccccactccccatccttctgccactagcaaagaagtactatggcaagagagcaacttagcaactaggagagattaagacaaccagttcacatgaagtgacggggtcagggagcctctgccaggactagaggtcctgtgtgagaaggtgaaggagaaagccaagctttctgaggagctgacactttttaacaggtctgcatccataggcccagggagcctggagaagtttgggccttccttgccagtcattctttccacagatgttgactgagccccggctcagtagcgtgctctgggtccttgtcctggttccaggcaggctgaggcaaagagggctgtggatcacttgcgggagccctcagccagcattccatcatgcctctgttttcaggggcctcctggccccagtttctattccttgttaaaagaaatgacagctttctttgagtataaaacattaattattcccaatggttttcacaaacttcatgatatgaggaaggttttgatggccttcagaatcaactccatgacaaaccaccgatccctcgagggaaggatctctctgtgactcccacgtccccctgctctgtgactctctgtgactccctgtgctctctgtgactcccatctccccctcctcttgtcctgtgcagtggctccctgtggctctgtagtgagactgttttgcagtacagcagactagaataatttttctacaaaattaccagaacattaatgttctctatggtgtctaccaagggccattgtccctcaggatgtttgtaaatcatctacagtgccagtttagagattatggaaatagaaaattctgtatcatgtatactatatagttgctgagtgatttttatagagaagtagttgcctctggttacatctcctcctaaaagggttgtttaaaattaaatgaaatagagaaacttaaaaatacctaaaaatgttgtagaacacagttaaagatgtagatcactctgctttgttattctttgcatatttctgatattatttggaataaatcctttgtgttactgtttacctcctactttttctattaacttcaaagttttgcaaagtgggtagttatgggtttttttcctattattaccagacttcaggacacctctatgaattccaaagttgtgctgctttcttgcaccttgccatggttagggaagagtgacaaccttttacatcttaggttctcatttagcctcccaaagccttctttggataaactagacatggattttaagaccgtagctagcttactatttggaagatgtgaagtgaaggttatattcaacctgcaccttaatctatgattaaaaaaataatgccgttttagatcctgcatggtggtggttttctttttcaattaataatttgttgtgaaaaaaatactgataaggtttgtatcatgttgacatactatagttgtgggagtatgatatctgattttaaaaactaaaaagcctggaatatcctcttcgtcttctttggactttttcacatgtgctcagtggggatttgggctttcagagtcgtgttactagtggaagccggcagacctgcttgtctctggcatcatagtttcctagcaaatgtccttattttatatagacttggaaaatgtaataatgtatgtacatggtaatagaaaaattgaaatggtatgaaaaagcaaacagtgaagaataactctttaaaaacatactatctgtgcaagaagccacctcaaacttagtatcaaaaaagcacaactgttttaccacaatcatcaattctgtgatttggaaattcataaagggcacagcaggggtgacttttccctggaaccttataggttccatgatatctgcaaccttggctcaaaagactggaaggctgggaggctgcagccatctgaaggctcatcactcccatgactggtccctggactggacggatttgaagacaaggactattgagcagagcatctatcggtagtagatcatctactcggtagtagagcacatggtctctccatgtgtttggcttcctcacagcatggcagcctcttacacagtgactttggactccagtcatgagtctttttggccaacacagagaaagctgccttgccttttctgacttagccttggaaatcagacagtgtcacttctgcttcccagatttaagaggaggggacctaatccctatcttttgataggaggaatgtcaaagtcacatcatgagatgagagatattgttgcagttgtatttggaaagttcaatatatgatctttccccctgaaatgtggagattattccatatagatctctgagactctttatggctacataataatgtatacatcattttcacaaccagtcacctactgttgaatatttagtttgtttccattcttttgatagcacagtattttgatatttttattatatctttatttagtttgtttccattcttttgatatcacagtcttttgatatttttattatatattttaatgctattccagtatatttataggatataatcttataagtggtattgctgggttaaaaaaatgtgaattttaaattctggtagatattaagcccagtcttttgcatcaagattattttggctgagagtgatgaaaaatccaaaataacaatggcatcaagatagaaagacagaaagcatggaataagaatccagacctaagtccttttttcactgtaccaaactagaataggactaagttataaactcagcatttatcagccaaaatattactgcttatctctgaggtcccaataaggttatttggtcctattttatttttgtggtatctgaattgtgtatacaaagattaactttctctataataattattctttaagtggaaaattctcttcctgtcgctacaaagcagcagcctgcctagggaaagctattttttcatctttgtttcaatggcttagtaatcccctttgctgtttcttctttcagatcttctagcctcctactcctcacacagtaaatcctttcataaagaacggctgagtcatgaaagggaatgcagatggccatgagtttatttcctggcatggagtctagcccaggtttcttctcccagccaggggcagctgtcacctgacagcagtagtcctctccaggccaagtggacttcgtttattgttgggcccaggccctcaaatcctgctggtgatagaagcacagcctgtggaacaggctagataggagcccaggatggatgtacagtgagcactgggctggctcccaacccaaacttccactagtctagtgtttgctttcagtagcagcaaaatggaaaaatcataatcttcaaaatggtgtgaggaagataaaataggagcaaggggtggcatagctagagggtttaaactttgtcattcaaaggctgtacttggaagaaccttataaagcaatgaaaatttctgccagagaagcattaggcccagacttttagacctgtgggatattcccaactacacctaaggatttggccttgcaactttacctgcagattataatgactatgagattcagggagtaagaagcaggaagcagggcatttcatgggatgttatatttctatgtgatttcaactgactttcctaataatcaagagacccagaataatagttcaataaatatgtaaattaacttggtgtgacacgaatgtgctggggaaaatttgattatctgcatatatgaaaatgtgaaattgggatatattagtcatctctagaaatgaaagaaaatgatgctttaagtacatcataagaacaaagtaacaaactggaaaatagagttaaaaaattatactgcatgcagtatataaagtcaaaaagatggaaactatgaaagagaggtttagacatatggaagaaaacatgagaagctttaatatatgcttgttggaattccagaagtatatttttaaaagattgagggatagacagtacttggacataatatgggtaagaattttccaaaatctataaaagataccaatcttcagatccagattccaatgaatctcaagcagaataaataaaaagaaagccacaacttgatgcatcatagttaagctgaaaaatatttattttattttttttaaaaaagtagaagacctttaaaacagcagagagaaaggatagattaccaaaaaagaacaacatagtacaggagacttttcaagagcaaatatcaaagccagaataacatctttaaaggactgaaataggcctggcgtggtggctcacgcctgtaatcccagcacttcgggaggccgaggcagacggatcacgaggtcaggagaccgagaacatcctggctaacacagtgaaaccccgtctctactaaaaagaaatacaaaaaattagccaggcgtggtggcgggcgcctgtagtcccagatactcgggaggctgaggcaggagaatggcgtgaacccgggaggcagagcttgcagtgagccgagatcgctccactgcactccagcctgggcgacagagcgagactcagtctcaaaaaaaaaaaaaaaaaaaaaatggggggctgaaatacactgtcctcttagaattgtacacctagcaacacttcctttcaataaggagagtcaattggagacattttcagataaacaaaaattgagataatttactagtaggtaaagaatcacctaaatccatgtacttcagggaaaaggtaaataataaagacttaagatgcagaaatctatgatgaacaaagaaaatgttaaacacgtgggtggatcttaaattaattgactttataaaatgagaacaatactgtgcaatttaagggattacaaaatcaagataaaactaaaatatgacgtaacaatatttcatttgggatgggggtgactatagttaaatcattctaagttccttgtattgatttggagagggtaacatttttattaaatttaaactttgtcaagttagatatacacatcttatttttatgatagccgttaactactgagggagaaacataaaatgagaggaaaacatctcaatcaatcaatcaataagttaagaaaagaaaaattgaaaaaaagtaccaccactgcagaacatattttcttctctgacacacatggaccttttacaaaaaatagacacatagaggccaaaaaacgagactgaaaagttgaaaggaattggcatcatatcacattctcagaatatatcacaaccagacggaaaccaaaagcaaaataactcaaaaattgccatgatttggaaaataaaagtcacaattataaataagtcaaggatcaaggaagaaataataatggaaatttagaaggccttgacttttattttactaaataagctaagaggtgaacttaagacatttgcgggtaaaaaaacagaataaacccaaggagacaaggaagaaaataatgcatataaagacagaaattaatgaaatagaaactgaagatatcaaagaggactaataatccaatatatggttctatgaaaagaacaataaaataaaatcctggtaagactggtcatacaaacagtataaaggatgaaaaggagaatacataaataatgatgtaactaatattgagaatataagaatgctataaatacatttatactaataaatttgagaaattaggtaaaatatttaaaattctgagagaaatacatataacagtctgactcatgaagaaagaaatcctgcacgtttttataaacattgaagaaattgagtcagtagtttaaaatcttcccccaaagaaaccattaggcccagaagattttataggctttatatattatttcatgaaaagatcattccaacattatatatactcattgagtgattagaaaagcagggaatactttttccaatttatttcgtgaggttaacataacgtaatactaaaatcatatgaggaccgtataataaaagaaaatactacctaattttacccatatacataaatgtaaaaatcctaagcaaagtactaataaaccaaatccgacaacatagcaaaaagatactgcattgagttgagtttacaccaggaatggaaagttagctcaacattagagaatctacagatgcattttatcatatcgacaaattaacgggaaaaagccatatgttcatctcaatagatgcaaaaagtgttttatttcagcaatcattcgaaacaaaactctcaccaagaaaattttctcaacccaataaatgctacccacaaaacaaaacaataagaaaagccaaacaccaaagcagactgtaacaaatatcatatttgatggtgaaatgctataaataaaggaagtaaaaggttaaaaattagaaaggaagaagtaaagcaatcattatgtatgtatgtagatatgattatctacagagaaaatgcaatagaatttgcagataaattatacaaattggtagaaaaatatagcagaattcacatatgaaagtcaactgcatttctgttagataccaactgagtatctaacagatactcatttatttaaaaatattatttatagtagaaaccaaaaatgtaaggtacctaagaataaatctaacaaaaataatatctttatgaaaaaattctgaaactttattaaaaacattaaggaaggccaaaataaatgtggagacatagatgtacatggaaaggaaaaattgataaagataatgattctctccagacgattaatttaatgcaattctaataaaaatcccaagaggattgttcatgcactctgagatgctgattataagatttatttgaaagaacaaaggaccaagaatactcaagtcattcaaaaagcaaaacaataagatgaggggactttctatcaaaagacatcctaaaaatagtggacaaacaacccataaagtgggaaatcatttttgcaaccaacagaggaatagtattgagaatcaaccaaccgacagagaaataatgtagagaatcaacgaagaactcatgaataaaagagaaaaatcaaagaacctaacagaaaaatgggcaaaaatacaaacaggtttcacaaaagaggaagcacatgaatgaccataaatatatgaaacattccaccacctgataagtaataaggagatgcagataaataccacaataatgtatcgtttctcagcagccaggttggcaaaaattttaaaatctgacaacattctaagcattgctgggaatatatatgcaatagacacttgcatatactgctcctgggactatcaattggtgcaactactttgaagacaatttggcattccctagtaaagttgaacatattcagacctatgacagatccaggaatgccactcctaaatgcactattgttcatatacagcaggggatacgtgcaacaaaggtcatagcagcattgtttgtaattgcaaaaatctggaaatatgctaaatgtccactgacagtcaaatagatcactaaattatagtataataatacagtgaggtattacagcattggcagtgaatttatcaactacagataaaagtatcaacatgtgtaagttttaagtcagtgttaagcctacagaaaacacatgtaacatgaatctatttatataaagttcaaaaacagcctaaagtatagtttgtttggggttatatacatatgtagtgaaactataaagcaagcttgtccaacccacggcccatgggccacatgcagcccaggacggttttgaatgcagcccaacacaaatttgtaaactttcttgaaacattatgaggttgtttttgcaatttttttatagctcatcagctatcgttagtgttaatgtattttatgtgtagcccaagacaattcttcttcttccagtgtggcccagggaagccaagagattggacacctctgctataaaaaatactaagggaattaataaccaaaaattcagactagagattattggccgagaaggaagaggagtaactagggaaggcacaaagcggacttcaaagaaatctacttcttaagctaggtggtatgtacaagggttcatttatcattctcttaaacgtctatataatcttacatggtaaaatttatagtaagacatataacaatttataatgtcttactatacagaatactgtggggggaatcttttttattttatgtttatcttcacaacaactccgttaagcaaaatgtggtttttttctacagaaaatgaacttgagaagtaaattgatttacttgaaattccatgctaggttgatggtgggcttgtggccagaccttaagcctcttgttctatagagctttttacactgcctgcccctgatccacgccatgaatttgtttattcatttattcatttgtccattcactcattcacctcatgtgtattgacccccttcctgactcaggcactataccatcgaaattctttcgataagctcaaaaatgtaaaaaagcctaagtagttaatattttgattgcctgagtggcagtgccctctgggtgcatattcaccccatttataataggtcatttcctcaacccatgtagtatttactttcttagagtcttggacacctgctgtatgtccagaccttcagtttctgtcagtaggtatttctcacttgagagagaactgcaggcttctccagttagcacccttgccctgtgtttagagaaggccactgcactgaggttttaaggcagataagcagtgtcagctgacaggtcctcacctctaggcaggcctttgttcacgaggtggggaacttaacagagcctgcaggaatgtcaaaacatttacttttgtctgaggatagataacttggcagaaaataccccttttcagagctccagagtccaaaaaatgttttgagctaggtctccttattgcatcttcatggagttttctgtccattttgtcttatcagtcctgagttttagatgtctttgttcagcactgaagcccaatcactgtctacacctttaaatcgccttgtctttagatgggaattccagcttctaaggattctaaacattatcacttcagctttctgccttctctttttcatatagattttcttctgttagcctgaagggatcacagggtgatttccctgagggtttatcagaggtgcagggaaggggtgggagaagcctgtgcgcctcctccccagcatgcgggccagctgtggtccagtgcagagctgtttatttcctaacatttatggcctgtctttcatgggcctggcagcgtacaaggcattggaggtcaaaccagttgggacaagactagaaaagaatactataagatttaaaatacaagaaacacaagattcgtttacttagataattcaggtaaaagagtttaaaagaacagagctcaataagattgaaaagttaaaaacacgtattacagttgagattgaatataaggacaataaataaggagtaaaaaggagtaaaaatataataataaaatggggtatacgtaatttttaaagtaaaatgtaagattcaaaaggagaataggataagatgacaaattagaataccccataaaagtgcaattaaagggataaagaaagacaataaacttacatgtattaaggtaattggaatattttaagtaaattgggatattaaagggaaaaaaatgtgaagaaaaaccaaaggtttccttagaaaaacaaatagtcaaaccaaaaaaagaaaaaaaaaatacacacccgctggaagcaaacatacaaggtagtatacaagaagcccttgagcgcttgctagcctgacgtggctctggcttccggaggctgcgcctccactggcagaatgtcctgcttgaagaactctctggaagctgcctagggatttctcctgttcctctccctccagccactgctcactcaagaggatgtttattttactgagtttgacacgtttgttgtattccactttgctaaggttttaagatttttgttcatctatgttcagacatgactatatgtgttttgaactgttcattataggtttggagttcaaaaatcacttttgccagtggttagattttttaaaaatgtttggttgtttgggagatttttttctctcaatcagggccaaatgccttttattggattatagcacttatttctttcactgatgaagtacttacatttgcaattttcttgctacaagtttggaaattttatgtattcagaaatgactattgatatgtattcatgttattgtttttcttctctttgttttttttctaatgtttattcttttcataggtgatttcttagtctttacaacaatgcaaatgtggaaactaaggcttatagagatgttaagtaatttagccaggattaaatagctgaagggtttcaaaagtcacttcaccataccgccttctggataaaatctaatttatctataggcagtatagtcaaatacatttggctttattttctatttttaaaaaatctgactagatataggatccttgattttatgccaggtattttgttattactccccataagaccttaccaaaaagaaatctcttcattccttgcttttgaaaattcacctttaatttgcaggttaaggccaggcgcagtggctcacacctgtaatccagcactttgggaggccaaggcgggcggattacctgaggtcaggagtttgagaccagcctggccaacgtggtgaaaccccgtctctactaaaaatacaaaaattggccgggcatggtggcacgccccagtaatccgagctattcgggaggctgaggcaggagaatcgcttgaacctggaaggcggaggttgcagtgagctgagatcacaccactgcactccagcctgggtgacagagcaagactctgtctcaaataataataataatttgcagggttaattaggcttgaatcgtggatccattacttactagctttgtaactattttctcatccataagatacggagaatacctacttcctaggatgttgtaagaattaaaggagaggccaggtgcggtggctcatgcctgtaatcccagcactttgggaggccgaggtgggtggatcacgaggtcaggagatcaagaccattctggctcacacggtgaaaccctgtctctaccaaaaatacaaaaaattagtagagtgtggtggcgggtgcctgtagtcccagctacttgggaggctgaggcaggagaatggtgtgaacccgggagctggagtttgcagtgagccgagatcacaccactgcactccagcctgggtgacagagcaagactctgtctcaaaaaaaaaaaaaaaaaaaaaaaaaaaaaagaattacaagagaaaatgagtgtgacttattttactgaatccttgtcttgagtgctaccttgtaccaaaaggcttctcttctgtcttcatacacataacagtcctgatgaaagttttggttccttttggatcctctgctgaagaaacttgggtcagtgagttcaaatctagctctggtaatgcctaattccctctctaaacatcaggatgtgggaatgaaaataagaattttaacagcgacatgttctgaaataatttacagaggcaattgaaaaattaggaaattctggggacatgaactttgaatgttggacattgttggcttccttcacatggcacctccaaaagaacatggtggcagctagagactaaagtatgccttagacatggcctgacctggggctggggaaggaagggtgttcagagctgccctttggtctacttgttcctcagggagtcattgggtccttttttgggtctgaaagggaggttgcagccttctccctgcattggctggagctggactctgtttataatggtgcataccaaatcctcttgctggatttctaatttggcttaaaagacacaccccaatgaaagccagaaagaattactcacctgttgccatatttaccatctaccacaattatatttgcttgaacctctgtcctggccagatatttcctgggtgctgccttcaaagcaactgattgcattccccacttcctcttagataagttactgggctcccctggagccttcagcagcttaataccaaacagcatctgattccttcctgtttccagagcccacatgaaagtcaaactttccagatatggattatgaaagagagaggaagtaccccaaaagtcattttgtcttctttatctgattgtgtatttcatttttactggtgaaaaatacatgttttaaatatttagagttttcttgtaaaaagtgaggatggcatttttgcatctagttattcatttagcaaccctttacccagtgctgatgccaggcactgtcctgggcttgaggatacagtgatgagcaaagacagacatatccctgccctcatggagcttataaaccattagaggagaaatacattattgagtaccatagaaataaatgtagaattacaactctgataagtactagaaagaagagatacatgatcccaaaaaccatataactgggggattttacccatttggggaggttggggaaggcttgagcaccttggaagtctagagcccagtatccgtgtcctaccttccaaagtcaccagatgaaatctggagcaagcttttaaaaagctagtgcatcaggcatcctttcaactgataactctattcacagcaagagcaaagattcttaaacctatctgtcagagaccagataaacaacttgactgaaagttttgagcaatattaaagaggacagtcaatcaatcatcattaggtgccattcattctttaagacatcattgaaaattatgagtgcttcattgactatatttctgaggcatgaagatggctcatgacccatggggactctaagctgacttaaatgatctgtggtcgcagcagttttactgataacgtgaagcctactgatatacctagcactttgaagacaaagttagaatttaccctctactatctttaaaagtatttccttctgttttaaacttcactccaaaggacagcttcaaaataagcctcttagagtagtggtagatgggacatcatgagtccagctgtctgacttatgtctggctctaattcttactacctctgagactttggacatgatgtgtcacctctctggacctgattttcctcctctgtataatggagatagtaagaatactacatcatagggttgctgtgaggattaaatgagatgttgctagagttctaggtcaatgcctggccaggagtgagcacttagctgaggtttgctctcactgctcccctctctgcagaagagcagtgagtagtaaaggcaacagcaacacatctatatgctgtgtatttatgcatgctcctctcccaggagcaagtgacaaagccacacagaccctgggaatgttaggagcacacggtgttccttccctctgacagtagttttccagaatagaaatggaaaaaaaaaaataccatcagaatagcctcctgtttgccctgacactacgactaagtaaaataactcaagactcctcaaaaatatgacttgggactcttcaatttactgtgggtgtgagtatagtttatgaacatgtatctaacacctgccaaactgtagtctcctgcaacattcccccaccaccgccatgtgaaggaaccacaaatgaagtgatatgggaagaccagactgaaaatttctcaaagcaggtaaattcaaagcaaacatttgtctctccctcctgaaatggccaggagtgttgttcctggaaccaagacaacaggtattggataacagtgactgactgggctgacatttttttttagtcagggccaagttgtcattctgggatactctgtgggaaaacagctttgaattcagtttgtaaatttatactttttctctttgttcacatttctagtccagctttctcaatggggaaacaaatactgtagcagagaaaagtgtgatggctttttaaaaaaatcaaaatgatttatatgcatctaatattgttctattacagatttgctgctgcttttcattaagtaatagacccttaataaatataaccactttatttttgttcgtgtcattgatttatacaagcatttatttgttcacttagtcattcaacaagcacatgttaagtgtttactttggacacatgatctgggaggtacaaatgaagttatgaagaaaatgggtgggaatgttagaaatcacacctttcgcagaaaacccagactatgtggcagctgcacctgcggatggaattggaactgaataaaataggccagcacatgatgtatattttgaacatttcctctgaggaatcaaagaataaatgcatgctcatgctaacagcaatacctgtcacaatctggaaaaacacataatttcagagaattataaaccagtttattttttaaaggagggcaagatgctagggacccaggaaagggggtcacccctcttcactgtgtcctgtgcctaccctatccctgacaattgcatcagccctaacaccttacagccatctcgccctcttggcttgtaagtcctagcccaacaaatttacgtggagttccacaaacacatcagactctttcatccctttctgcctccacatatgttgttcctttttctggaacattcttctttctaccttcccttaatgtctgctcaatcttcaaatcccaattcaagcctctgatcctttgagaagcctctcgtggcccttcccacacctttctagccactccctcctccctggcacttggagaccttgtcatatatccatcgtcaacaatgtcataccaaattacagttatttatttacacatctgtatttcctgtccatctgtgagaaactgggtgcatcttgatgtgaatgacaaggtgttgctttccagcaagtgccacgatcaccggcacagaggacatgcatagccagtgtctgttgaactgagggaactgtacaggtgtttttatagttcttattaggctaggagtttgatgtgaaaggaaccattcaacaaatatttattgagcacatactatgtgtgaggcactgttctaagcgttaagaatggaggagtaaacagaagagacaaatgtctctgctgtcattgagcctaaagtttactctttaagccggacagtcatagactcagctaaaaattctattactagggaaaaagagaagaactgatgttgagataattagcagtccttgctatgggcatgtgtatcttttattcttaaaaaatggtaggctgtggtaattctagtttgtttgtcttaaatgaatgtgttgaacttttttgcatgtgtcttaagagcctattcaacaagctgtcttatttcttaattgaggatctgtgtgtgtgttggggacagccaggggaaggccagctttcaaggaaagtgttcttgaaagctccttcacatgctgttggctcctcaaaataacccagtgagctaggtagatgcagcagatgttattgtcccattttacagatggaaaaacaaagcacagagagttcaagtaaattcattaagattacagagttaattggtgaaagagccatgcctcctgacttcatactttttatttgattaaggatgtcgttagcaaaatagtaggtcaaggaactcaggattaatagataactaaaatatttattgtcattcttaactgcagttgtttccagaaaggaatgaatcaaagtaaatctttctacacagaacatggacacttccttcagctttctcccagtcctcaatccaagagaccactttgcccacattgtcactgcagttcagccagttctcctccagagaatagagcagggagatcctcctgtcaataattgctgcacgtagcaagcccagtccttgggctgtgactttccctgtggtcgcgctggctccagttcccccatgacctcatgtttcagaggctccatgttttgctgtagcattgccctgccaggcaccatgaggcagtgctggacatccccactcagagtttaatcatccatgtcctgtttcagctgctccacccagctcctctgctgagacctgacacttctcacttccttgcaactgcccacgcattcctgggcccttgcatctgctcatctcatgtacaaccaagatactcatgaagcagagtaaaggattcctctctgctacattggaacagaaaactgagaatttcagaaattaagaaaaatacatatcaaagatcaagtataaatggaaagaaaaccatctttggaagagagtctctaagcctcacattcctcttctgtaaaatggggataataatacttaaaggaaaattactttaaatgttaaagttatatacgtaaaatggtcagcttactgcctggaacatagtagattctccacaaagggtaaagaataaaataaaataaattttattctttttccatagtatttaaaatttgagcagccgtactcagggtaaatgaaaccatatgttcacacaaaaacctgtacatgaatgttcatagcagcatcgttcatagtaactagaaagtgaaagcacccaaatgtctattaactgataaatgaataaacaaaatgtggcatatccatactatggaacattatttagccataaaaagaagtgaagtactggtacgtgctacaacatgcgtgaaccttgaaaacagtatgcaaagtgaaagaaggcagacacaaaaggccacaatcatatgattccattgataagaaaggacgagaataggcaaatccatagggacagaaagcagaatagtggttaccaggggctggaggggtgagaggtgactgctaatgcatgtagggtttctttttgaggtgatggaaatgttctggaattggataatggtgatggttgcacaactaaaaaccactgaattttatattttagaagagtgagtattcgatatgtgaaatatatctcaataaagttgttagtaaaaagtttgtgcagcagtaatcatgtcttagttgctgcgcaatgagaggaggtatgtacggtgtttgcaggaagtgtacacttacactcattctgtggtgctgccatcatttttttcttctttccaattctcttgatattagactgggttgagagaattagttacatcttgctcaatctgtgcatgtttgtcttttctttctcatggaagatgttttctgttttgtgaaagcagcaaagtgatagtattgctgtcctcccagccatatttgaaatatttaattactgaaatatgtgccctgagcatgtgtggatagatggacctgggctattaagagatgaaataatgtgttttttatgttgatttccagagacctcctgccagggtggaatattttcatggcatttcagcctaaaagtttgtacaggttataaatagacttttatctctaaaaagtagatagccagcttctcttgaaacaatttgaaagcctagcatttctgggcacacattccagtgcagcagcaatcagttggggcccacatgtgcctattctcaacagtcctcctttcacactgttggctcatacatggcccatttcatttctttgttatctgtgctcagcatttataggcatttgggttggatggggagaagttccctgaaattgttcattcattcactcatcaaactcatgataagtgcttattttatagtgaactgttaagtactgggacagtccctgtcctcagggaagaaagtcaagtaatgaagaaagaaatagaaccagttaattataacacaagagcaagcacagtgctggaagcatggcaagctagtgatgcataattacagatagagggtgtccaatctaacctgatgtgtttggagatgtagaggttcaggactcctggagaaaatgtttttggatcctgctgtgtcttctctttagtaccagtgctacatttaactagtaactacatgtcttcagggtacatccacaaaataaagaacttaacagaattggaaaatccaataaggacaagaaaaggggccatgatgagtgggtgaaaaaggtgggaagaagaataaacaagggccaaaggagaacgaaaacaggaagagggtagatagacaaatgagaaacatatttgtcttgtctcagacactcccactgatattttcatggaattccaagggttgtgactccaaggaaaattatgctgaaagtaaacctaagcaaagcttgtagggaatgaatgaatcttcccatttttcttttgtttttttgctagagcatttccatcctgtcatcctgagatgatcatattggtcatattgattcatatccttgacaaggtagagaacttccaatttgacaggtgtttcctggtcatctactctttgttggacaggtgtggtggggagcctggagtgggagggtgggtgttgagggatggattagaaggcctaaataaaaaggccaagctctagcacccaccatttgcatgacttgagcaaatcataacctctcatcctcagccttcttttctataacaggggaaataaagataatgagtaacttagttaatcataaggctaaaaatgggttagtgtgtggcataatgttgagaagttcttaacacaaagagaagaaaaatatatctccgaatcatgagtataaaaaatagctcaattataatatgtttaattaagtttattaattttattgaaagatgataatgggcttttgaattgactgttaactggtcaatcagcaaattttaccatcaggaaaaatttagagatgccatttagggatgaaattgattggttgcttgaatttctagaatcaaatatttatttttacatcacatatacccaggcttcaggtgtgtcgtgtctatgattgtttctgggatgaaatggggcatactgaggagggatgttgaggaagtataaacattaattttgttggtgaggaatttttcatgagaagtgagtttttctgatttcttagttcattgggaagaattgcaactaagtgacttggtatgaataggatctaggaaaaggctttttgtgggaggaatccccagacccccaatccatattcacgtctttaaccatatccatatctagtttccacccagaaaaaggattccagatctttagacagaattctacccagtaaccaagaaagaagaatcaattggcatattttgctgagtggctgagcatgtctctgcctttggcacgtctgctgctggggaggctttccttgagactggacacagaggtggcgggactcgatgatatgacctttcttgaaaatgaattacagtagttgctttcattagtggaattttatttttaggtggagctgtttattttctacaccagtgagtcttctttgctcaatgaaaacaagaagcatctgagagggtagttcagtgtttgaagtctcgaattggaaaatttacctttgccaactcactagtcatggtgaggattgtccaggtggtgactaagtttgttgttcattccactgccattcccttgagcctctggggaatgtattttgcaggttctcaggcagcaagatcaatagatcagtcgttgtccagtgttgccatcctgctactccaccaatcgcagacctcttctatagtgacagaggtcttagactttctcgggtgtggcagggaagctgaggacattccctgagtctcagtacagatggaagtgatcagaagtaccgtgtcctggccgggtgcggtggctcatgcctgtaatcccagcactttgggaggttgaggcgggtggatcacctgaggatcaggagttcgaaaccagcctgacaaacatggtgaaaccccatctctactaaaaatacaaaattagctgggcatggtggcgcatgcctgtaatcccagctacttagaaggctaaggcagggcaatcacttgaacccgggaggtggaggttgcagtgagctgagattgtgccattgcactccagcctgggcaacaagagtgaaactccatctcaaaaataaaataaaataaaggagtactgtgtcctcagtttccgtgtcccacctgctgagagatccagtcttcatctttaatatgattccagtggccccatgcttaccaatatgagtttagccctaacaacctcagtaggacttgtcaaaataaatgagtcagttctaattatttctagttggctctgagtcttaagaggcaagacttagaaatgaaaactaacttctggaacaaggagaaatgtcaatgtttttagacattgccagataaatctcaatttttttttccacagccaagcagtaaagcgtctcatcctgcagacatgttgacttcttggtctgctctttgtgctcccttccatgtagcggtgacagtgcacctgttgacctgggagcatcatcagccaaggggatccctacatgtgctgtgatcacatctccaatacgtgtttcccttagtcctaattcaattttgaatctgagactcatgggcttttgctaacttgcacagctggagaagaggaagaaggggaaataggaaccaaaagcagaatcagagggaaagcagatgggcagcattagggtaagaggtggccagtgtggatgtggcacctgtttctaccagcactcccttttcaggtactagctccaaagaaagcaggccaggactcatggacagagaggtggccaaccatgagcactgaagctgtctcagggccacagctcccctaaaagtggaagggagagaccttggtggctggcgggtaccagggctccttagaggtaaaggaaagttattgtcccaacatgaccttcaaagaaaattaaaaacagctcaagagctgagctctccttgctgtctttttgtcgttgttgtttttcttttgagacagaatctcactctctcacccaggctggagtgcagtggcacgatctcagctcactgcagtctccgcctcccgggtacaagcaattttcctgcctcagcttcccaagtagctgggactacaggcacacaccaccacgcctggttaatttttgtatttttagtagagacggggtttcaccatgttggctgggctggccttgaactcctgacctcaggtgatccgcctcaccctcccaaagtgctgggattacaggcgtgagccactgtgtccagcctttccttggtgtcttatcctgagtcagagatctggggaagagagagtgagtggaggtgttgatttaggtgtgaatccactctagttggagaattgaggcaaagactgagccgtatgagcctcccggaaacatggtcacccagccagcccatatttgtgttttcacaatctgtggttttccagtttgattactgactgtcaattacttgcagatcacctctccagatgtccagctgtccttgcacatcatttgttttcttcaaggaatccattagtgatgtctgcgatttttctgggtgccttttctggtctggttgggaggagggtaacagattcgaggcagtactcattttccaaggagccttcagactgagagaggggccactgtgcctcagctcctcctgaggggcctcacacattctgggttctcagcttcctagcttcatggaaaaatccacctcagccgcagaggtttttgtgtctagatgcttgtggagtgctgcagcaggacaagcactgcgctgttgctgccttgtgctacagggctctgaaaatagaaccgttagcaccagcctcgggtttcctccagaaagcttgcatatgggcctttggtatctctctctgtccaaccctctgaatagcccagggcctgtgttgctttcattattatgcattcaaatggaaatatacttttgtcagagcgattacaaggcagtagttagaagtgtctgcctggatttctgtgtttttgccttttttgacattggggaggaggagcagggaaacttagtcttaagcggggaccaccaggcttcctcggtgggctggtgtggccctcactgctcttcctcctcttcctcctctgggaatgagtgtaggagagattggccctgcacttcaaagaccaggattcatgcacctctctccaaccacaactggaggacgtgttcatttcctcagaagcctgagaacaaacagaatcttaattcagggaagtaacactacagacagttttttaactcaataaagagaatatttgaaatctgtgcatctgtttttaattagacatctgtacctctgcatactccaggcagctaatttctaaggatgttcatcaggagtggatgcttaggcaggttttggagttgtttaatctgtacaccaggaaaacacatttcgtacgataagaccaactttgtcaaaaggattaggaaatgcattgatgtagagaaggcaaagagaatttaagaagtcctgtgtaatgaagaaacaacaaccaaggaaagaagtagatgctgtataaattacctagactattttttttaagagatggggtctcactatgttgcccaggctggagtgcagtgactattcacaggcatagttgtactcactgcagcctggaactcctgggctcaagtgatcctcctgcctcagtctgtcaggtagctaggactaagggtgtgtgccactgcacctggcaaattctcttatgccgtttataaataatttaagaataatgtagaaatctcatagcttttggctaacactgtgataaggaatttttgttttgcttagttttaacttactcctcttcataatgttttaagtgaagaataaggtgctttatggtaaattctgagtttcaggaattgctctctgcatgcttcctatcacgagaccagtggttagactctcattgcgctcttcatggcgtaccctggacgttggtagcttgtggccatgagtcacaaaggatgtgacttttgctgacgttgcactttttggcacaatcacaaactcagtggagcctgtggccttcttccacgttgctttctggaccactttcccacctctgtgagttgctaagggctcctcctaccccatcttggtcctaacatgctcacctggtatccctcaaaactgtcagattcacacatcacctctctccctctccaggccatggaatgtccaggtgggcctgtgggtcgttctccctcctagaccttgccgagaagagaagagttggttctcatctaatttcaagaagacacttgaaagtagatcaagttggccattggtgtcatctgtagttattggataatgtttttaagtaggctagttttaatttaagtatctattttacaagataatattttcaaatattacttacatacctctatgtcccatttttctacaccctatggcttaagttacatagttttaagtttcttggtattttacagaaatgtattccctatctaaatagagttccactgtgctttgcttaacaatgtatttttctctcttgaacattcctgaacattccctctcttaaagattattattttaggagataaaaaaaattttttgaatatatttagtggcaatttaaaaccaattaaaaactataatgtttcatgtttaatgaaaaggagttttttgtgttttatttatttattatatttattgagagagcatctcgctctatcacccaggctgcagtgcagtggcccgatctcggctgactgcaatctccaccttgcaggttcaagcgattctcctgcctcagcctcccaagtagctgggactaacaggcacgtgccaccatacccagctaatgtttttttttttttttagtagggacgggtttcaccatgtagatcaggctggtctcaaactcctgacctcaaatgatctgctcaccttggcctcccaaagtgctgcaattgcgggcatgagccaccgcacttggcctttatttatatttactttcaatttattttaaatcatcctacaaatagcagtgaaagtaatgatgcaatagaagctaaattatttcatgtgtacctctgatcatttttcaaaactgtattatatcatatatatttttgatgaaactttatttatttttaaatttcaactttcattttagatacagggagtatatgtgcaggtttgttccatgggaatattacgacacccttatcatatactaaatttctgtacttactgttctgtgccactgggctccctatgtcatttatccctgtgtcattaccacacagttttaattgtagtggcttatttttttagtatctgcttgaattgtattctgtgtggttattaaaaaccaggattaggtgtggaattttgttaaagaccttttacacatttacagagataatcatgatttttcttcaggtccataaacatagtgaattatgttagtgaaattccttcatattgaaaattcttagaccatgctatattttcttaataagatgttggactctgtttgctaatacttcatttaagatttttgcagcatgtgcattaaaggatattggtctgtagttgtgtgcctgtgtgtgtgtgtgtgtaaatctttataaggtttagacatcaatattatacttgcaatattagaagaacttagaattttcatttttttcctgcactctggataacaagctgtatagcattggaagtatctattgtaggatttggtagaattcccttgtaaaaacacatgagcctagttggggtttttttcctgtttactctcttcttggaaattattcatttaagctttatatcacttcaggagttaattttgctaacatgcatttttctggaaaatcttctattatatttagttttcaaatttatcatcgagttgtacaaagtagttgcttacacatttttaaaatttttctttcaaatcaatcttcttgtttcccatccttaccatttcttattgttttatatttgtttgtcttaggtaggttaactacagcttgtcttttattgatctttctcaaagaagtagcattttagtttgtttctactctttttctgttttatatctcacaactttctacccttatctttattaatttctttatatatgtttgctttgttgcttttttcctagctttttgagtagaaatttaactcatttatttttatttatttaagcatataaaactgaatttttctctaatcactgctttaattgtatcccaaaattctgatatgtagtattttcattattaatttttggaagttctgaaattggtttgtatttatttttccactagtaattgttattttttaaaaaacaactttataagagagtttttagtggatttgggggattttattttattatcaacttctacgtatatgtcatttagatcagagaatgttgtttatataatttcaattttatggaggctttctttgggatgtaattgttggtcagtgctagcagatgttccatgtgcacttgagaagtctctattagtatgttgtacagatcctatatatacttacttgtttccccatttgtaccatctttaactgaaagtggtatgttaatatctcttattattgttatttctgtttttctttacagtttctatactttctactatattaggggtcagcaaattatagcctacagactgcctgtttttgtaaataaagttttgttggaacacagcaatgctcattcatttacatattgtttatggttgatttatcactaccatggcagagttaagtagtagctgcagatagtatatggcctgtaaacctaaaatgtttactatctatcgcttgaaagaaagtttgccaacccctgtaatatatgaaaatgtatagatattcatactttgtatattttgatgtgaatggcctcctttagtattataaagtctccttctttgtcatcttaatactctttggcctgaattctacctcgtttgttgtcaggattacaactcctgctttcttctctttttctgtttttcatttcattatctcttcatttataggtgttctgaataactgttttacatgtgttgggttttgctttgtgatacaatttgaaaatactttttaaataaatgagttaggcccttttacaagtggatccatttgttaaactttcagggtagaacaggcacaagttttgtgtacattatttaaaggctttggaaaatactctattttgtaaacgtgatggtaaagttaatccaaaatagataattgaacataccttaaattttgagttttatattgagaattattattgtagcttcacaatgattaaagcagcattgactagatattttgctgcggtcagaaaattgacttgaaatgaagatgaagcagaattattgctcaaattgagggtcattgttaatgaagttaaaaggtggagtttacatcctgggtaactgaaagttaaaacatatagaaaaatttccaagaagattcattaattgactctcagttaattcattttatgcttacactctcttggtgttttcatgtgtttatttattaatgcaaccatttacacgttctccaattggctgagccctgttttaggatctaatgacacaaagatgattttaagcagtgtctctcactttggaaatttattgtctagtttggactatgagggaattattttcatatatacaattttttttccaggagtagccattcttctttcagttagtcaggggtcttttggatttccctctctttcattggatgacatagttaaactatattgtgctttctctcatgcagggcagccactgatcacaatgtggataatacaacagaaatattcagggagtggttgaaaaatgtacagagactctatcactatgtggagtggaggcctatggatgaaccagagtgagtagcaagtgcgaaatttgtaaactcattatttacccttcctctttaactagctctttagggcttccaggtttggaggtacatgtgacttttcattgtctttcatttctgtagctatgtgagttctgaatatctgccatttctcccttttagagatcttcacagtactctcttgctgtttactcccacagctgccagccaagttcagattttcattacttcataaataaattgccatgacagtttatatttttaaatattgatattatttattcatattttaaacaaacttttatatttggaggatcatattgaaaatgtgtatactttctacatagagcttgcttttttcaacttttatcttgataatcattctatagcaatagttaaggagctaattttcattttttttactgcataatcactgttgtatgtgcatttaccataattatttaattgatcccctactgatgctcatttaggtaatttcctatcttaaccatagaaattccttctttctttcttttccttcttttctttcttttcttttcttcgcttctcttctcttctttctctctctctctctctctctctttctctctttccttctttctttcaagacagggtctcactctgtcaccccagctggagtacagtggcatgaccatagctccactgtaacctcgtactcctgggttcaggcaatactcctcactcaacctcctgagtagctaagaccacagccatgcaccactatgcctggctaattttatttttattttttgtagagacatgatctcaccatgttgtccaggctggtcttgaactcctggcctcaagcgatcctcccaccttggccttccaaagtgctgggattacaggtgtgagcctttgtgcctggttaccataacaatttctttctttttttttttttttgagacagagtcttgctatgtcacccaggctggagtgcagtggtgcaatcttggctcactgcaacctccgcctcctgggttcaagcaattctcctgcctcagcctcccgagtagctgggactacaggtgtgtgccaccacacccagctatttttttgtattttgagtagagaggggatttcactatgttagccaggatggtctcgatctcctgaccctgtgatctgcccgccttgacctcccaaagtgctgagattacaggtgtgagccaccgtgcccggccaccatagcaatttattaattgcttctatctccaagtcatcctacataccatacagtcaaatcaatctacctcaaatacaaatgaaatggtttcatttctttattaaaaatacttcacttactctttaggacctgaacaaagttcaaacacctaagacttatatttttaaaattccatgaatttagcaccaaaagaaaatgtgctttatccagaacgtttcttttatttccaaaccccacactgttgcttgtgcaggtcctggaagaccctttccttctttataactaattcttatcctaaatcatgcctactatagaaacctattcttaatcactcagttataaatatctacctttgtctcaacaattgtattgcttatattctatgtcatcctttttggcacaatgatatacgcaaccaacattttccccctatgcaattaatgtattttttttctaaataagttgtaagttctttggcaggggctagaatatataaacactttatattccccctctcccctcagagccatgttcttggcaggcactaaattaatactggttggatgaacaaataagaacaagaataaatgtatttaaaacttactattataaatgttcccaaagctactacagttttactttaaggaactgtagaaatagaatgaaggagttgcctgaatttcttccccagagaagtcatttattgaaagccaaatttgtattatagtaataataaatgccattccagaacaagtttctgttcttctagtctttctatatgtaagaattattataaatatttatattataaagaaatatatataaatatgatataatatatacatatgtgtttctcaaatccaagcccatggactgtatatcaagcaaaatttaacagtgaagtctgaacaccgtaaaagattgtaaacactcctttagagtgccttataatggagtttggcctaacaaaaatggcacagaaatactttgtgtcccttctttgcaccttggtaatgttctctgcagccaggttttgactaaatatattatatgccaaggtcagtgtgaaaaaatattagaacaggcatttttggggggaatatatttagaaaaatgagaattccactgattttcattgaaacaataactggggaagatattccagagaattcctgtgctgtacatagttttattaaccttatttgtttagttacagtctcattgtttttgcagtttttcactcactaaaacaaatgtactgccagtgcagctatgagatcttgaagtggtggccagttttgggttactgcaacagtatcaatgtccgtgccagctgggtgccttcagaagggttttggagcgtgctccaacccacttgcctatgtggccatgaaggagtcttggcctggctgttttgtgaatcttgatagagatcccacgacctcactttacctaagatagatcaatgtgttaggctgtgtggaatcatttgtggagactccaacaagtagattaaacctttgattttcctgggaaactcatgttttacactgcatactctccaaatctattcgatgtcgggatgtataaaaattgtctaggaacatgagctttttgcttggattcaaatcttgattgtgccccattgtgtaacattggacgaatgacttaactgctctaccctgatatcctcacctgtgaaatgcagagaatagcagtactcacctcaaagggctctcattagaacccactgaaatatttcatgtaaagattcttgtatacaatgagcagtgagttacttgacttctcattgctccggtttcctcatctgtaatatggggatgatgataacaataataatagtatctacttcctgggattgatagaagattaaatgaatacatataaacatttaggacagagcctggtacatgtaggcactcaataatgatgagctattattattattttaggtcttaccctgatgaaattggaccaaagcactggccaacctcccggtttgcccatgtgatgaaactacgacaggcagcccttcgaactgcgagggaaaaatggtcagactacattctggtaaaaacagatgtttgatttcttgacaactgtcatctcaggtgtatccaaatcagtcgtccaaaaactagaaccatggaagcaatcaaaacaacctttttgattaggcagtgcctcccccactttttaagaaaggcacaatgaaatttttggtagtttaaaattgggctacctggacttcatcttcaggcccacatgcattttcagtgggtaagtgaagaagtgcctgaattatttggtctctgccatgcaacaggcataagaactctgcatatttttagctcacaggaaaggctgtaggtaaagcaatgtaagttgttcttacaactttttggaagaatttgggggatatgaaaaagtaattatctaaaaaagtgattcagctgaacagctctgaaatggttcccttttgctcctgaatgatctggggagtagcatctgttgcttggcacagtgatgctctctttggagaatttatgtccatccccatcccctcaaccacagtgaaaatctgcccaaaaatgtatcacgcacacttgtgacacaaatcctttcatagaagttttcaaattgtactgacaatatttaacattgtgtagctgtttaaatgccattgaagtgtacaaatgttaaatcacaaaatttggggtaaacagatggactatcataaaaatgaagacttctgaattttttattgtgataaaacctacaaaaggtaaaatctgtcagtttatccctttttcagtgtatagttcagtatgattatttcttttataaattagaatctgttgttatactgtctctaaataaatcactgttaacatggacttctaagaataggaaatagcttcactggttagcatgggttgatataatgtacttaaacaaaaattctacttgtcacattaaaattcattgatagatctgttttgagctactctggcattactatagaaaagctaagtaggcatgcccatctgtacctagactgggcagccaataagtgtttttgaatgaacctttaatggcttgggagccattaatatcttgtgcctaaaacactagccaaagtgtaggttggttcctggttgaggctatgcccagtatggcagcaccaatttactgcttagtgccttatgcagagcccaacatacgaaagttagactaaatatattttgactgaatgaaagccacctagctgcaatgggtttcaataaggaggacatagatagctggttccatatgtcatgagcaagtttctgggatccttcagaagggctgggttattctcaaactcattactgaaaagtaccttttcacctaacattatccttttcttttcctagttcatagatgttgacaatttcctgactaatccacagaccctcaatctactgattgcagaaaacaaaactattgtggcccccatgctggagtctcggggcctgtattctaatttctggtgcggaatcacccctaaggcaagtcttttgcttaaatgaattaaggctactagttttaacaaggcaacacccggtcaacagtagtcccattcacctttctcttgtttactcccttgaaacatgcgtgtcattgtgttcccagagcaagcattttttaggaagggcagtaaatctgggtccaatgctacacccagttgggctcttctgtgttaatttattatgaaaaaaatagtctaaagagcttagccttagaaacgtcaaattagccaattcctgattcaggaattactatttttaattaattctttttgtccttacaaaactaacataagaacactatagaaaaacttagaaattaaaaaaagtttaaaagaaaaccaacaagacagatgttaaatccccatcaccgtaacaacatcatagatagaaacttgcacgtttttagtaactgtgttatcatcaagtggctatgttccaatttacttaacctttatctcggtttgaaaaacatttaaattattcacaactttttaactatcgtgaccgtcatgattaatataatttttcagcatttaagattatatccttaggatagctttttagaagtggaattactgagtcaaacagtacaaatatgccaggcgcggtggctcacacctgtgatcccagcactttgggaggccaaggcgggcggattacaaggtcaggagattgagaccatcctggctaacatggtgaaacctcatctctactaaaaatataaaaaattagccaggcgtggtgttgggcgcctatagtcccagctactcggaaggctgaggcaggagaatggcgtgaacttgggaggcggagcttgcagtgagccgaggtcgcgccactgcgctccagcctgggtgacagagcgagactccctctcaaaaaagaaaaaaaaaaaaaaagtacaaatatttcaatgaccttcgatgtatgttgccaaatttatttccaaagagttctaataatgaaaactaccatggtaggttatttttataaaattcaagttaaaaaaggtttgattttttattatttctttttttcatagtaaaatcttcaaaatagtggtctgttttagtgaatgctcatggctggttatattttttattctttaattaaagaattagataaattcaactgattaatgtaatatgtatcaatgtaggataaaaatgtgctaagcaaaatatgttggccaggagcagtgtctcatgcctgtaatttcaacactttgggaagctgaggtaggacaattacttgaacccaggagtttgagaccaacatgagcaacatggcgaaaccacatctctacaacaaatcaaaaaattaaccagttgtggtgtcgtgcacacctatagttccatctattcgggaggctgagcagggagtattgcttgagcccaagaagttgaggctgcagtgagctatgatcacaccactgcactgcagcctaagcaactgagaccctgtctcaaaaaaagagggagtatgttcaatgtattctcatggccaaagggctaaagtttgagtctcccctttatatttggttttgttttggatgagaaataaggtcagtagtgtgctgataaatgtttaataactggctctttgtgggaaaaaccctagttggtagcattgccaatttttatggtttaaatactcccaccatgcaaacagcttaaatgttgttaagctaagggaaaggttaagtaaactgcagtatagccacttgatgatacagctattaaaaacatgtaaaactgccacatgaggtgtcattagagtggtggggattaacgtgatttttgtttttatggattccaagctatcaacatgtcaactggtttgcaaactttctgaaaatttaacaatgtgtggtccagtacaccactggatgaagcattcctcttttgttgtaattatttcttctagctgtaagagattttgaatgcgtgctattttctgtgtctcttttgggaaggtaatatgttcatatttctaacagccattcacttccttgggagaaaacattatattggtttaaattcatacattttcagtgtttcacatggcagaatcacttgagggttgtttttaatgagttgtgctttgacatcagcaacaagggtgggttatcctagtggccgcagcctacaaatttgtattatctccttatttactttcaggcttaaaagcaaataggagaaatgtgctcacttgttttgtacagtaaaactaaattctgagcaacttagggacaagtattattttcctccatttatttttggctttctaccatcccagttagtctctactagagcaggaatagaaagggccagtgacttcataaattcaaagcaggacctggttcccagagcctttaaactcattcaaaacaaaatgtccttgatgttgtctggccaatgaacaggaattattaccaacaagattcaatttatgtggaaaaaggaacacattcatcatctctgcctctttgcaggaggcacatttattctccctcactctccctgcttccttccttctcacccccaccccaaggatattcagtgattcatcatcatcatggattttccaagctaatcattctgggaatattgttcctaagtaatctagaactttatattagacgcaagtacttaggcagccctttaaaaaacccgagtcccctttatctcttggaagactgctcataagctgaagtattaggaaaaccatagaggatgttaaatgatccttaagttaaaggctaataaaaacattatagtaatgataatacttcatataatgaattgcagttcccaaaataggttcatagaccttatcacatgtgattcattctgcagctctatgagattgacagagcagctgttatcccatttttcaggagaaaaaactcaggctcaaagagggtaggcatggactaagatcaaacggctagaaggtgattaagatgactctgagacccacatcttctgagtcctcatttttgatcctcctcccttatcatggggtcggcattagggttagctcagctaggacactcttctagaacctgaagggaatgtcagagaagtaggtgaggctgtagcaccttatgtgtggatgctgaattacaacaggaaatgtaaccatgaagtgatgcaactgattaatgaacacataagaacttccagagtatggtgcccttcggagtgctggctttgcaaaacttaacactcattccagtgagcctgccatcacctagaacattttccaaaatgcctggcaaagcttccacaagtatgttttgtaagcatgttttgttgagatatatcttcatcttttctggaaatgattcaagctttggaataaggaaattggttgtcctgtgtgcttgtgcagaaggacgtttcagaagctgaatccccaaaaactatggagcagctgcagcttcaccagaatattgactaagtaactgcattgaaagaagaccctcatttgtatatctaagtaatgcatgtttaattacaaatattagccacagtgtaatgtcattttaataggagccggtatttgctgatacattcttggtgctgggcagtagtctcaacactattcaggttctaccttacttaaattttacagctaaccccatggagtagatagtgccgtcatccctgttttagagatgaggaaataagcgcagcaaggttgagtcacttgacccatacctacagacaataagtagctgaggtaggatttgaactcagggagtctgacactggaacctgtgcccttaactgctctgccacttcttaatactcatgcttcatatttaatcataagtcaacataaaatacacttttatgaaattattaaatctagagatatgctgaaataaaagttacttcttatatcaagacccttttagtattattttatatgtagacagcatttcttgtgctcacttggaaattcataggccatgataagaggagtgaaggtggctttgtttgggagcttgtatatagctggtaatgacttgaaaggaatcagtctagcaaatgactgagaaggatgaagacttcaaatcagaaaacacaacccacctatttgctcttttacagggcttctataagaggaccccagactacgttcagattcgagaatggaagaggacaggctgcttccccgtccccatggtccactccaccttcctaattgacctcaggaaggaggcctcggacaagctgactttctaccccccacaccaggactacacctggacctttgatgacatcattgtctttgccttctccagcaggcaagcaggtactgtttgtctttggttgtagtgccacaatggagacacagcaaaatgaccagctcctttgttttgtgcattttattaaaaaaaaaaaccctcatatgtctggtagtgagaggcagtaaattgtctgcaataaccataccagcaccctctatgttgctgtccctgggagcaccaatgaccaagagccagggctggcctctacccaggaacccactctattttgagttggagggactggtggtgatattgggaattatgggaaggtgattgcttctctgtggtgctactgcattgcaattgtttattatagaagttcatttattaattaggaaactgtcacagaggcctaaaacaacactggcaaagaccccagactttaaaaatggaagtttatttcttcttgaaaaagtctgagctgctgtagtggctttgttccacaaagtgttcagagtcccaggcttcttgtgtattgcttctcacactccacgaggtactgcccttaattgtggagtcccaggtgtctcaccaccatggatgcgtttcagccagcaaggcagaaacaacagggagaactctccctgtcccttgaagtgtgcaatccagaagttgaatgcagtacttccatgcaaatcctgttagctagagcttagtcacaggacaatacctcactgtaagggaggctcagaatgtcgtctttattctctgcatgcatgcactgcaattttcacactctagaagaaggaaagaacagataaagaggcaccgaacagtctcagcctcagtccctgtggaaggagaggcaaagcgagactgaggtcttttatgaaccactgggaaagcatttctagtggggcctggagatttttgagaaagacaagtcaacaggaaggaaagttatttctctcatttcaccctacacttgcttcaggaggacaaaattcacaagagcagttcaacagcaagacacatggcatctaacagagcaaagctttgttaggataattcagactttcctgacagaagttgggtcccattattaatgtgccagaaatgtgtcacttaaccactagcaaaaatacgttcataaaccaagaagatggtgaataaactcactgtggccatataactgagggtggaaaagatggtgcaaagatcctccggcagctgaggaagtggctggcagatgagaatgttaatacaaattcaagctacaattcacacatcagactctccttaaagccatagatgtcccactcatcagttgtagatttgctgagaataagaatatttggtagaaatgggtcaggctgatttcccccttggctgctggagcaatttagaccctttggccaggtgtaggcattttgtagcccttatgtctaggcaaaagcaatcctcatatgattggaagatttttgtaaagattcctatgtcagtgttaatggaaactccttctttcagttggtctgtgatttgctctgacttccccaggatgggaagcaaagtcagggctttttgagtcctttgagtgccaatccctttccttcagaggttgaagttaggatgttccaagaaagtgagatattaacaattacacgaatgacactgcctaacagagtcctcctttatagtcactgcacaaagcattattatgatgcaatgaactaaattattatgatacattgtatgaaaccaatacctggatattggtatgggaaaaatgattcaggttaagcaggaatttttcagctctgccctgtgcttggcctgttcaccaggattttgtgtgttattggtcagactttgaaaaggcttttttagaacattgaaagcaggtagacacccaaagttgtttggtgactcatttgggaagaggagatagaaaaggaaagagagaggatgaactcccaagtgtttccttctgttcctggcacggtgttagttgggagttaagatttttacatgtgaaaacacaactaatagtcatgaagcagtgaaagctaagggccagactggcggtgcagaccatgaacagggcaggagtcaaggcaggaaagattcactgtcattttggggaaatgaaaggtctttcttgacaactgtggattttaaggtaatattgtacttatctctaagtattttcaagagaaacatgaatgagcctgggagtcatgtgcagcccagggcatgtctccaggctcttccttccttagtttcaaagcaaagcactttcctctttcttcatgaaatatgattggtattcttttgttctcactcttctgaagctccctagctgtgtatcatctatgtcccaggcaggaccatccaaccacaaaccttggtcctaaatctttcaccccagactctagccattgccccatgtgggtgatgagtgaggagcaatccaagtgtgctggtgagcagggcttggccacccttctagcccaagaagagagcacatatggtcataggcgcgtctctgttcctgtaatgagtccagggtcaagagttcacctcccattgtggccagtgatctgggttctgtatcatggccacaggaatcatcccagtgccagccagtcgtcttccaaatgtctgatgtgagtcaaaagaggtgagtgatatgggcaatgggcagacagatcctgaacaccactggtagtgatcaaatttgtccccttgtggagggatggcaatcccctagtgactaatggtcttggaactgagcttccaattactgactgggtagaaagcacttggcattggctctttagggacaaagatttggcactaatgacttactatgtgaccttggacaagtgacagcctgaatctgatttttcatcaccaaagatagggataattacatcaatctgcaatgttaaggtactatatgagtacaagaaaatgtttaatatgtttaaaagaaaaacagtccttcaaaatgtagcgtaattcacttctctttttcaaaagaaaaattgtcttccccagaagcagcattcactgggagtgcagactctttcatagactttatctaattattaatacattttcttttaaattttctgttatcaaactgcccatgcacatggttgaaagtattcatatagttccccatggtttattaagaaatgaacagtcccctgcacatcaccctgcatcacttctgtcctccagaaggcaaccacttttatctctaatatttacttccatgttaaataatatgcatgcattgctacttcttgattttctggcttcaccgtgggcattatttgttgactctccactatagactgtgaggagttagctctttttcttcctttttgccctctgcatgcaaacacattcttctcatcaccctgttctcccattgtaatttcaaacagattgatggtcagtgttcttgttgtaatcatgcaagcctaactccaagcttggtcattcataggctatgattagttttcctttgccattctttggaggcaattcctttaataattgccttttttgcttagttttattattactagtatgatccaaaactaatcactaattacctcaaactcctctcagaatgtccagatttgtcagatgtccttttttgcatatttgcgaagacgtctgttctggagctttctaatatattctaatccaagtggtgctgaagctatcaacctaagacttatttctcttctcttatacactgactctcctgttcatgttgtttataatctttcttgttggttataatcgtcctcctcttcttcctcctcctcctcttccttcctttcctcctcgtccttctctcacatcatccagcagctttctgagaaagtatgatggcaagtaaatatattatggtcttgcatgtctaaaaatgccttccttgtaccctcacacttgatggataatttggataggtatcatatcatttttttatggaagcctcagaaagttaaatggtaaaatggtttgcctaattagggtagagatgcaactttaatatatttttccttccacttcctgaattcatcatgactttacaagaaggtgcactttgaagctccccagaagcattcatatgggcaaacagcagagctaatgagtttgctcggtgaaggcaagagaagggacagtgcttggtagaccagccttgattcaagccagattcagtaaaagcagggaataaaggttattttcttttctccttcctctctgttaatgccatgagacagcttcacctgatttgacagatgatgtagctgactggaggaaatttcatctgcacaaaatagaggagtccctatgcagataattatctctctggaaaacactgacaattatcgcaattaacaaatcacaggcttggatacatggaccagaggcttggatacatggcggactcatccttttcactaagcagtcttatcattgatcaggagtgtcaattgctgaccaatgatgtgtatgagaccatcctgattcctatatttctagctgtctggttaaacacagatgccttataactctgcaagttatcaggtggggctatgaagaacaatttgaatatgagaagggtattgcatacttctggtattgtcacactacaggttcttaacaggacattctgaaatgcagactcttttgtctctatatgaactgattttggaagtttcatgtctgttggttggctccaaatccatgcctgctaagggaagcaataaaaccagggagaatcttggagaattttaaatttccttcgttttttcgtttttttgttctatgtatgcctagatttagctttaataatctgtcagcgttacagaattttcctgtttgctttcatatcaaatgtggatttcattcctcattttcttgttatttcctgtaggtggattacagtgttccattctgctctccagaatgggaattccttgcctcccttttgatcctttcatgccttttttgttcattccaggccatgagtttgctttttcttcagagggaaaaaatcaatttcctctgggctgaagaatagccgagtgtttttattagtccccaatgctgtgttttacttttttaataaaggagcattttttaggtctatagacatacctgaaacaaccacttatttaattgcagtgtcaaactcagcatcagacacagttcaggttccttctcctcgcttgtcactcagcagtatgttttctgattgttggctttgtccctctcttggatcctcaggcatccagatgtacctctgcaacagagagcactatggctacctgcccatccccctgaagccccatcagacactgcaggaagacatcgagaacctcatccatgtgcagattgaagcaatgagtgagtgacccaggagcagaggggatggctctcgttccattgccacagtgaccataccagccacttccctcctcttccaggattggaatctcacagccatcagtctcccctggctgaatacatagctatttatttgttcattctttcctaaatttttcctatgggaaatatgaatatgacaaggtctttgccatgtgggagcttcccatcctggaagagcgctgggtacacaagtaaatactttccaaaagatctgataagtgctataatagtgttttgtggtgtggacttaaaccctaacttggctgctttctaattatatgactttgagcaagtaatatccttagttgtaaaatggaaataatgaaaacttccagggtttttgggcagattcattatggtatatgtaaaaaggctaatacagccacagtagttatgactttaacttaataatagctcatgatgtaacagatatcactgttacatcataaaatgctaagcactttttgtacattaaagtgtacaaaactgtttcattgttgtttcattaatccttgcaacaattcaatgaagggtttttattatgcccatattaaagatgaaaaacaatgagatgttaccttaagtaacttgccctagatcattctgctaaacaaatgacagattgggatttgaacccatcttgctatctccaaagttcatgtccttaaacactattgttattgcctctgggtctggcatgatgcatgaattgctgtgctcagtcatcagtagctatgctttttattatgtgtgatgtacaatggtggctaaaagagaaagtaaccaatccacctaacctaggggaagatgttgaaatggcttcccaaagcagggactattttctgttattcatcagtagagcacgggggtgtgaacgtgggcagtggaggtggttagggaggaacagcagaaactgaggctagaaagtgggcaggagccccgccaagaggctctgatgtataagaaggcatttgggcttcagctgaaaggacaggcacgctcaaaaagattttagcacagaaatgtcaggttgaatttggatttagaaaggtcactctacaggtaagaaaagtgtaggtggagcatgcatgggatgcatgggcagtggctgctggtctcaggccaggggtgaagagaccactttggacatttcacggctactgggcaaaaggtggtgaggacctgagctagagcagtaacagtgggaatggagaggaaggaacagaagcttaggacataggcttgaaaggacatagccaagagttgattgtaggtagatgagcaaaagggaggcatagagaaaactcccaagttctgtcttgagtgtctgggggtgattttaggaactttaaatggaatagggcatgtagcataaaggagaggtttgaaaagagagaccatggctggcatggtggctcatggctgtaatcccagcactttaggaggctgaggcaggtggatcacctgaggtcaggagttcaagatcagcctggccaacatggtgaaacctgtctctactaaaaatacaaaaataagctgggcatggtagtgcacatctgtagtcccagttactcggaaggctgaggcaggagaattgcttgaacccaggaggcagaggttgcagtgagccaagatcgcgccattgcactccagcctgagtgacagagtgagactccatctcaaaaaaaaaaaaaaaaaaaaaaagaaagagaaaaagaaaagaaaagaaaacagagaccatgagtttatttttagatccattgagttgtctatgagtatctgcttcccactcccttgctcctacactataaattcctttttcatcatattagtctcaggacctagcacattgtctgtcacgtggtagatgcccagcaaatatttgttaaatgactgaatgaatgatgatgaaatgatgaaataaggagctggttcactgtgacagtatttcttgaaccagccctcaggaatctcctttgcgaatttctttaatacatactttttctgccactttccctatgttctaggccctaaaggatatgggtggcatcttattgctttgtattccaagcacctagcacagtgcgtggcatgtagttgttaccaaaaaaaatctgctgaatgcatgaacaaatgagcaaatgaatgaatgaaaactgtattgacaagggcactgaacccaaagcgagaataatgggcttgaacttagacactgtcgcttttgaagggagaatcagatttcaggacttcagtttcttcatctatagagtgattttgcaatgttgagaagagcaaataaaagactatatcaactccataaaataatgaggtgttgctattattatgactccatttacctctcgataaagtgctgtcccttattatccctgtttcatggctctcggtctcgactcccaagtagggagagtctctctggcctcagagagaggccagccagaccttatgttctcttgttttctcccacagggctgagagtataagctctcagtacacagaaatgcacgtgtcatcaataaagattttaatgattgtaaattacaaatatgcacactaccatgctagccaggtagagttcatttgagaagaacctgtaaattatagctttcatcattgatctcccaacacatgccacctctagtgctaagcactttacatatcgcattttatttcattcttatacttaccttctgtcctgaattctaaaaatatagaacacaataggagtaagaaaatgttggaaaaataaaattttgaggtgtataatgaagaaatatggcctagaagtccgtgtaagattgataaaaagttggtaatgacaaaatcctatcagtcaagtatccttctctaataaaagattaactaggtgttaaaaacactttgcatagtgcctagaacccaataagcagtaaataaatggctgctaatagtgttgttagactatactgattgaagaataggaacggggtgtccaatattttgacttccctgggccacactggaagaagaaagattgtcttgggccacacataaaatatactaacacaacaatagctgatgagctaaaaaaaaaatcacaaaaagaatcacatagcgttttaagaaagtttacaaatttgtattgggtcacattcagagcaatcctgggccacatgtggcctgcgggccatggttgaacaagcttgcattagtatatgcattttgttcatgagcaaacatagaatgcctgtaatgtatgcgtcttctctgaaggtactagggattcaaaacattttatgatcaattctctgttttcaggtatgtatgatttaataggagaaacagacagatgttaaaaaaacactaacaacacagtatagcattttgagaaaggagaaaatatcaaagaaataggaatttgggatagagagagattgctatggcctgtgtgatccaggagagcctcaagtcctaatcgttcttaggctaagcttgggtacaagtgtaaaatttaaacaagaagagtggtatggtgaggacactacaggcagaggaaacagaccaagaaaagacgaagtattctcatgctgaaggagagctgacttaaaacagtaggcagaaataaagttcgagagggtggagtggcttcattgttgtagtccttgaattcttcttcagctaaagaagaattcctatcttaaggagccaatgaaggtgttagaagagataatcaggctgtaaggatttattcaacacatactgtaccccgcagattgttcaagatgctgggcataaagcagtgaacaaaacaggcagaagccctgccatcagggaacttatattctaacacagagagttagacaatagacaatatatctgggaagcagccatatgaatatttgggtgaagaatgtctcaagtggaaagaacagcacatgtaaagactgttagacaggaaaagcttgggggtgttccagggacaaaaggccagcatgattggggcataaagaatgagttgggtcaagggagatgaagtaatggaagaagaaatgtccagatcacaccgaacattctggccatggtaaggaatttagattttactccaagagtaatgggaatccgtggaagatggggtggggcagagggggcatggcctgaagtgacttgtgcatttagaaggatcatttgggctgtggtgaggatactagattgtaggggaccagtacctctctcctggtgggacatgatggtgattgggatgtgagctctagcaaggagttgatgagaaacagacaggttgaggatatattttggtggtggagcaacaggacttacagagacctgaatgcagtccatgaaggaaagaaaggaatcaagatgagtccaagattttagcctgatatgccatttactgagatgggaaagactttatagaaaaagactgggggttggggagctagttttggtcacgtaagtttaagatatttaataggcatctaaatagaaaggcagaagatagttggatatataagtctggagttcagggaagaaactccagctagagacagatatttgagaatcatcagcatcagaaggatatttgaagctgtggaacagtctgaactcatgtagtaaaagaacacaggatgagaagaggacagatccctggggaagacaaaacagccagagagctaggaggaaaaattgagaagtgtttcaagacggagccaagatgctgctgagaagccaaggaaaataaggataaagaattggtcattggttctgtcaagagagaggtctgtgatgaccttgacatgggccacttcagtgcaatgatgagaacacaaatccattcaagtggactgaagagaagccaatggggagatgagaaagctgaatcttgatgggatggggaaatggagaaatccgatggaggctgttgggggtaagaggtcaagggaaaggtttttctggttaggttgtttgtactgtttttttaaaaaaatagaaatataacagtatgttttatgccagtcacaaggatccagtatataaggagatcttgatgatgtaaaagagaaggtaattataaggtgaaaacaagagggtttttgtcctgggttgcagcccagaacaatattgcagaggctatactagatagaaacttcatctactgtggcagatgggatggcagaatgtattgatacacatgcagtttggtttgtggacttgaggtggattgaaaaggtagatctaatttgattttgaatattttctttctgaagtatataggccagtcagtcatgagctagacagagattttggagattttaggagagagaagacaaaagatacaatctctcaaagagtgggaaaataaatttactatgaaaggacacttacatcatttggtggtgtcaagtgccaatttgacatctgtgattgtagctttgaagtgactcagtcaacacaattgtgtatgtttctcccagtagtcctcttggtgctgagtaagtgggcaatgggtttaaccaggattagggttttatcaggcatcagtggacgagaattgaaaatcttgtgaaggggatggtcagggaatttctgaattgtagactggagttttagaaatcagagttgaagaatttgagtgaggtgggagaagggttatgacgacaatgactaacacttattaaaagcactgtgcccatctcttttcatgtgataactcatttagtacattagaagctgcacagagaatttggggatgtgctgccttcgggagatgaatgacaggaggccagatcttataaagatgttagatttaaatggtctataaagcatgaggagattactcttgcaaattacagcataaggtgataggaagtctcaggtacctgctctcagtattgacattttgagacaacagtacatcatgtaaaaattattaagataattggacttgaagttatgtctaaaactgagttccagctctgccaatcactcagtatttgaccttggacaagtctacatctggcttggtctcagtttctttatttgtaaaaaaaaaaaaaaaaaaaaaaccaccacaaaaaagtgaagataaaattacatggtgactatgaaaacacctagcaacctgttaagcccttaaatatagtgttgagtgtgactgttacagttgagaacagagctgtgcggcggaagattattttgacaacagtgagcatgattaattagaataggaaagactgagagcatgtaagtgtttgaaaaaaatcaaaaacagcccaggcatagtgggtaaggacccaagctaggctgcaacaatggaagaagttcaggagaaattatagagaagaagcggtaggatttgatccaagtacaatctatcatgtactattccagacatgactgggcttaaatgagctactctggacccagcccagttgcctggttggctaataccagtggccaccaaggactagctctggggatgatgtggaatgggaattaagagctccggtaaaggagtaggacctaggttcaaataccagctctatcagctctgtgatcttgggcaagttatttaatgtttgtttccttgtctataaaaatagagacactcatacatatcccatggtacatgtgaacattaaatatatgtgattatatatgtcaagtatatatgtgacatatatatatatcactcacagaactctgggttctgtgagtgataagacctctgtaacaatggctgtaattattcacattagatcttgaaactatcccgaaagcaatgaagcccattgtcccaagtggcagtacagggaaggattatttccaggaagggatttaatgagagaccagatcaattatgaaagatggagtcagaaatgactacaaacagaagccaggatatacctaaccttcaagtctgttgtcagcaaagatacatccttctccccacagactaagtttcttaggtctgactcactgtatcacttcctgttttcctctgtggcttactgctgccttcagtggcaaaacccaagcacacttctctgatatttttgctcagtgatgactttcgggagccaaccacttgtggctttttttttgcaacacttgtcctgtgaatgcaatgactgcctatgtttgatggaaacaaagtggctaaaagcagtctctttggctgaaatgttaaagccacacaggccatgtgagtccaaaggagaccagcagcctagaatgggtaactcaaaatataacatcttcccaagtctcaggccccaggagggagagtgagacagctcctcagacaatatcatgaacaggaggaagctggtacattaagcttctttctcttaaaaacctaaccgtgtacctggtggaccctccctattgattttaaaagaaactaataaggagtggagtggagcagaaaggaccagaatattctcggctgctattgggaagacaaagacatgcactgcatatgcacagaaatatgactgtaagtgtcaagtttgaagtaatgagaccagctcttgtgtttggcctaagaactctgtctcactacgttctagaatttcacatcattcgccaataagtaaaattggatgtcaggatttctctataatatttcagtgaagttaaacagatcataccctttggacagtatctcaggatgggcaaagttatgctggaatataaaaatctgattggcttcatacaacaatggcttatttcttgctatccaagtctgcagagcaggtgtctttcctgggagctgcccttcatgtgttgatgcaatgttccaggctgcttccaattcacatctgctatccatatccacacatgccgctatgagcacagtggtgggaccaagggcagtgtcgggggagcccttggagagtggagcagcagcaccacactataaactttccccagaaagtcatatagccctgagtaacttcaagggcaagagagtgtattcctctcctgtgcctggaatagaggtgaacagatacgttacagtagtcatggccattacccatagttctttcaacaacccagttaccagctatcattttaaattttctttgtattatccctttaaggaaaatcaaatgaggactttgaatttgtataatactaaacattcttcgaggactttgaatttttataatactaaacattcttcaaggccttttcaggtttcttaaccaatattacttccaaactttaaaatacatagtttgcaaaggaagcttttttagagtatcaaataaataaaactttcattattgaagaagtagtgtcactcccagctggaatcttcccattagacatgggccagctctctgtggttagatcctgttaaagcaatggaccttttgcgcacccacacctaaacctgcccaggtgggataaaaatagtcccccactttgacaattttaaatgcagagaaaaaagtgtttttcagtaaaaattctagcctatttctgagctctttcatcatgggccatagtaagtaatagctaagagttgttgagcatttactgtgttaaagtggtgagtgctttgcacgcaggtctcatttaaattttataacacagatacacttctattatcccaattttacaccaaagaaatgagcttaaagaggtcccctaactctcctactccttcgcaaaccaaggtttggacccagatcatccgactctggagcccttcctcttaaccattatcctaaactgcctcccaaatattcttgaaataagtcttaagggaagtggagcaaatgttgcaatctccatataatcaaatgctcctgaaaccagtgccctgaccagcagggttcctgtgtggctactcaatcctggagaactgctgccattgtcccctgccctgtatttccaagttatattccaaccctagagatcaggcatgcggatggaattctgatttctgaccctttcattaacaaagcactctgcatgtttcttgtgtcttccagttgaccgtcctccaatggaaccctcccagtatgtctcagttgtccctaaatatccagacaagatgggatttgatgaggtaggaaaggtgtctatatgtgtgtgcacatgcacgcgtgtgcaggcttgtgtgttcattttggaacacaagcctgagcttgcatctgagagccagcaagactggcttggctgctgaaatggctctgaggtcttgggaaaactacttggtttttgttgttctcagtttccttatcttaaaaaaaggagtatcatgataaatgtagttaatcatttacttagaaagaaattaccatttagtaatgaaagtgaatttgatattttctaggagcagatattgtgatatttttaatcaacctttttatcaaaattcaagagtaagatacagaggatacatgttttagatatggaggactttaattttattctgccacatctgagcaagtggaaactattctggaactttctgtgctttcttttatttctactattcttccatggaaaaaggttagagagcagggttgagaggacaaagaaagaaaaaaaaacatatttgttctaaaattctgcctttcagcaggcaagaacttcctaataatattctaagggtagtatttattattaagttttagttgtataaagaatgaagcagaaatattaagaggttcccctcctggtaatatgcgtaacagatacttggcagggattgtgactccacatcactgactctctcatgggtgtcccctgtagctgctgaacagtattcagaaggagcttggtggtctagaagctagggcagtgcctcaggagtccacaaactgagaactcttccatggactctggatatgtaacagatcaggcttcgagcttggtgctaattgccactgattaatcgaaggaagatgccttatttatcacatggtaacatatacatacatatatgtacatgtccccagagtacagccttctcaaagggatttgacgctagaactgggaattaagatttcttccgtaagactgatttggagctatacttcaggaagggggaaagaatatttcatgattattaagtggggaagagttaacagctactatggtatttccacaaagggcagaatgagaagagatgagctgcatgtagtagagaggaataagactcatttgcaaatagtttttaaaaatgatcagggctatagagaaggttgtcccacacccacagtggaccagcttccacatgttactgtagctttccttccctacagctctctctcggttccctaggtgaaaggacccaagtgtccttacatagattcatttctcctcctaaaaacattcctatgaggaccaaaccaaagcaaataaaataagacaaaaccaggatcttccagttccggtcttctttgggcaggacacggtgtaaggactgggtcactcctagagcccttcaggagaaggccaactccatgaagtggcacaggctcggagactctactttcctgagtctgaggttagtcacctctccgtatggaacagagatagcatggtagaaaaagggcttttcaggggcttttcaatcctcctcggactctgtgacctcactggtggtgtctgggctgcatttggctctgatgctcttttctctgtttactgttcactaagtgtgagtgagccatctgtgtttttacttcgtggctacagttttattgcacttgtcctggcagggactggaactggattgttatttactgaaagtcttcccagactggaggtctctgtttttgggggcctttttggatttatttctgttgattttttgttctgttctgtttttgttctcttagagtgacctcaggtggcttcatgtttatacctgagaaaatgccctttcctttccatatctggaaaattaggggatgaggcatgacccatcacagtatgattctgactaaaagaacacaacccattaagttataaagtcccaagtaatgaggcaaatagagtcaccacagaaaattatgttttttacaaaataattacccagttaggtaaacaaggaaggtagtaaaattaggatgcacttaatctacttggccctaaatcaggtggacaatttcttcaaagggaatatcttgctcctccatcagtttctacacccagggatttataaatggatagaaatgagaatattttgcaaggaagggttgaaattttagttagtgtagcttttaattccagtgaaacatatatttatgactgcattcagaatgaccatgtgaaccaaaccttaacacagtacaatctgaactccagactggttctaagacaaagtttctcctttattctggccatagcagaaagccaactttattataaaccacctgtcttaaacattttaatctgtactgaatttgaaagatgagtttgtgcacctccctatttttatagaactggacccataaacattaatgtctcctcaaagtcatccagatggttagtcaggatgaagtcaacaccacctgacttgtttctataggtttctgctttaccatgctatgtgtcatcctcatttctcactggcagttaaagtcactagtttaacatttaaaatgagtttcttactatttgtagcaaaaggaccttattaaaacattgatttacgtgtaaaggcattcacaaagctttagatacttctatggttcattaagtctgggaatagtgaggacatcctcattatctgtaactcttgttgtccttgttgaaaatgagttggctgtaaatgtgtgcacttatttctggttctctattctgttccatggtctacgtgttgtctattcttatgccagtaccatgctgttttggttactatagctttgtagaatattttgaaggcaggtagtgtgctgcctcaagccttgttctttttgctcaggacagctttgactattcagggtcttttgtggttccatgaaaattttaagatttttttctggttctatgaaaaatgtcatttgtattttggtagagattgcactgaatctgtttatcacatttgatagtatggacattttagcaatattaattattccaatctatgaacatgggatatctttcttttcttaatatccttccatttttttccatcagtgttttatagttttcattataaagatctttaccttctttggttaaatttattcctgagtattattaaatttttttgtagttactataaatgggattgctttttctatttctttttcagattgttgttagcatatataaatgctaatgatttttgtgcgttgactttgtatcttgcaactttactgaagctgtttatcaattctaatggttttttggtggcatctttaggtttttctaaacataggatcgtattgtcctttgacctcttaaagagtagttttttaaactttcctatttcaagagaagggagaacatatttatcaatgaacatcagaaaaacaaagagagttaagtcactacgaagagttgagttttgaaaataattcagtttgaattagtatcatttaccttaaacactgatgtgagatagaaatgaattttcacgacagttcttcctatcttttccactccttcttctatctaaaacatttactaaacttttcaaacagcctaaaagaagacttgagtaatttatgtgtcttttcccttttccttcttgcattagattttcatgataaacctcaaacgcagaaaggacaggcgggaccggatgctgcgcacactgtatgaacaggagattgaggtcaagattgtcgaggctgtggatggaaagtgagttgggtttcttctcccattgcagatgtgattggagtgtggatgtgtcttctctgacagagagttagtcccaggtggggctctaagtctcttcggtcattagaggatagtcttattttcaaaacggccacctgtagtagcatttaagttaatttcatcctgtagagcaggcctgaaatccactcaccagccagtggtctttggtcttcattacactgaaggctcacattggatgtgattgtcccgtctctgggggttcttgcaacagttgtggtggttttcagccttctgtagtgtaacagaaggaatgtgttcagaattgtgttcagagctgaattagagcataaagtgctgaaacttggtcaatctgaagaaaatagatggaaaatgcataaaggtgtacatttcctgttgcatgagatgcctgccacaatctgcctggaccgatcatagtggccacttttcctggaaatatggcaggaaagtaacacagggaacctagttagatcccttctttttttttttttttattttgttcagctttgcccttttatttgacaccctaaactatttcaaggcatagatttttataaaatgtgcctttccatgttatatgttggtttagaatatcagtagctttgttttctatttgcataactccaactaaggagtatggctagcagctgttgaagtttttatgactcccttagagaatctcatcagtgtttcccaaagtgtgacctggacactcacatcagagtccccacggatggttaaggggacagctccctcagtcccatctcagacctgctgaattatgctctctgaggctggacccaggatctgcatttaagaagcctcaaggtgattcttagacaggattgccccataaaatactggatagccagttaaatttgtcccaaacatcacatggggcttggttatactaaaaaattatccattatttatctgaaacttaaatttgactgagtgttttgtgtttttcacttcctaaatctgtcagccctattcttgggtgcagtagagtttaggaaccactgcttcaaatacctccaagaacaccagtcccattcatagaccacatggaccagggaaactagttgagtagtgagagttctttatatatcctggatgcaagtcctttatcagatatgtaattgtcaaatattttctttaactttatgcattattgattgtcacaatttcatgatggtatacattgaagcaaaagagtttttcattttgatgaaatccaatttattttttgttcttgttgctagtaattttagtgtcatacctaagaatccattgtcaatttcaaagccatgaagatttacttcatgaaattttcttctgagagttctacagttttatctattacatttaggtatttgatctatgttgagtaaatttttgtatatggcatgaggcagggatccatattcattcttttgcacatggttatccatttgtcccttcaccatttgttaaaaagactttcgtttccctcgtagaattgtcttggcaccattgtaaaaagccagttgcccataaatgtaaggatttatttctgaactctctattttatttgattgatctatatgtctatccttatgccagtactataccgtcttgatgactgtagctttgtatttaagaagtatgagtccttcaattttgttattctttttcgagtttgtctcagctattctgggtcccttactttttccatatgaattttagaattagcttgtcaagttccacaaataaagaaaacggcagctgggattttgataggaattgcattgagtctgtagatcaactgggagaatatttccgtgttaacaatatgaagtcttctgattcgtaatcatggaatgtctttttattatttagatcttctttagttctttgaatgatgttttgtcattttcagtatacaagtcttgcatttattttgttaaatatactcctaagtattttactcttttgatgctatggtacatggaactatttccttagttctattttcagattgttcattgctaaatgaataagaatacaattgatttttgtatattgatcctgtatcctgcaaccttgctgaaccctttttatcagttctaatagtactttttcctttgtgtgtgtatattccttaggatcttctacatacaagaccatgtcacatgcaagtagagatagtgttatatgttcctttcaaacctggataccatttatttcttcttcatgtccaactacccttgctggatcatcaagtacaatgttgaatagaactgttgagtgcagtttcttgatttgttcctgatcttagagggaaagcattcagtccgtcactgctaagtatgatgttaattgtgggtttttcacagatggcctttactgggttgaggaaggtcccttttagtcctattttgttgagtatttttatcataaaagggtattggattttgtcaaatggtttgtccgtgtctattaagatgaacatgtgacttttgcctgttaatatggtacgttactttgattggttttcacatgttaaaccaaacttgcaaccctgggataatcctgggacccatttggtcatgctgtataattccttttataaattgctggattctcttgctagtatttgcttgaagatttccacatctatattaataagtgatattggtctgcagttttcttataatgtttttggttttgtatcaaaataatattggcttcataaaatcagctgggatgtgttccctcctcctctttttttttggaagtttgtgaaagattcgtgttaacaatttttaaacatttggcagaaacccctagtgaagccatctggttctaggcttttctttatggaaattttttttattactaattaaacttcttttcttgttatttatttactttctatttcttcttgagtcaattttggtagtttgtaccttcctatcaatttgtccatttcatctaggttatctaatttgttgccatacaattgttcatagtattatcatataatcttttttactttcataaggtcagtaggagtgacccctctttcattcttgactttaatagtttgagtttacttttttttaattcatcagtttaggcaaataattgtcaattttgttgatcttttcagaggactgacttttggttttgttgatttttctctattgtttttctattctctagttcatttatttgtactgtaacctttattattttcttcctcctgtttgctttgggtttaattttctctttatctagtttcttaagatggatgggaggattattatttgagatattctattttactagagacatttgcagctgtaactatatctccaagtactatgttaagtgtatcgcataagttttggtatgctgtgttttcattcatctcaaaatattttctaatttcccttgcaatttcttctttgacccattggttaggagtgtattgtttaattccacatttctgaatttcccaagtttcctttggttattgatttttaatttcaaaccattgaggttggagaacataccttgtgtgatttcaatccttttaagtatactgacacttaatttatgacctatatggtctttatggtctaaaaaatggtatttcttagagaatgttctatgcacacttgaaagtgtgtatttggctattgttgggtggaatgttctatagatgtctgctaggtctgattattttaagatattattcaagtcttctgtttccttgtcttcctcctgcctagttctattattgcaggtgggatattgatgtcttcccctattattgttgaattgtctgtttctcctttcaattcttccagtttcatggttctgaggttctgttaggtgcatatgtatttataattgttatgccttcctgatggattgaccttttttttttgagatggagtcttgccctgtcacccaggctgcagtgcaatggcacgatcttggctcactgcaagctccagctcccagattcacaccattctcctgcctcagcctcccaagtagctgggactacaggcacccaccaccatggccggctaattttttgtatttttagtagagatggggtttcaccgtgttagccaggatggtctcgatctccagaccttctgatctgcccacctcggcctcccaaagtcgtgggattacaggcgtgagccaccactcccggcccagattaacctttttatcattaaaaaatgtccttccttggctctagcatgaattttgtctgagatttattttgcccaatattagcatagctctgccagctctcttgtcattgctgattatatggtatatctttttctattcttttactttcaacctatttttgtcttttaatctaaaggctgcctcttatagataccacatggttgtattaatttttaaaacttactatgccaaattcttccttcattgcagtgttttattcatttgccttcactacatttttttccagatccttaaggtcagccagaggtgagagactagggacttctcaagtttttcctgggcgtgtggacagccctgaatatgcctggggccttctagattctcagggatattttggagcaaatcaaactccctatggacctcttattccttggtttttccttttaagttttttggtgggcttcttgttagcatcagctgataatgcttctcaaacagctgtaatgttaaacagttgttgctcatgggttttgacaaatgacctgcagatagtgctgttcacagaaaatgaactctgagtcaggtcaaatcaagacaagctctgagaatgtagcttttcaaggagctactagacaggttgaatagagattattttctgggggcaggtctttaagggagtctcagtccattttgtccctgccagtggcttctgggttggtggggtttgccgctctcttagttgtgaggctactggttttcaaggcttttgtagggctggggtgaacaggttaggattagggcagctgtgaacttcacaaagctcactgtgttaacagagattcagcagtaggtcttgatcaaacactccttggattattgcagtactttaactaatttccataggagtgtacttattaaatcttgtcaaaaaactgatgatgcttagaactatgttgggcactatgagggatacacaaaaatatgataccctcttgtcttcccagacctcataatactagtgtgacacattagcctggaggaacttctaaggaataaagggaagcctctctgtctttgtctgtgtgggggaggggtgtttgcagaactaactctctctttctctggcctttgtggtggggacctttgacttgttaatctccagacgtgttttatgtgatgcagggcactcaacacaagccagctgaaggcactgaatattgaaatgctgcctggctatcgagatccctattcctccaggcctctaacaaggggtgaaatcggctgctttctcagccactactcagtctggaaagaggtaaataatgctttattcagattgcagttttatgatgaggagaaaggaaagcaggctatcgtaggtgagttagggccagatgtaaagtgagcccgcaactgttctggaaatgtgcatgagagctgctcctgccttgtgtctccctctgacccaagaccagcaacaaaggggcaaggaggagtagctttggtgccacttggggtggtgacgggggagacacccatgtcctgtgtgccacactcttattaattcattatcatcattagcaggaatgccttctattatacctattatgacatcacttattaagtgattttatacaagaaatcacacagaagtcatgtgaggtgggttgggaaggacagaccacctttaccgaagaagaaattattaagtagcttgacccggtaagaagtggcagagccagaagtggaacccctgtcttacagatcaagacatatctggagcagatattggtgtgtggggttcctgataaacagtcagtttccacaaccaaaaagaaagtccctgaagaaaggccccttgaacactttctcttttaatgatccagtctatgcctgcctttgttttctttaaactttaagtgaaatgtgataaataggtataaaaagatatagatcaaaagatacagctcagggaaatttcacaaaccaaacaacacacccatgttaatcagtacacagatccagaagcaggtaaccagcatcccacaagcacccccccaccccgtactgccttctggtcatcagtccccaagggcagtcaccatcctgacttctaaaggcattgaatagctttacctttgtttgtactttcccttatatgaatggaatcatgcagtatgtgtactctcctaacatgacatttaggagattcacctataacgttgcgtttaattgtgatcatatatcctcactgctgtgaatattccaaagtttattatctattctactgttgatggccatttgcttagattccagttatgaatctgtgctactagactcgtgactttttaatacttatttatctaataaaaattgggtttcaaacttttcatagggtatcttcctactgatgacttttgcaggtaattgatcgagagctagagaagactcttgtaattgaagacgatgtgcgttttgagcatcagtttaagaagaagctgatgaagctgatggataacattgaccaggctcagctggactgggaactgatgtgagtgacaagatgatcttacgagagggctctgagaggcactcagtcctttccaatgcgcagagagccccacctccacagccagtaggagatacagcttaagcttccacttatctagttttctttccataaatgttctcagaaataaaaatgggtagaggttagccactggattttgcatccttctactcttcagggtgggaaactgtggaagattgtctgagacctggagtcggcctgcagatcagggaccttcagacagaaccaaggtgtggcactgagcacttacttaggagcacagcagaaatcccaccctcaattaacgtggcacatggagtgggtgtgaagctggagaagaggccatttattcaagctctaaagtcctgtgtcatatttaagactcagctcccgggacagcaggttgcctctgcagcttccgagaaggtgggaggttagagggtcagccagggagctcctctgttgggaaatggggctgcacaaacatgaagaacatggacaactagatttggggaagggtctgaggctgatgcaggaaaaccaggctcaccaagggagtgctggctctgagctgacatttagttaatgttctttgtctactctctgggaattgagtggcttctgcttttttcttcccttccctttcatttttccttcccttccctttcatttttcctctccctctctcccttcctctttcctttttcttcttcctcctctgcctcctcctttctctctctcattttctttttaaaacaaatgacactttcaatttctctccaatgaagcagaaagttcccaagcattgtgtttgctcccagctgtgtgtcaaaggcaattcatcaactctgagcctgcttctttggagcagctgcagcagaggagctgtccctgcttctcccacccacaggcggtatttaactgtgggcccaggtggaatacttgttccctcagaaaatgggccactctgagctcagaagaaacctagcaatggctcaactaatgcgtcactgtgtaataagacacctatgccctgtcagatttcagtcatgtggtcatgtggtttggtttggcattctgcacagtcccttgagatcactgtttcttcctatatcctccagaagtcgctgcacttcagcctttctcaatggatggctccgcagcctgtggttaaggcctcacaggcctggaagctacttgatgtccacgtgacttgtataaaggcaacttcacttaagcctcataatcacagaagactgagcccagagaatctaaggtttagagctggcatacgttcccgttcacatgtagttcggtgggtgcatttctcaggacaaagtaccgacagatgcaagaaggaagaacagttgtcttgataaggatacaggaaaaaaatgttttctaaatttcacaggttgatcaagtcaaaatatccccttaaaatctattatatagtcttaaagaactgtaacagttttaaattgtacctgttattttctaaaacaaaaaagaaacaaatgttacttaaacctaaaacatgaaaggtaataagctgttcatgattgccacattacatctttccaggaaaagaaaataataaaagggaagaatagaacaagtcattggaatcattgagggagtgttgttcaatagaaatataatgcaagccacatatgtcattttcagttttctagtaatcacattaaaaaggtaaaaataaattagactaaattagttttaatacattttatttaacaaaaatatccaaacagtatcatcattttggtatgtaattaatattttaaaaccattaatgacatagtttaccttctttttttttttgtaccaactcttcaaaatctggtatgtattttacacttagaacacctctcaatccagaagctaaattttcagctgtttaagtaaactgggctgggcgcagtggctcacgcctgtaatcccagcactttgggaggccgaggcgggtggatcacgaggtcaggagatcgagaccatcctggctaacacggtgaaaccacgtctctagtaaaaatacaaaaaattagccgggcatggtggcgggctcctgtagtcccagctactcaggaggctgaggcaggagactggcatgaacccaggaggcggagcttacagtgagctcagattgcaccactgcactccagcctgggcgacagagcaaggctccataaaaaaaaaaaaaaagtaaactgtcgtcctaccaaaacaatgaacttgtttcatggaaaaaatatatatatttcacacagcttcaacatttaaaattaaattaattaaagttagagcattaactcagcacctctatcactctagttcctctcaagtgctcgataagagtttcccttccactggatgagacacgagagaagctcagactccgtaatctgaagagagagtggctggggatatatgtttgttgttctcagaagaactgaagattgaacatagacttgttctacaaatcctgggatgctttcacaagggggaatcccttgaatgttgaaagagattgttttagggcaaaatagaggaagtactgctttacctggcaggcaagaaggaggcaactcctcaggttgctccagtcaagcccaaatcaataggttccggacaaaagtaatggagcacagatccatgggtagactagggaagatgggagtggccaaaggtgcatcctgtgttgtagaagttgttcacggaggacggaaggtgcctggggggcctttctcagagcagcatgtctgggaggaagcctggccacagctggacgagtgtgaggcaggagaatgcctgtcaggagctgtcattcatcctccccaaaaggaaccccttagggccactcttgggttcccagaaccttcactgcagactgactctttcccccagcttatttggtcctgtgtttcccaccagcactcggagtgctgtgcagaaggcatccaaggctgacactctggggacctgaagacagcagcctcaggattctcccatctggcctttttttgtgcctttccaacctctgtaaacacagctggaagccccatcccatctttaagaaatgatctgaaagatcttttaatcttacgacatcttactttccgtcttgaaaaccgtccactaggcaggaatagtgggggtgttgataaatggagctagcaaaatggccccagtgatggcagatggcagtcctgactggcgattggatccacttttggatgtgatacatcatttaatgacagacagagtcagtccaggatttcagaggtatctatgtaaaccaaagctgtgcttcatccttatcatggcataatagtcaaggtggaatttttctcctctgccatttccttacagttatattggtaggaagaggatgcaagtaaaggagccagagaaagcagtgcccaatgtggcaaacctggtcgaagccgactattcctactggaccctgggctacgtcatctctctggaaggagcacagaagctggttggagccaatccttttgggaagatgctgccagtggatgagtttctgccagtcatgtacaacaagcatcccgtgtgagtctccctgaactgcctgccttcccttgggcacagcctcttcatgaattatgctctccatttctggtagtacttgatattttctaaagttgtactgctttcctaaatgatcttctcataattatgattaagagagcctaactcaggtgatttatccctttgtacagatgggaaggtgaggcagagatggtgagtgtcctgcccagagattcttgtaatatccagtttgtagttgaactgaatgtaatgtgcttggtcccctccttgtctttgctcttcttatttccataacctcatacacctcaaggtgaaggccatcttcctaagcacctcaaaatttccagttcctttggctcaggtcattgggtactgttggctaagcagagatacccatttttgcatagctcacaatctggtcaggaacccagactcatgaacaaatcatcatgatatattgtgattcctgcaatcgcaggggtgtgtaagaggttcagggagtgtggacctgatacctgagcatgatgtccatggaagaagggcagtgtgatgcttggggctcccatagcccaggagcttaccctgacctagcgcttatcaaaaggtgtggcaattaatgatttacctgtcaatctccccaataaactataaaccctttggggcagtaacagtcttatgcctctgtgtccttagagcctagtccaaatgctacacataacagcagctcctaaatcattaatgaatgattcctaaattcattgatggagcagcattcgttctaaccttggccccttctctcagttgctgggtgatctcgtcactagatggtctcattttagctgttgagatttcctgtgctgccaccagttcattttgtctcttgtcctcagtaaaaatggagttgtgtgccctcttgtatataacatgtcagagactgactttatctctgtgtcctagcagaaacatggaggtcaaaccattatcccctaaacaaaagggaaattactacattcagatgtcacctcatgtactctgcacaggagccctgagagggaggccaagtcatccgtctcctttacacctgttggaaccggagtggtgagcagggagctagagcacaaagccaagcctgcgtgcctctaagcctccacgtgccacatgccccatcactgctgtccagatgtgaggtgtctcatttattaatcccaaagcagggcatttttggtgaagtgatcgtatttatttatcattatggtctaacagggcttactttttaacttttggagtcagacctgaaattcatcttttaaactagtctattcaaatacgtcagaaatgtcctgatctttttgcttgggagcttgtctttggaaagcttttaaagaaatatttgtgtttgtaggctaaagtttttcacaaatgacacaattgaaataatgaaatgaactcatgaggtaaccaggaggcctccttcactctttgtccctgttccgtaagtctcctttccgccccctcatgtgtccggccaccttcttgttttcagagccgagtacaaggagtattatgaatccagggacctgaaagccttctctgcagaacccttgctcatctaccctacgcactacacaggccagccggggtacctgagtgacacggagacctccaccatctgggacaatgagacagtggccaccgactgggataggacacatgcctggaagtcccggaagcaaagccgcatctacagcaatgccaagaacacagaggccctgccaccgccaacctccctggacactgtgccttcaagggatgagctatgaaggctccctgggagtgtggcccacatcagttcaacatcctctggtttttctaaagggctattcatctgtttgctccagttttctgttttgttttgttcttagtggtcacagtcatctaaccaaagtgatctagtgtgatagatcgaaattaacatatttttgaccatggaaggaaataaggaaattcaacccaaatttcccaagacggctgaaagacaggttttttggaaactgttaagataaactgtaatccagacacctaattcttcagttcactactcatgtgatactgattcccacattaaggttgaacaacatggctcagagtcttgttcaagagaaagtgatcaccgagctgtcacatcagcaaatatgtagtcaaggcagccaggccaactagaccacacttattggtctagtttgtccgttttatatgacattgaaaacttgtgtgtgcaacttttgggggacaggaatcacttaaaatcatatttatttggctttttatttaaaggattctgtcacaagtcttattgaaaagtagattttttaaaaaaaaaaaatcttagtccctgttatccagtaggggtgggtatttgggtccgactgagacttggcctgtgaccatcatggcagttggagttctcatatagaggtgaccagtttgccatgtggatataatttagtagatatttgacagtttgtgtaggtatttgagggaaaaaactcaatgtttggcttttttattatggccactcgagtcaggatgctctatttataaagataaatgtaatatataaagggtgaggactggctgtgcatcctgccctgtcccgggtttgcgcgctgctacagagcttcacgctctccgctccaccccttagcctgggaacccaccgcaggtgtgagttctgtgagtcactgctaagagacagagcacattttcaggccagcaactatccttgccagagttttttcattatattttgaattatttattttacaaaatgggcgaagatattgtctttaggataaggcagagaaacagatgttgcagacttccacggcacccgggggagtggtgggtgtggacacattggttcggcaatctgattctcctgaatttcccagccaggctcttgtggggaggcctgtggatggggggatttgaactatttggaaacaaatgattctctatctcaggtgagaaacctggtcagaaacaaagggctggtcacctgatttaggccagcaaccagggaagctcttagaatcccaggcggacaccctttctcaaaagatatcccctaagagtcctttctgctttcttcacagattgattttatgtaaaatgcagagttggactacacgatttcttcccactccacaatctgtcatcctagtatagatcatggtggtttccctcaagtttatgttctcatgccctcaatctgtaaatttttgtctccagaaaaaccctcccaggcatcccataccagcaccgttcctcatcactgtccatgcaccatgcagccatatggggggccgtgcacaccccaaaccctgagcttcacacttaaactcatggggagggcccttcagagcagagtccacaggcgggtggtgctacatacacaagcttagtgtacgagtgtaagatacactttaagccagacacctaattcttcagttcactgcccatgtgatactgattgccacattaaggttgaacagcatggctcagagtctagagaaagtgatcaccaagctgtctcatcaccaaataggtagtcaaggcagcctcatctccccaggtgaggggcgggtccccactttaggacaagaggcagcttgccttccaccagacgccagcctcggccttccttcccgactcactgtgggtacccttctacactgaccagcaagctaggccgctggaggaaagggaactcacccaactctaaattgtgccgcttagacttagctgtcagtgtgacttcctttcccacccacccccagaaaaacagaaagagcatctggggagcgagtgaaaattccttaggtgattcctaagatttccttgggtatctggtttttgttttcatatttgagtgtgtgcatgtgtgcatgactttaatgacttttttaatggggtgggaggtggctggggtgctggggttgaaggaagtttgggttgatttttgtggtgttttgtttaatagagaattttttttttcctgttcccctgtcagctggtctgacagatttaagaactctcattcttaaaagactttggacttaaattctagcattttagactaggactgttctactgtgaagaaagttctgtctcctttagcccggtttgtttctccctgctcaggtctagaatcccaagcagtgttcttttctggtgaacactgtgagccgcagatgtgactttttttttaaagtcatctcttcagcaatccagaggttccttgacctcattatttgtcctatctctcccttatagtcctaagccaagacatttgacctttgacatttgacctttgcagtgtcatgtgagggcgtcagtatagaggcctttgcatctgggcctggcacccgctctctgcctctggaggctaaaccctgtctggatttctcttgggatctaacgtgggatcttctggacagacaaccgtgacatcagcagtgctggtgctgctgtgtgtggactgaacacctgcactttgcagaggacacgctgcatgggccccgcttgcggttcattcaggcctgctgcaggagctctgagaacaagaaagagtggacacccgttcccctgcatcatctgtcttgcgtgctatttcagagtggggaagtgataaactatttgccttctggagctctttgtgaaaaattaaaaaaaaacttagctc

SEQ ID NO: 37344 - DNA, 91181 bp, Homo sapiens
cggccgcggtttccaggaggaagcaaggatgctttggacactgtgcgtggcgcctccgcggagcccccgcgctgccattcccggccgtcgctcggtcctccgctgacgggaagcaggaagtggcggcgggcgtcgcgagcggtgacatcacgggggcgacggcggcgaagggcgggggcggaggaggagcgagccgggccggggggcagctgcacagtctccgggatccccaggcctggaggggggtctgtgcgcggccggctggctctgccccgcgtccggtcccgagcgggcctccctcgggccagcccgatgtgaccgagcccagcggagcctgagcaaggagcgggtccgtcgcggagccggagggcgggaggaacatgacatcgcggaggtgaggagccccgaggggcccggcgcgggcctcggcccggccaccgccgcgttcggttagccccgtccggaagggggcgccccggccgggcttcgggctcccgccccgggtcggggttgggggccggttccctcctcgtcccctcgccctccaggggccgggggccggccccaccgcgcccccacccctcgggtccccattcatttcctgcctccccgagttccggctgcggcagccccggggatgcccgtcaggcccggggcaggtagagccgccgagggaaccacgggtgccagcggccaggctcagcgccgcattcctgacccattgcctcatgagaattgcctcatggtgattccgaaataaccctgctcacttggggaggctccttgggacacgagaggggagttgcgcggggccgggcccccagtggtctagtcgttctggctcactgtgccactttcgtgcatttggggacttcacgcaggacccctgacccttttatatgcctctttgtgtcttcttttcctcctacccctcacgtgccagaaatggaaaaactgactgtatctgcagccactagaagtatttccttcctctgcgatcttcgctttgggagatggaaaggaagggagccgcatctcgttatttaatccttcactgcaaccttaacagtcaggtcactttactggtacccgttttatggatgaggaaaccgaggcccagaagcaacatgctagtaaatgacaagatttgaaacttaggaggattagtgagttaatgagatcctttgaaaggtcagggtaatactactactaatagctaacatttgcttagttctgaccacagccctatcagatggctactattatccccattgtaaagatgagtaaaccgagtttcagaggttaagtaaattgcctaacctcacagctagtaggtggtggagacagaatccctacttttaatcactatgttgcttctattattttgtaactattgctaaccatttgtaagccttaattttgttgtcaaacagtagtgtgacctgttgttttcagatagtgatcctgctattttgtatagtcactctatataccactcacacttaagacccattgtctattcttttccatgattgttcaattatggtcactgtctcagacatttaaaaaacgattcaagctattgaggctatttgaatgagattttcttttctttttttctttttttttttggagacggaggctcactctgttgcccaggctggagtgcagtggcgcaatctcggctcaccacaatctccgcctcctaggttcaagcgattctcctgcctcagcctcccaagtaactaggactacaggcgcaccactatgcccggctaatttttgtatttttagtagagacagggtttcactatgttggccaggctggtctcaaactcctgacctcgtgatccgcccgccttggcctcccaaagtgctggaattacaggcgtgagccaccgtacccagcctgaatgagatttttcaaaatattaggaatgtctcctccaaacacacctggcatgttattcatacatggatctggaatttaaaaaggggagaaaaagaaaactgagaactcgtaggaagtgagtgacttggacaggtcggttggcaagtgcttacagatctgggtaatatataactgcatttcaacagaacagtgtatagcctcaaatgttctaattctttagggagcttttaaataaacagttgtctattctttaatctgtcaaatagtcattgagccttttgttcctggtgtctgctcttccagacaagtaaggatctgctgctttaggagacatcagacggggctgggggttgggaaaaggtctgggtagtaatagaccctacattgtccagtttgttcatttagaagcatagaagtgtgggcatagtcaaagtagcaagtggtaaagatgacagtttgaaatggagtaattccttctcccctccagccctggtattatgcaccacccaaaaagccgggttatgaacataatacacataattttgaatgattcattattttttggattataagcctgttttatttgttaaccagccttaatgaggtataaatgacatgcaattaattgcatatatttaaatgtacaatttgatcagttttgacatacatatacacttgggaaaccaccaccatagtcaagataatgaacacatctatcacccctggtaattttgccttatgttctttataatccttcctttgttcttaggcagccactattctgctttctgtcactatgtattagtttgcatttcctagaattttatttttaaaaattttaaaattgtttgaatagagatggggtctcactgtgttgcccagggcagtctcaaactcctgggttcaagtgatcctctcaccttggcctcctgaagtgttgggattataggcatgagacaccctgcccagccctagaattttattattattgttattattgtgtttttttgagatagggtctcactttgttgcccaggctggagtgcagtggtgcaatcactgcagccttgttttcctaggctcaatccatcccccctcctcagctttccggttactggggctacaggtgtgcaccaccacacccggctaatttttgtatttttttatagagacagggttttgccatgttggccaggctggtctcaaactcccgggctcaagcgatcttcctgcctcggcctcccaaagtgctgggattacaggcatgagctattgcgtcccgccttcaaattactttaacctagtattaattcattcaacaggaagttaatgagccaggcaggataaagcagtaagataggaaaatattgctattttcatggctgagagagagcagacaaacacatgactaaatagggcaatttcaggtagtaataaattctaggagggaaaaaatcccacagaaatgtgaggatgggagaatgcagttagttttgataggtggtttagagaaggtgatcgtgtgagctgacacctgaatgacaattagtagtctgaattttgttttgcttaattatcaaaataactcctcttgggttcggcttttatatgcatccagtaattaaaatgtaagtatattcaatgtactgatatctctcagcatcataggtaggaaaactaaggcattcagcaattaagtgactcctcccttgatcatgtagcagtgatagtactggatttagattttgaggttgcttctctgcccttttctgcctttgtgaaaccaacaaagctgcctgtattttccaactcttccttcagcatgtggtacctcctttacatctgtttttgttgctctgaaatccatacgcgacgatgagctgagaggggcagaaaattgagcttgttctgagactggaggcttttggtttatctcttgcaggtcaagtacattttgtcctgggctctccctggtggccacgtttgtttatctcctgcgggagtaaataaacttgccttgctgaaaaataacagttctgtgtctttgcagtggaaactgggatgtctttattaacgttaggtcctgatgtaaggccaagtttttggttagagttgctcaagtgcagaggccactgctaagatgacttacccctcgtgtccatggtcaatgtggagactgttatgagtggcacatgatgctggaaaagcagagccaactcatgtttgtaattgtcctagcaggccgtggtgtactttgttaggcagccacagaacaatagagaaactcagcttattccccttccctctgggaaacacagacagtacttgccatccaacgccaatgtttttaaggaagaaagaggcaaaaagtgatgttggcaaggtctctgggagttgtggaccccaaccaaggattggagaccctgaaatggattcagatgccctaaaatgcagcccagttcattactatgaattttggaggactttgtgccttgagcaaatgtgtatatgtgacgctctttgacaacactgaaataggaaaaatactatccatgttcgcgaggagcactgaatttagagagggagacagacttttatgccagcatcaaatgaatttgataaagctagtaccaaaatgaaatttgaaattttttttttttgaaatagagtcttactcagtcacccaggctggagtgcagtgatacaatattggctcactgcaacctccacctcttgggttcaaacaattcttgtgcctcagtctcctgagtagctgggattacaggtgcgtgccaccatgtctggctaatttttatatttttagtagggatggggtttcaccatgttggccaggccggtcttgaactcctggcctcaagtgatctgcccaccttggccttccaaagtgctgggattataggcatgagctaccacacaagcctgaaatttgaaatgtattggtatagaatatactgtttagaatgtatgtgtatatatgtatatttgtatactcatataaacacaaatacacattgtatgtgtttctgtaatatgtatatctgtctacacatacatgtatatacacacatacaatgtcttttttttttttttttttttttgagacagggtcttaccctgttgcccaggctggagactgcagtggcataatcttggctcactgcagcctcgacctcctgggctcaagtgatcctcccatctcagcctcctgagtagctgggactgactacaggcacgtggcatcaaacttgtccaatttttctatttttttgtagagttagggtcttgctctgttgcccaggctggtctcaaattcctgggctcaagctgtctgcctgcctcggccttccaaagtactaggattacagatgtgaaccactgtacctggcctttacaatgtctattttaaagataatggttcaagtttttatcatcccactggcctactctaatgaaacatctatccattcattgaagaattatttatggtgggataactctgtgccaggtaccgtgctaggcattgagtattccaggttttaggaaacagcacatgcaaaagtgctgaagtgggagaagatctcggagtgattgaaggctaggagagagcaagtgtgggagctgtgaggctgggaaggtgggaggtaggtgggagcagaccacatagggattcttaatgtctttagtgtcatgtggaccatggagaggagtgtagattgtatttttagagcaatgcaaaatcatagaaggatgtgatcgggggagtggcatgagctgatctatttaaaaatatttctctggctgctgtgaaggaaggattgtaggaggcaggagtagattcagggagatgagacaagtgatgagagaggctttgaacttgggtaaaagtagtttgtggaaagtcttttttggaggtagtttttgtttattgccttgtcatcaaagcagagatgctgaccaatgaaactccatgagaaaatagtgatttataaagacatatctatgcactgccattaaaaagctgcttggaaaaaaaggataaaaagctgctttaacaacttttttttttgagatggggtcttactctgtcacccaggctcacgacctcagctcactgcaacctctgcctcccaggctcaagcattctcccacctcagcctcccgagtggctgggactgcaggcacacgccaccatgtcaggctaattgtgtgtgtgtgtgtgtgtgtgtatgtgtgtgtgtgtgtgtgtgtgtgtgtgctgggactgcaggcacacaccaccatgtcaggctaattgtgtgtgtgtgtgtgtgtgtgtgtgtgtgtgtgtgtgtgtgtgtgtgtgtgtatgtagagatggggttttgccatgttgcccaggctggtctcaaaatgttgcccaggctggtctcaaactcctgagctcaggtgatccacccgcctcggcctccaaagtgctggagattacagacgtgagccactgtgcccacctaacaactttaaaaaaattttgacatttagtaggatatttattgcattattgttgagatggcaaaatattggagacaactgaaatgttcatcagtggggggggctagttaaatgaaatacagtgtagcatgcattagaacacttttcaagaatttaactttttttgtagccttttacttataatgcttgtccctattgatgccttttttttcagcatgacttactcttttactataggatattaaaatttaattagattagaaatgaggaatattcttgtaatctgtagaaagtaacaaactataaacttattccccaagaacaaatataataatttttctggagtagcaggtaagaaagatataaatttatatgtatacaagaaactgaaattagactttatacatttaaaggttacaagtgcagttttattacatgaatgtattatccagcattgaagtctgggcttttagtgtaaccagcacctgaataacatacattgtacccattaagtaatttctcatccctcaaacccctcccaccctgaaattagactttggatccctagtttaaattccacccctctctttttttgagacaaggtctcactctgtcacccaggctggagggcaatgttgcaatgatagcttactgtagcctcaacctcctgggctcaagggatacaccctcctcagcctcctgagtagctggaactgcaggcgtgcaccaccacattcagctaattttttgatttttttatagagatgaggtcggaactcctgggctcaagcgattctccccaagtgctggggttacacacatgggccactgcccccagcctaaacctcctttctcagtatagcagccttgagatgaagttcctgaaattactggccagcttgactgtttccccacatcactggaggagggggatgcatagataaaacaaaatattcagcatcattgtattttctttttgtttcatcagcatctttttttaaaactcacttgacataagtccctagcctcaaagagtaaagcctttgcagaatctgcattcagatttcgggtgtgatttcctgacagatagttcaggtttgtaaactcttttttttttctttgagacagagtttcactcttgtagcgcaggctggagtgcagtggcaccatcttgcctcactgcaacttctgcccccttgattcacgcgattctcctgcctcagcctcctgagtagctgggattacaggcatgcgccaccacacctgggtaatttttgtatttttagtagagatggggtttcaccatgttggccaggctggttttgaactcctgacttcaggtgatctacctgcctcagcctcccaaagtgatgggattacaggtgtgagccaccgcagccggccaaaactttgttttttttcctctttttgttgctgagaaatgtaaactcttacagacacaaattatgtctcccattttttaaaacccactcaacacaggggtcatgtgtaataggccctggagcttattttagacattgatttgaggctcttttccccaagtgctggtttgtgtgtgtgtgtatgtgtgtgtaagtctttctatgagatgagtggtacctacctgggctgtgtgatcttttttattttatttattttatttttgtagatacgaggtctcactatgttgctcaggctggtcttgaactctggggctcaacctatcctccctccttggcctcctagagtgctgagattacaggtgtgagccactgcacctggccagcgatccttaataaatatagataatggccgggcgtggtggctcacacctataataccagtactttgaggggccgaggctggcaggtcacctgagctgaggagtttgagaccagcctgggtaacgtgggtgaaaccctgtctctacagaaaatagaaaaattagccaggtgtggtggtgcatgcctgtagtcacagctacttgggaggttgagacaggagaattgcttgaacctggaaggtggaggttgcagtgagccgagatcgtgtctttgaactccagcctgggtgacagagtgagaccttgtctcaaaaaaaaatatagatataggctgggcgtggtggctcacacctgtaatcccagcactttgggaggccgaggcgggtggatcaggaggtcaggagatcgagaccatcctagctaacatggtgaaaccctgtctctactaaaaatacaaacaattagccaggcctggtggtgggtgcctgtagtcccagctactcgggaggctgaggcaggagaatggcgtgaacccgggaggtggaggttgcagtgagccgagactgtgccactgccctccagcctgggcgacagagcgagactctgtctcaaaaaaaaaaaatctatatatctatatatctatatctatatagatatagatatagataatgccagatgatggctggttagaagggattgtcaggggctggcaggttttgcaggtgttagaatgagcaagatgaggagaaggatgcttacttccctctccttgtaactctctaccccctcccctcagtgtttttttatttttatttttatttatttattttttttgagacaaggtcttgctctgtcacccacactggattgcagtgatgcaatcatagctcattgaagcccaaactcctgggctcaagtgatcctcttgcctcagcctcccaagtaactgggaccacaggtgcgtacaactatgcccagttaagtttttcattttttatacagacggggtcttgctatgctgtccaggctggacttgcacttctggcttcaagtgattctcttgcctcagtttcccaaagtgctggcattatgggcataagccactgtgcctagcccatcagtgtctttttatcctttactcctatcaaaattcattcactcagcagccattgatcaagtgcctactatatacatgttgaggactggaaatttatttgtctcttctcatcttatctggaccctctgtgttaattgtaattaactgtaatcattctgtattaattgtaataaacttgttgataaactcaaatgaggccataccgttttgccacttcccctccttccaggttatatggatgtacttacattgcaggtttcatttgttggttcagtttttaaactaagccctattgtgtcaaattatgctaggtgtgagatggggagttcaagctgtgtgttgtctttttttttttttttttttttgcctcacttactaatatacaagcgcttataacctttgaggctggccctatacattaagatttttattaattccactgttctttatcttctcttactaagttctcagggtcgaatgaactctaactgctccttgctagtgataagcaagttgcaaattacagaattgtcagtgattgaatacacgtattaaacctgtaactgggaagcatttttggtaattatgaatacttttggaaaaaaaaaagctatggaaggaaagtttaaaatctacgaaagctcaagtagatggtcatggaatagctatttcaatttctaactatatattacttatttatttatttatttttgagacggagtttagctcttgttgcccaggctggagtgtaatggcgtgatctcagctcactgcaacctccacctcccgggttcaagctattctcctgcctcagcctcccgagtagctgggattatagacatgtgccaccacgccaggctaattttgtatttttagtagagacggggtttctccacattggtcaggctggtctcgaactcccaacctcagctgatccgcctgcctcggcctcccaaagtgctgggattacaggcgtgagccaccgcgtccggcctcttaactattgtttgaaataatgtagagacagctccagagccatgaagaagtgtatgaagaagcagtgttagcttaaatgacatacatgtcacaattgcctatgtgaaactatcataattatgcatgagaagtatctatcctgcataacctccaccaataataataatgttaataatagtgaaaactaatgtttattaagtccttactgtctccagcctctgtgctaaatactggttactaagtttccctgaaaatactattctcatctgtttgttcttaataacaggatagcataattgtaagttgtaaatgaaataatacagtttatgtaataaaagggtaaaagagaagaccacctaccttatcttctgttgctgatctggatggatgtaggtggtgtttacctagtttcacctttggcagttgaaactactttttttttttttttttttttttttaagagacagggtgggccaggcgcagtggctcacgcctgtaatccccgcactttgggaggctgaggcggacagatcacttgaggtcagaagttcgagaccagcctggccaacatggtgaaaccctgtctctactaaaaatacagaaaaattaactgggtgtggtggtacacacctgtaattccagctacgtgggaggctgaagcaggagaatcgcttgaacccgggagtggaggttgcagtgagctgagattgtgccactgcactccagcctgggtgacagagcaggactccgtctcaaaaaaaaaaacaacaacaaaaaaagaaatttttagaaatatgagatgacagcaagaatgagggtattaaaaagaaatttttagaactaaatagcagaatgtaatggtgaaaagtttgatttctcaagtctgctttgcacacaggcatgtggcaaacattcagtaagtatagctgtaattttaaccagctgtaatgtataatagccaacatatcacatttttcttttttcttttttgagacagagtcttgctctgttgcccaggctggagtgcagtggcaccatctcggctcactgcaacctctgcctcctgagttcaagtgattcttgtgcctcagcctctcaagtagctgggattacaggtgtgtgccaccacactcggctattttttgcatttttagtagagatggggctggtcttgaactcccagcctcaggtgatctgcctgcctcagcctcccaaagtgctgagattacaggtgtgagccacagcgcctggccatatattgcttttttcttattatcagagccagttcataattgtggaaaaatagtgtttgtaacaatgtaagtatggataaatcatctttttaattttgtgattcatataggtttgttgttgttgttgttgttttgtttttatcttgagacagagtcttggtctgtcacccaggctggagtgtaatggcacaaccatggctcactgcagcctcagatgcctgggttcaagcaatcctcccgtctcagcctctagagtagatgggaccacaggtgtgggccaccatgcctgggtaattacaaaacttttttttttttttctagagatgaggtctcactatgttgcccaggctggtctcaaacctttgacctcgcttcagcctttagagtagctatgactataggcatgtgccatcacccagctaattaaaattttttttctttttttttttggtggagatgcggtcttactttgttacccagactgcaagttagtttcagatatcaacatttggtgtttccaaatgcacggggaggctttggagcaagtttttggctcatatgcataggtgtcctagacattcactttgcaaattcttattaaaatgactacagtagcatacagatagggaaaaatatccttgtcagtaccaccgattgggtgagaagagactgtatattaaaaacaatgaccatctttttgccacataaattgctggtggggccagtttgaagagggctttgtcagctgccttctgcctcttcctcttgagtacgtggagttggagtcatccttgacagcctcctgttgacaccacccgggtcacagatgtgaaactgtgtggatgtaggagagagcagtgatggggcttaccccaaggttgctcttccttccctctggccacaaatgtttagtaaggaactgctctgtattaaccatttgctaggggctgcagatacggtggtgaagaaatagacatgttcctactcgggatgctgaggtgggaggattgcttgagcccaggagttggagctgcagtgagccatgatcacaccactgcactccagcctgggggacagagcgagaccctatctctaaaaaacaataaaagaaatagatgtgtccttcaccctcatggaactgccagtctagccttcaacctggtgactgtagaaatgtgtgattagatgctatattgccatgttgagtgtcacccctgagaagcagggttttttttgagaaggtaggatgggggatctgactgtgggaccaccagagggaaaagcacatgtaaaagctgcgtgtaccaactggaggaaatcggagacgtgatcagagaaccagagtcaaccaggggccatgccgtacagggtcctgttaagatctgtgacttttttctaaacgttttcttctggataacatctaaatttctagttccaaatgtgaaactccaagggcgttctgtgctaaacattttgcatgtattaattaatttccaccacacaacattgctgtgaattaagacagtttctaagcatggcaagaaacccagaaatcataatggaaaaatctgataaatttaacaatgccaacatgaacctctgtaggaaaaaaaataccacagactaaaaaggggggaaaaaaaccagagacaaatatttgcaacacatacagtaaagggtaattttctggttatatcaagagctcctacaaatcagtaagaaaaaaaatctaataggaaatgagcaacgacaaactgacaactcatagaaaaggaaacacaagtggtctgaaaacatgaaaaagtgctcagtctcacaaagaaatgcaaactaacatggtaccattttccattaatcagatagacaaagatgaaagagtttggtaatgtatgtagtattggcacaagtgagggaaaacaggggatttcacactctatgcccgtccaaaccagtaccttattttgagggtggtttgacaatatttgtcaaaataaaaaaattatatatagtcatttgccacataatgatggttcagttgatgatggacggcatacataatggtggtcccataagaatataatgggctgggtgcagtggctctcacctgcaatcccagcactttgggaggccgaggtgggtggattgcctgaggtcaggagtttgagaccagcctggccaacatggtgaaaccctgtctctgctaaaaacatacaaacaattagccaggcatggtggcgggtgcctgtaatcccagctactcaggaggcagaggcaggagaatcgcttgaacccggaaggcggaggttgcagtgaggtgagattgggccactgcactcccatctagatgacaaggcaaaactccatctcaaaaaaaaaaaaaaaaaagaatattatgggcccagccacagtggctcacacctgtaatcccagtactttggtaggccaaggcaggagaatcatttgaactcaggagtttgagactagtggggacaacatagcaagaccccatctcaaaaaaaaaagattatggtggagctgtcctgtatagacataccatttttaactttttttttttttgagatggagtcttgctgtgtcacccaggctgatgtgtagtggcgtgatctgggcttactgaaacctccacctcctgggttcaagcgattctcctgcctcagcttcctgagtagctgggactgcaggcgcaggacaccatatctggctaatttttatatatttagtagagatggggtttcaccatgttggccaggctggtcttgaactcctgacctcaagtgatccgcctgcctcagcctcccaaagtgctgggattacaggcattagccaccatttacaggcacctggccaccatttttaatcttttatattgtatttaaactgtaccttttctatgtatggatgtgtttagatacacaaataccattgtgttacagttacttacagtattcagtacagtagcatgctgtacaggtgtgtagcctaggagcaataggttataccatatagcccaggtgtgtagtaggctctgccatctaggtttgtgtaagtacgctccatgatgttaccacagtgacgaaatcgcctaatgatgcatttctcagaacatattcctgttgttaagcaatgcatgaccgtatcttgacaaagccattttatttctaaaactttaattttacagatttatttgtaaaagtatgtaaaaatgattgtaaaggatatgttctgctgcattatttgtaataacaaaaaaccagaggataacataaatgtcctataagaagggttagattatggatggcacattcatacaatggggtattatgtagccattgaataaaagggtactggctgggcgcagtggctcatgcctataatctcaacactttgggtggccaaagaaggaggattgcttgaagccaggagcttggggccagcctgggcaacatagcaagaccctatctctacaaaggaaaaataaaacaattagccaggtttggtattggacaccttcatggtcccagctactgaggaggctgagattggagggatcgcttgtgcctggcaggttgaggctgtagtgagccatgattgtgccactgcactccaggctgggagatagagtgggaccctatctcaaaaaaacaaaaacaaaaacaaaacctcctgtaaaatgtcaagaagtcctagatgtgggccaggtgtggtggctcacacttgtaatccctgcactttgggaggctgaggccaggagtttgagaccaggcagagcaagatagcaagactccatttctacaaaaaataaaaaaaattagttgggcatagtggtgcattcctgtagtcccagctactcaggaggctgaggtgggaggattgcttgagcctgggaggttgaggctgcagtgagccatgatcacacctctgcactccaacctgcgcaacagagtgagaccctgtctctaaaaacaacaaccaaaaaaacccagcaaagtactgataaagatctttggctgggcgcagtggctcacacctgtaatcccaacacttcaggaggctgaggcgggcaggtcacaagatcaagagatcaagaccatcctggccaacatggtgaaacccggtctctactaaaaatacaaaaattagctgggcatggtggcgtgcacctgtagtctctgctactcgggaggctgaggcaggagaatcacttgaacccaggtggcagaggttgcagtgagccgagatcacgccactgcattccagcctggcgacagagcaagactccgtctcaaaaaaaaaaaaaagagagaaagatcttcaagttgtagtatgtgaaaaaatcagggtgtaaaacaagagaatcccatttgtgtgtgtgtcgagtgtgtttcacacaggctcagagggagtagtgtgtatatgcacatgaacatacgtgtcagtgtatatatgtatatatacaaggttgtgggtttgtttgttttttttgagacagagtcttactctgttgcccaggctggggtgcagtggtgcaatcttgacccactgcaaccttcacctcccaggttcaagtgattcttgtgcctcagcctcccaagtagctgagactacaggcacgcaccaccatgcccagttaatttttgtatttttagtagagatggggtttcatcatgttgcccaggctggtctggaactcctggcctcaagtgctctgcccgccttggcctccgaaagtgctgttgcccaggctggagctcagtggcacaatcgcagctcactgcaaccccgacgtcccaggctcaggcaatctttccgtcttagcttcccaagtaactgggactacaggtgtgtgccatcaatgccccaccaattttttaattttttgtagagatggggtttccctacgttgcccaggctgatcttgaactcctggtctcaagcaatcctcccacctcagcctcccaaagtgctgcgattacaggtgtgagccaccttgccctgccctgtacaaagatctgcataaaagcagttaataatactatgtttgaggctgccatcacaggggtgaggtcaaggacaagtgtgagaaattcttttagaatctattttaaaaaaagaagagatgacagtggtgacagtcagggaacagataagcaggtagattgtgggggtctaggctgtctaactggtgtttaaaatgaagcaaccgctgagcctgctgtatttcatttaatggagactagtaaaacaacagccagaaattcttcactttccatctaagagaggcaaaagttattttcccttcaataacctgggactgtaggattaaggtttttttttttttttttttaaatactacaatatgactaccagtataatttaaaaatgattagaattctatttgagtaagaaataggtgtctgcctgaagtagacagtcactgaagtcactaagtggcaaaagacagaaaaaaaattgaaagtaggaaacaatcagcagatatgataccaaacatgagctgtcagtgataatggattaagtccttcaataatggctgagccagatggaattaaaagaaaaaatccaggccgggcatggtggctcacacctgtaatcccagcactttgggaggctgaggtgggaggatcacttgagtccaggagtttgagaccagcctgaacaacatagtgggaccccatctctattttataaaaatattttgaaaaaagaaaaaaaaattcagttgtgttctgctttaaaaagacaaattggcacagaatgtcaaagaataaataaaacaaacatgggcaaaagagattcaggtggtaccaatatcgggctaagtagcattcaagataaagattattaaataataagttagttaatactagagtaattgcatattaatgaaacataatctatggtagagatattatagtcaataattgttttatgtattcattaaggtaacaacaagcaaacaagctttaatagttttaaatgctttatatgctttatagttcttttatgtgcattaattcattaattctcatttcctatgaggtaaacactattattatccacattttacagatgtaaaaaccgaagcagagagattaattagcttgcccaggagatgtggcattctgggatttgagacagtggtttggctctgtaggttgcttcaataaccaagagatgcttcaaatcagatttttaaaatatgtttttcagaagcattttcctgatacttctccccttacatgggtgttagtcttttgggttgaaaaacatgagtaagtgctagaagagcaaaatatgcatccagatttaatagtatgtctgtttttctgagccttggcatttcattgcttttataatagaaatgaaggcttttttttttttttggctgagaatagcactgaactcagtgggagggactgtgggttgtaagttgtccgcctctgaatggagttgaatttaagtttcttggtttccaaagaatgattgatttaaagaccctcaaattgcaagttagaactgacttcagtccttgaggttttttaccatttaatgaataattaaatttatggtaataaatggtaataaatggtaaaaatggtaataaattttaccatttaatgaatttttcttaaaaagcaattgaattgttgatgaaaggtgatgttaaaattatcccagatttatcaatcttttttttattgcccctggattttgagtcatagaaagcctttccttattctaaggttaacaagacattcacccatgttttcctctagtattgcattgtttcatcttttacgtttattatttattttattttatttttttgagacagggtctcactgtgtcactcaggctggagtgcagtggaatgatcttggctcactgcagcctctgcctcccgcctcccgggttcaagcgattctgctgcctcggcctcccaagtagctgggattacaggcacctgccaccgcgcctggctaatttttgtattttttttttagtacagatggggttttgctgttggccaggctggtctcgaactcctgaccttaagtgatccacccgccttggcctcccaaagtgctgggattacaggcatgagccaccgtgcccggcctaaaatttattctgatatgtgatatgatgtatggttctaactactttgttacggtgcattattttctaaatgtggtattggattcttttatattttgtttagaagttctgcatcaatattcatgagtaccattggtctctgttgtttttcttgtgccatctttattggtataggtatcagtgttatatttagtttgtaaaaggaagttggaagttttcctttctttttagtactcaggaatgattttaagaattgagactatttggtctttgaaggtttggtagaagtccattgggaatccatctgggcctggtgattttctgtgcggtagttccttaattgttttccctattttttcttatttttaatcaggtagcctctgaaccagaataggttcagagaggctccctctattttttttaatacaagttggtctgcctaagttttcttactctaatgggttaatttttgtagactgcatttccctgaaaaattacacgtttgttctaggttttctgacttatttccacaactttttagtctttccccctggaatcatgcccctttccataaacaggactctgatgtacctgaagtattttcacacttcgggtggactttctgtttctgggggtggttttagagcaattttaggcctgccactagctaccctgttctctacaccatgctgtttttctcagaatgctcttcttttgcacaaaggcttggagtaggaggttgagcagtcactcactgacgtttggtatattttcttttttttgcttacaggtaatctggaagtttgggcattctctttaagttgagggtgtggttttcatgtcattttatttgtttattgttttcttgtgtgtgtttcttagagacagggtcccactcttgccctggctggagtgcagtggcgtcttgatcatagcttactgcatcctcaagctgctgggcttagatgaacctcccacctcagcctcctgagtagctgggactacaggagcacaccaccatacctaatttttttttttttgagacgaagtcttgctctgtcccccagattggagtgtagtggtgcaatctcggctcactgcaacctctgcctcccgggttcaagcgattctctcacctcagcctcccgagtagctgagactgcaggtgcatgccaccatacccggctaatttttgtattttttagtagaaacagggtttcaccatgttggctaggctggtctcaaactcttgacctcaagtgatccacccaccttggcctcccaaagtgctgggattacaggcttgagccactgtgcctggtccctggctaatttttaatttttttgtagagatgggatcttgctatgttgcccaggctggtcttgaacacctggccttaagcaatcctcccaccctagcctgccaaaacactgggatttacaggcatgaaccattgtgcctggcttgttttgtttttaattctatgttgtttttgaaggatgtatggggagagatggatttaggcaatcatcgttgtccttggctacctgaaagtccaggcactcttctagatactttataaatattaactcattttatcctctcaacaacactatgacatgggtactgttacaccttccattttataggacttaacagagaggttaaatatgtagcccagggtcacagagagctgggcttcagaccaagacaatctggcaccagagtctatgtggctacccctaaggctttgccaccatgtgttagtgattctcagcctgtcatttggggaggggattgcccttttttttaaactttttaaaaaatttattcttattttattatatttttgagacagagtctccctcttttgccgaggctggagtggagtggtgtgatttcagctcactgtaacctctgcctctggggttcaagtgattctcatgcctcagcctcccaagtagctgggattacagttgccagccaccatgcccagctaatttttgtattattattattattatttgagacggagtctcgctcttttgttcaggctggagtgcagtgctgtgatctcggctctctgtaaccttcgtctcctgggttcaggtgattctcctgcctcagcctccggagtagctgggactataggcgcgcaccaccatacttggctaattttttgtatttttagtagagacggggtttcactatgttggccaggctggtctcgaactcctgacctcaggtgatctacctgccttggccttccaaagtgctgggattacaggtgtgagccaccatgcatggctggattgtccttttttaaaaaaaaaaacaaaaacaaaaaaaaaaacccaaaccataaacccaatattctgaaagatttggtctccacacctgtgttatataataattagtttttccatttttttcctcttggtagaaggcacatatgccactcagtttccagttgccacacccaattaacataattgttttgcagccaaaagcaaaagagagttgacattttaattagcttatgtaggtagacaaattgaggcctaatgtaagagtttcattatacctttttgaaaaactataaatagctagaagccagttgtcattactttttgattccttagaattctgggcatctttcatctggaaccacagatgaaagaagctgcaaggaaggattttttttcttaacggaatagtttaaccattctgaatgcaaaagtattggatgctagaataataggtatcacataaattgaggttgacgttttcccgggtgaaattctattctgtctcaattttcctttttttttgagacggaatcttgctctgtcgcccaggctggagtgcagtggcatgatctcggctcactgcaagctccacctcctgggttcatgccattttcctgcctcagcctcccgagtagctgggattacaggggcctgccacaacacccagctaatttttttgtatttttagtagagacggggtttcccaggatggtctcaatctcctgacctcgtgatccgcctgcctcggcctcccaaagtgccgggattacaggcgtgagccactgtgcctggccttttttttttttttttttttttttttttaagacagagtctcgctttgttgcctaggctggagcgcagtggcatgatctcagcttattgcaacctccgcctcccgggttcaagtgattctcctgcctcagcctcccgagtatctgagattacagatgtgtgccaccatgcctggctaatttttgtatttttagtacagatgaggttttgccatgttgcccaggctggcctcaaactcctgacctcaggtaatcctcctgcctcagctcttcccaaagtgctgggattataggcatgagtcaccgggcccagactcaatcttctgacaagctctcagagagagtaaaaagcaaatgaatatttcattattttgatctgagctttacgatttttcttttcttttcttttttttttttttttgagatggagttttgcgttgttgcccaggctagagtgcagtggtggcgatcttggctcaccgcaccctccgcttcccgggttcaagcgattcttctgcctcagcctcctgagtaactgggattacaggcatgcgccaccatgcccggctgattttgtatttttagtagggacagggtttctccatgttggtcaggctggtcttaagctcccgacctcaggtgatccacctgcctcggcctcccaaagtgctgggattacaagcatgagccaccttgcccagccttttttttttaaatctgagaagaggtcttgctcgattgcctaggctggagtgcagtggtgcgatctctgctcactgcattctctgcctcccagactcaagcaatcctcccaccttagcctcctgagtagctgggactacaggcatatgccaccacacctggctaatgttcgtatttttttgtagagacagggttttgccattttgcccaggctggtcttgaactcctgacctcaggtgatcctcccaccttggcctcccaaagtgctgggattacaggtgtgagccactgtgcctggtctccttcactgttgtaagatacttgaattgggtcaatatttgtggagaagtctcttaaaagttcacttgattgtcagtactagaactctacatttaatattgacatattcctgggagcatttcagagcattctattagcttagaaaggtccaggataatttgactttagaagttactgttaccatgaatctcaatgacttttgaaatccatgaagaatatcttttttttttttttgagacggagtctcactctgtcgcccaggctggagtgcagtggtgatctgggctcactgcaagctccgcctactgggttcacgccattctcctgcctcagcctcccgagtagctgggattacaggcacatgccaccacgcctggctaatttttttgcatttttagtagagagggggtttcactgtgttagccaggatggtctcgatctcctgaccttgtgatccgcccgcctcggcctcccaaagtgctgggattacaggcgtgagccaccgcgcctgcccaagaatatctttttgctggtaactagagaggactcctctgaagcagatgccattcatgatggatttcatcatttatgggttttaaaaaacattttattttgaaataatttcaaatttaaataagagttgcaaaatagtacaaataattcgtgttaacttttcatccagatttacaagtcaaccttatacaggttgagtatcccttatccaaaatgcttgggaccagaagtgttttggatttcagattttttcgaattttggaatatttttattatatacttaagcatctctaatccccaaatctcaaatctgaaatatctgaaatgctatgatgagcatttcctttgagtgttatgtgggcactttttaaatttatttaattaatttattttttgagatggagtattgctccatcacccaggctggagtgcagtgagcgatcttggcttattgcaaacttcaccttctgggttcaagtgattctcctgcctcagccccctgagtagttgggactataggcgcttgccaccacggccggctaatttttgtatttttagtagagacagggtttcaccgtgttggccaggctggtctcgaactcctgacctcaggtggtccacctgcctccgcctcccaaagtgctgggattacaggagtgaaccaccgcgcctggccatggattttgcagcattttagatttgggatactcaacctgtaccatgtttactctctctcctctctctctctctctttttatatatatatatatatatatatatatatatatatatatatatatataaattatatatacactacacatatatgtatgtatatgtatgtattttatatataaaatacatatctacatataaaatacacatgtatatatacatgtgtacatatatgtgtctctatatttaagttttgttggaaccacttgagggtaagttgcagacatggcgtctcattgctccaaaatacttcagtgtgtatttcttaaatacaaggacacttggttacataaccacagtatatcaccaaatgtatattataacaagactaccatcaaatccttatatctctttcaaattgttttagtaatatccttatagcaaaagacaaaacaacaacaaaaactgttcccttttattttgtttgttttggtccattatatgtccaggttatgcattaatgcattgtgttacttgctaagtcttgttactggcctttaattaggatatttctttgcatcccgccaaactcctcttcatggttgtatctttttttttttttttggagatggaattttgcttatgttgcccaggctggagtataatgatgcgatcttggctcactgcaacctccgtctcccgggttcaagcgattctcctgcctcagcctcccgagtaactgggattgcaggcctgcgccaccttgcccagctaattttggaattttgtgagacggggttttgccatgttggtcagactagtctcgaactcctgacctcatgatccgcccgccttggcctcccaaactgttgggattacaggtgtgagccactgtgcccggtctttttttttttttttttgagacagggtcttattctgttgcctggcctggagtgcagtggtatgatcttggctcactgcaacctggacctcctgggctcaggcgatcctcccacctcagcctccttagtagctgggactataggcacacaccaccatgcatggctaatttttatatttttttgtagagactgggtttcgccatgttgcccaagctggtcttgaactcctgggctcaagtgatccacctgccttggcctcccaaaatgctaggattacaggtgtaagccactgcgcctggccctaatttttgcattttttgtagagatggggtttcactatattgcccaggctggtcttgaactcctgggctcaagtgatcttcccatcacagccccctaaagtgctgggattataggcgtgaaccactgtgcctggctgaggattaagtttcaacctcaggggagcggcattcaaactatagcattgtcctttagtgactggcttagttcacttagaatgtttgtctattcatccatctatagacactgttttctttcaccttttggctttgcaaataatgctgctgtgaatatgagttatagaaaaataccaatttgaatccgtgttttcaattactttgagtatatacctggaagtggaatttctggatcatatggtacttccaagttttttttttttcttttttgagacaaggtctcactctgtcacccaggctggagtgtagtggcacgatcttggctcactgcaacctccgcctcccgggttcaagcgattctcctgcctcagcctctcaagtagctgggattacaggcacgcgccaccacgcccaactaattttgtatttttagtagagatgggtttctccatgttggtcaggctgctcccgaactcccgacctcaggtgatctgcctgcctcagcctcccaaaattctgggattacaggtgtgagccaccgcacctggcctccatgtttcaatttttaaacaaacaattagttaaaaaaataggaaactaagagaatgaactatttcctgttttattcagtgggttataatctgttactatcattgtttattttgaggtacaaattgtccctactttggccagcagaggatcctgcagtttgtctcctgtgtccttttcatagctccttgttggaactcttactggcccacaataggatgttccaagttcatcttcttacttttactgccccaacgctgggatcagccatttcttcaaggaggccagttcctttcattggagaatggaaaacccaatatgtagaaaccaagatagaggtgttaggtgtgattgctactggagtgtcattgcttccaaaccctttcagaagagacctaggaaatgtgtgtgtgtgtgtatatatatatgtgtgtgtgtgtgtgtattcataaaagcacatacacatacacataccccgaagcatgtatttctgtattattattatttttttgagatggagtcttgctctgtcgcccaggctggagtacagtggcacgatcatggctcactgcaacctctgcctcctggattcaagcaattctcctgtctcagcctcctgagtagctgggattacaggtgtccaccaccacgcccacctaatttttgtatttttagtagagatggggtttcaccacattggccaggatggtcttgaactcctgacgtcaagtgatctgcccgcctcggcctcccaaagtgctgggattataggcgtgagccactgttcccatccagaagcatacatatctatttctatatctacatttctgtctttacatgtatatattaaaaattacagtttgcactaatacctccaattacaatctaacatcatgggatttattctggctttctcccttctcatatttgtgtctccccaacagtgagaaacctggcttgctatcctcaacatggtaacttatttattaagaaacttattctttttttttttttttttctgagattgagtttcgctcttgttgcccaagctggagtgcagtggtgtgatcttggctcaccgcaacctctgcctcctgggttcaagcgattctcctgcctcagcttctcaagtagctgggattacaggcatgcaccaccatgcccagctaatttcgtatttttagtagagatgggtttctccatgttggtcaggctgctctggaactcccgaccccagctgatctgcctgcctcggcctcccaaagtcctgggattacaggcgtgagccaccgtgccctgcctctagtttatttatttttattccatgtgctcagtcttgcgagcacgtggtctgttttcttgggcctggccccctcagtgcactgtcttaataccctagcccccagtccctctgatcatatccccagacacccctactgaatcccaggtctctaccaagggaaaggcagggaggaggcattgaccaaggagaagagggggaagggacagggaaggtcttgatttgtattttctaaaattttctactctgctcataatgcgtcttagctgtgttgttgtggaaagtagtgctgacagtgtcttgtttttttattacttactttgtctttctttttaagatggtttcacccaaatatcactggtgtggaggcagaaaacctactgttgacaagaggagttgatggcagttttttggcaaggcctagtaaaagtaaccctggagacttcacactttccgttaggtaagttggaatgaaaagagaggatcctgagagtgttttctaggtaggaagtggtaaaaccatgcttggatagcttgctgcctgcatttcgagtttgaaggccttatctgagccctgggctgccttcagggtttggggagtggcctcctggacatttagcagaagaggagtaaggagggcccttcttctccctctgagacctcatggaaggtgagttggagcaggtcatagaagttcttaagccctccagtgcttgagacttgttccacacatcttgaacctggtttctgcatttttcttttccttcctgttgatttatttaaaaattttatttcttttcaatttttttttttttttaaatagaggtgggatcttccaatgttggccaggttggccttgaacttctggcctcaagcaatcctgcctcggcctcccaaagtgttaggattacaggcgtgagccactatgcctggccttctttttttgagacaagctgttgctctgttgcccaggctggagtgcagtggtacgatcacagcttacagcagccttgaactcctgggcttaagtgatcctcccgcctcagcctcccgggtagctgggactccaggcttgtgccaccatgctcagcatttttaaaaaatattttttgtagagatgaggtctcactgtattaccaaggctgatctttaactcttagcctcaagtgatcctcctgcctcagcctcccaaagtgttgggattacaggcatgagccaccacactcagactttgttgacttcttaataagaaaaatacttgttaagagtttcttcagatcactttcctttatcaacaagtaaaacatgactgaggaagttgtggtcccctttgcttccctgcccaggcccgtttccctccctctttccccagaggaaaccaccaagaggttggcatatattcttcctgaacgtgtttttatagttgtactgcacttgtactgtgtatgaacaatataaagttggtttgtgtgtttaaaaaattcacatacatggatttataatgtatgtatcattttgcaacttaaaaatttttttttgagctccatgctgattgataacgatctattttttttttttgagatggagtttcagtcttattgcccaggctgaagtgcaatggcgtgatctcagctcactgcaacctcagcctcctgggttcaagctattctcctgtctcagcctccggagtggctgggattacaggtgcatgccaccatgcccagctaatttttgtatttttagtagagatggggtttcaccatgtcgaccaggctggtctcaaactcctgacctcaggtgatctgcctgccttggcctcccaaagtgctggaattacaggcatgagctaccatgcctggcctttttttttttttttttttgagacaaagtcttgctctttttcccaggctggagtgcagtggccacaatcttggctcactgcaacctctgcctcctgagttcaagcagttctcctgcctcagcctcctgagtagctgggattacagacatgtaccaccatgccaagttaatttttgtattttttgtagagactaggttttaccatgttggccaggctggtcctgaactcctgacttaaagtgatccatctgccttggcttcccaaagtgctggggttacaggcatgagctatcgcgcctggcctgagaaatctcattcttactcctactcccttgcacactatctccattctgtaggtagccatttctattaatttcttgtttacccttctgtgtttctttcattctttttctttttttcttttttttttttgagacaatcttgctctgttgcccagactggagtgcagtggtgtgatcttggctcaccgcaacctccacctcctgggttcaagtgattttcatgactcagccacctaagtagttgggattacagcgcctggtgtacactaccacacccagctaatttgtgtatttttagtagagatggggtttcaccatgttgtccaggctaatctccaactcttggcctcaagggatctgcctgtctcagcctcccaaagtgctgggattataggcatgagccaccatgcctggccctatgtttctttttataaaaataagcaaattaatatttttattactattttccttttatttttacacatcaagtagaacattaaatatatttctctgtaatttttttcagttacctaaatcttttagtgatctctctcatctttttaatcagctggatcgcattctatcatgtgaatattttataacttctatatactgtcaccagcaggtagcgatttagttgtgtctaatattttaaaatgatatataatgcctcaatgaatatagtaaccttttgcatatattgttttgtgctttgggataacactacctcgtattggaaactgtgtcattacatgtgtctttaaaattacatgtgtctttttatttttatttttattttttttgagtgggagtttcactcttgttgcccaggctggagtgcagtggtgagatctcggccgactgcaacttccgcctcccgggttcaagcgattctcctgcctcagcctccccagtaggtgagattacaggtgcctgccaccacgcccagctaatttttgtatttttagtagggacggggtttcaccatgttggccaggctggtatcggtctgctgacctcaggtgatcctcccacctcagcctcccaaagtgctgggattacagacgtgagccaccatgcctggccatcacttttttttttttcttaattgctgcatagtggccgggcacagtggctcacgcctgtaatcccagcactttgggaggccaaggcaggcggcggatcatgaggtcaggagaccaataccatcctggctaacatggtgaaaccccgtctctactaaaaatacaaaaaaatttagctgggcgtcgtggcgggcgcctgtagtcccagctacttgggaggttgaggcaggagaatggtgtgaacccgggacgtggagcttgcagtgagccaagattgcaccactgcactccagcctgggtgatggagtgagactctgtctcaaaaacaaacaaacaaacaaaaaaattgctgcatagtattccattgtatgagtagtaacacaacaatttttataatgcatagtattccattgtatgaatagtaatgtagcactatttgtttatacatttttatgattaaaaaacaaaatgtttttctattatgaataaagtggcaatgaatatttttgtacaagtgttttggtagctatacagttattgtcacttaatatatgcaattcgataggccagtcattcaaaatagaagatatacaaggtaggccgggcgtggtggctcacgcctgtaatctcagcactttgggaggccgaggtgggtggatcacctgtggttaggagtttcagaccagcctgaccaacatggagaaacctcatctctactaaaaatacaaaagtagctgagcgtggtggcgcattcctgtaatcccagcttcttgggaggctgaggtaggagaatcacttgaacctggatttataatgtatgtaaatccaccgcgaaggttgcggtgaaccgagatcacgtcattgcactccagcctgggcaataagagcgaaactccatctcaaaaaaaaaaaaaaaagatatgcaaggtaaagatactaataaagacctttgtgttgagttggttgacatgtggttatttcacccatcgtatttcttatagggaataggtaaattcgttccttgggtttctttcaacacttaggtaaaatccgacgtggaagatgagatctgattttactggtgtaactctttatttgtccccttgcctccctttccaatggactattttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtcagtaacattttagtgaccacaaagtctgctgctcccttgtgccctgagtgtcagaaatgcatgacggtctgtgtatgactctctgactccaaaggcttgtgactgttttttgagctgtaatctttaaagaattactaaagtgagactaatagcatcaaattattttcagagtacctttttcctgcaaaagttttaatcagtgttacttacactcatcctataggggttgcataccattcctgcatatacttggtacgtgtattagttttaagacttattgaacttcagcagataatctttgagagttattagaggaaaacaaatgataatggagacaccaaaatagcagcagttttctatggtggctctcgaccagttattcagcaatgtcaccaacagatgtcagtttaagctcagaagtggaaaagcagagagctcagagggtcagctttttcatcagttcttttaatgttatcaccacaattatgtgagaatgaccttgcttagagaaaattatgttattttcgagatctttccccctgtgttggaactaggctgatgaaagcatgggcttgacttatttattgattgtattcgttttgtacattcccaatctcctctctgacttggtgcaaattcaggatctcttagttagtttgtatattttgtgtcttcaggtatgattttttcagcttatacctttatgtcagtgctattatgtgctgataatttgtttctctagctaccaccgtagcttcaggcaaaaggctgtcagccaactctgtacagtttatttctaaattttactgttttcagttgagtatggatgaagaataactcaaagtttattcttttgatgatgagcccttaacaccacctgccatgatagtacttgctttctgaccaagatcctgagggaaaaagccactttattattagaactatgttaagatgcttcccaaaaaacatggagcagtattgtctcaaagtctgtccttggatggctttggatgcctacatcaggactgtctgatgtgctggttaaaatgcagattcctgggcctcattcagacttacatgtattgatattgctggttgtggagcctgggaattcatatttttagcaaaatccctcatttttactccaagtcttatgtgcattatacagtttgagatgatcacccaggatatagtccaaagacactggaggctgttgaagtataggttgtatatatggaaaaggttggaatgtttgaattaatttataatgaagatcctttttaattgagtgttcacatgccaaggcaaggacaaacattcaaaatgattttctgtctctgttacaactttttctttcttttttttaatttatttatttgagatggagtctcactctgtcacccaggctggagtcaagtgacgcgatctcggctcactacaacctccgcctcccagattcaagtaattctcttgcctcagcctcccgagtagctgggactacaggcatgtgccaccatgcccagttaatttttgtatttttagtagagacagggttttgtcatgtttgccaggctggtctcaaactcctgaactcaggtgatccgcccaccttgacctctcaaagtgctgggattataggcgtgagccaccgtgcctgtctctattacaactttttattacaacttctttattttgactttatttttacaaattatttatttattttttttgagatggagtttcgctcgtcacccaggctggagtgcaatggtgcgatctcagctcactgcaacctccgcctcccaggttcaagtgattctcctgcctcagcctcctgagtagctgggattacaggcacttgccaccacacccggccaattttgtatttttagcagagacagggtttcaccatgttggtcaggctggtctcgaattcttgacctcaggtgatccacctgcctcggcctcccaaagtgttgggattacaggcatgagccaccacgtccggccgacttttatttttttttcttgagacagggtcttgctctgtcacccaagctggagtgcggtggcatgatcatagcgcactgcagcctcgacctcctggactcaagtgatcctcctgcctcggccttgtgtatagctgggattacaggcagttgccaccatgccaggctaatttttaattgttttgtgaagatggggatttcactgtgttgcccagactggtcttgaactcctggcctcaagtgatcttcctgccttggccttccaaagtgttgggattacaggcataagccactatgcatggcctgtaacttctttaaatggctataattaaacagttggtccttttaagattgggcaatggacgaatggcaaattgcatttttaaaagaggagggatttaaaaaaaaacaggaaagattggggcatttgtctctaaaggactgtggactcatttaagaagtttagtggtcattcttaccatctttgtggtttttcctgcctgcatgggatgcagattttctgtctcaggtgggattgatcaatcccttggaggaatgtgtctactttttaattgtgtttaggagagctgactgtatacagtagttttgtgaaagaacaacatgaacccatagtagagctaaattcttttttattttttaaaaactttaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggtaaatctccagttgaaaaatgggtctggcaagatgttacctttgggtgatttttctgctgacagaagacagacaccattacattcaaagtcagattgtcttttatttatttatttatttatttatttatttgagacagggtcttgctctatcacctacagatggggtttcaccacgttgggtctggtgacccaaatctttgggtgatttttctgctggaagaggacaaacaccattacattcaaagtcagattttctgttttttttttttttttgtttttgtttttttaatattcatttgtttattcatttgagactgggtcttgctctgtcacgcaggctggagtgcaacctccctgggctcagttgatcttccctcagcctcttgagtagctgggactacaggtgtgtgccaccatgcccagctagtgtttgtattttttgtggagatggtgttttgccgcattgcccagtgtggtcttgaactagtgctcaagaggcctgcctccttcaacctctcaaagtgttaggattacagatgtgaactactgtgcctgatccaaagtcagattttctttgcttacttagtcaagttcgtctatgcttttattatacttaatatattagtatagttactgtattagtatattagcatatttaatatattattatacttatcatacttgagtatattgagtatatttacacttttagtatatttgtatacacacaccacatttttattatttatcttttttttgagacagagtctccctctgtctcccaggctgaagcacagttggctcactgcaacctctgcctcttgggctcaagtgattctcgtgcctcaccctcctgagtagcagggattacaggtgtccaccaccaagcctggctaatttttgtatttttagtggatatggggttttaccatgttggccaggctggtctcgaactcctgacctcaaatgatctgcccgccttggcctcccaaagtgctggaattactggcgtgagccactgcacccagcctattatctgtcttttgatggacatttaagttgtctctatatactagctattgtgaataatgctgcagtgaacatgagagtgcttgaaaacactaatgtaacataaaggtaacaaataataaatgtcatgtgtttatcttgaaaggaactgaaatacgacgttggtggaggagaacggtttgattctttgacagatcttgtggaacattataagaagaatcctatggtggaaacattgggtacagtactacaactcaagcaggtgagcagattggaaagctcaagctttctccttaaaaacttaaaacaaatcctaatagagaattttgcaaacatacagaggtagacagaatagtatcatcagcctccatgtacccattgcagcttcaactatcaaatctttttttttttttttttttttgagacagtcttactctgtcacccagtctggagtacagtgttgcaatcttggctcactacaacctctgcttcctgggttcaagcgattctcctgcctcagcctcctgagtagctgggactacaggtgcccaccaccatgcccggctagtttttgtgtttttaatagagatggggtttcaccatgttggcctggctggtcttgaattcccgacctcaggttttctgcccgccttggcctcccgaagttttgggattacaggcgtgagctaccacgcccggccctaaatcttttcttattatgattccactcactgactgccgctatagtacttggaaacatattccagatttatattattcccatatttatctgtaaaaggcattacagaggttctttttttttttttttttttttgagatggagttttgctctgtcgcccaggctggagtgcagtggcgtgttcttggctcactgcaacctctgcgtcccgggttcaagagcttctcctgcctcagcctcctgagtagctgggattataggtggtgccactacacccagctaatttttgtatttttagtagagatggggtttcaccatgttagccaggctggtcttgaactcctgacctcaagtgatctgcctgcctcagcctctcaaagtgctgggattataggcatgagccactgcatctggcctaaggctgtacagagttttaaagcaagttttcattatagatccacttctggttacctttaggtaacctcacttattcactttggcattgttgctatttcaaatttcacctttatgatagtggaaaatgatataatctctctaaataatgtggtctattcataaagaaaaataggcttgaatttatatcagcagagtaaagtgtatgtgaagactgaagaaagatacattttctggctgaacagaaaacacggtgaaacgatttgaaaacttttattgtgaattacagggtcctatgaaccctctgtccgtgcctttatgaatatcaacatagacatgtttttttttttttttttgcattaacaccgttttctgtaatattttctttattttacatcaactgctgtactcgatcagccccttaacacgactcgtataaatgctgctgaaatagaaagcagagttcgagaactaagcaaattagctgagaccacagataaagtcaaacaaggcttttgggaagaatttgaggtaagttattaaaaaactgtttttacgtgagttgttatatcctatttttagtggaggagaagttgctcttgtgtttggaattggacctgagagacttgaaactgacgtccttttttaattcggccattgattgacacggagcaagttgctgagagggcttcttcgaaacagaagagcattgtgttctgagggaagggagttggcagtgagtagtcaatggatgtgctagccgctccatttggctcttttggtttggactggtggcaaaatctcagagaaacaaaaggatctaatttcttcgaaagatttccagcatgcactggggtctttagaaacaatctatagccttagtgcagcaaatgagtatgagtaaaagagaaacaccttgtggtggcttttttttttttttttttgagacagggtctcgctctgtcgccgaagctggagtgtagtggcgtgatctcggtttactgcagccccgtcctccctgggctcaagtgatcttcccatctcagcctactgagtagctgggactacaggcacatgcccctatgcctggctaatttttgtatttttggtagagatgaggttttgcagtgttgcccaggctggtcttgaactcttgggctcaagtgatcctcctacttaagcttcccgagtagctgggactacaggcacacgataccatgcccatctaatttttgtatttttttgtagagatggggttttgcagtgttgcccaggctggtcttgaactcttgggctcaagtgatcctccagctttgacgtgccaaatgtggtggctttaatttcagagttcaaattgataactctggtaagttaagtgaactgatttcttttttttttaaattatttttgttgattatactttaagttctgggatatatgtgcagaacgtgcaggtttgtacataggtatacatgtgccatcatggtttgctgcacacattaacccatcatttaggttttaagtcctgcatgcattaggtgtttgtcctaatgctctccctcccctttaatgcatcagtgaaaaagtgatgataggctgggcgtggtggctcactcctgtaatctcagcactttgagagggtgaggcaggtggaccacttgaatccaggagtttgcccccatccccagacagtgtgtgtgatgttcccctccctgtgtccatgtgttctcattgtttggttttctgttcctgtgttagtttgctgagaatgatggtttccagcttcatccatgaccctgcaaaggacatgaactcattctttttttatggctgcatagtattccatggtgtgtatgtgccacattttctttatccggtctatcattgatgggcatttgggttggttccaagtctttgctattgtaaatagtgctgcaataaacatatgtgtgcatatgtctttatagtagaatgttttataatcctttgggtatatacccagtaatgggattgctgggtcaaatggtatttctggttctagatccttgaggagtcaccacactgtcttccacaatggttcaactaatttacactcccaccaacagtgtaaaagcattcctatttctccacatcttctccagcatctgttgtttcctgactttaagtgaactgatctctttcctgaaactaacttgggttggagaatgtccctgatgggaatgtgctgtgttcccattgcactcttctatatcacttacccattgacaatgtgatctctttcattttctcctcatccatttgacagaaaacttcaaaaacaaggattctggcatatttacctttgcagttgtccccagcatgtagcacggtgcctagtacacagaagaaactccataaatgtttgttgaatgagatttacatttaactcatgtttacatcattttattttcctgttctgttttatgggaatgattattctatgctttttgaggactacaatttataaatatttgtggattgaatgaataagtgaatactgggcaaataaagtccttttagccagagtatgtctgaacaacttgctgagatagatatgatttcccattttccagctgaggggcctaagggaggttaagtaaattattcaatcttcataccacagtttttgttttgttttgttttgttttttttcctcctgagacagagtctcactttgctgccatactggagtacagtggtgcaatcatagctcactgcagcgtccaacttctgggctcacgccatcctcccacctcagcctcctgagtagctggtactacaggtgtgcaccaccatagccggctaatttttcattttttgtagatatggggtctcactgtgttactcaggttggtcttgaacttctgagctcaaacaattctcctgtcttggcctctcaaagtgttgggattacaggtgtgagccactgtgcccggcccataccacagatattgattgaattccagcagtggggaggagtgtggaatagaacattctcagtccttgctcaacattactgaacagagacttgaatttgagtttattctctcatcccaggcttcgcgttaggctctgaagacactagtgaacaagacagacagggttactgcctttaaagggagcttttagttgagagaaggaaaacagtgatgaaaagcatcagtgaaaaagtgatgataggctggggcgtagtggctactcctgtaatctcagcacttttagagggtgaggcaggcagctcacttgattccaggagtttgagaccaggctgggcaacatggtaaaaccccgtctctacaaaaaatacaaaaagtagctgggtgtgggggtgcgcacccacagtcccagctactctgggggttgaggtgggaggattgctcgagcctgggagattgaggctgcagtgagctgagatcacgtcactgctctccagcctgagcaacagagccagaacctgtcccaaaaaaaaaaaaaattgatgataaacatagtgagacagaattttgaaatctcagcctcactgttgccttccttgtcccctgcctgcctaaataataaaaggcagcatttcagcagtcattcatttcattactttcacttcatttcaccttcataaagcctcatgaggtaagatgggaagatacagaagttttagaaaccgctcatcaaaattgaatggaaagccgattgttccaaaactttttagtgtggaaaatttctattatatgcaaaagtagagagaatgggatagttatagcagtatacctgacacccagcattaacaactgttgataatatggccaatctttttcgactctgccccactcacttccccagccctgacttgtcttgaagcaaatactttttttttttttttgagatagagttttgttttgttttgttttttgtttttgagatggagtctcactctgtcccccaagctggagtgctgtggcttgatcttggctcactacaacctccgcctcctgggttcaagtgattcttgtgcctcagcctcctgagtaactgggattacaggtgtgtaccaccatgcccagctaatttttgtatttttagtagggacagggttttcactatgttggccacgctggtctcaaactcctgacctcaggtgatccgcctgacttggcctccgaaagtgctgggattgtaggtgtgagccactgctcccggccttgaagcaaatcttaacacatcatttcgtctgtaactattttatttcaaaaaattataacctgaatagcattatcatatctaaaactattaacagtatttccttaatattaacacatatcagtcacattttcctgattgctacacacacacacacacacacacacacacacacacttgcaatttgtgtttttttctttttagatggatctcactctgttgcccaggctggagtgcaatggtgcattctcagctcactgcaacctccacctcctgggctcaactgattctcttgcctcagcctcctgagtagctgggactacaggtgcccaccacctcacctggctagtttttgtatttttagtagaggtggggtttcaccatgttggccaggttggtctcaaacttccgacctcaggtgatccacccaccttggcctcccaaagtgctgggattacaggcatgagccactgtgcccagcagcaatttgtttgaattgggagtgctttcttccaccttgattatgaaaaaatttcaaatgtgtataaaacagattcatataaaggatcctgatatgccattatcagctttatcaattatccctgtcatcatattttttatttataaatatttcaatatttgtggaatccttaaaaatgcatcacataacccaacattgttcatattataccaattgtcttataatttaaaaatattttgttcaatcatttttcagataagcttcacacactgtggttggctaagtctcataatatttctgttgtaaaaatcttaagtctgggcgtggtggcacacggctgtcattccagcactttgggaggctgaggtgggcggatcacgaggtcaagagatcgagaccatcctggccaacatggtgaaacccggtctctactaaaaatacaaaaattagctgggcgtggtagtgcgtgcctgtagtcccagctactcgggaggctgaggcaggagaatcgcttgaacccagaaggtggcagttgcagtgagccgagatcgcgccactgcactccagcctagagacagagtgcggcttcatctcaaaacgaaacaaaacaaaacaatcttaagtctcttagaatactttgatgccccttccatctctctttttctgtcttccttccccctctccctgtcttttctgctgttgaagaaagcagatcatttgtcctgagagttacttatagtctgaattttgctgagtgcctctctgtggtggacttaagcatgtatccatcccttatatttcttgtaagttgatatatctagagacttcattggatacaagttttctttggcaagatagcatgtatggtggtgtatcaggaggtgtttatgtcctgttgtttcttctctgattttcttagcagctcctgatcattattacttagatccattaattcataagggactatatggtagtgatattgtaattttatcattcttcttcatttgttaggttggcatatttctataaaaagcttttcatcgccgagggttgattttttccttcttactaagcagttttcttttctttttcttttttttttttttgaggtaggtctcactgtgttgctcaggctggtgtgcagtggcgcaaacacacagttgcgaactcttgggctgaggtgatcctcctgcctcagtttcctgtgtagttgggaccacaggtgcatgccaccatgcctggctaattttttgattcttttgtagagatgaggtctcactttatttcccaggctggtcttgaatgtctgggctcaagcaatctttctacctcagcctcctgagtagctgggactacaggcacataccaccatgcccagctaattttttaatttttatttttagtagagatgtggtcgtattatgttgctcaggatggtctcgaactgcagagctcaagtgatcctcctgcctcagcctcccagtgtgctgggattataggtgtactacaggcaagagccaatgagcctggtcagatttttttttcctgatttgaaatctgttatgggttcaattgatacttccaaatcaaactcagggtttcaggatttttactaacctcattgatcttacccatgtatctcctttctctaatgccaaaaatcctacttcttgaagccataataagattattcatttgttttatcccacattacacacaacaatcttagaataatgacttcccaataatatgattactgaaaacagtttaattttttttgcgcttttcaaaaaaatccttcagagatgtgtagtcaagttactgtattctgctgggcacagtggctcacgcctataatcccagtactttgggaggacaagaagggaggatcgctggacctcaggagtttgagaccagccggggcaatatagtgagaccctgtctctacaaaagaaaattaaaaattaaccagacatggtggcatgtccctatagtcccagctattgagaggctgtggcgagagtaggcttaagcccaggagtttgaagctgcagtgagatacgattgtgacactgtactctagggtgacagagcagggaccctgtttttaaaaaaaaaaaatgaaaaaacttcctgtgccttagactcatttgtaatcgtccttctctctgtgtggctatatgctaactgggtatatggttagtttatttgtttcatttaaaaaatctctttctgttaagttttatttataattacacaaatactggctttgatagtcaaattgaaaaaacaaagtgtattcaaagaagtctaccttctatccttgtcctttcctatgttttagccatagtataaaaagttatggtttatcattatatttcaaaaatataagaagatattcccatatcccactttttcttaaacagtagcataactttacatacttttttctaaccttgcttttttaaatatcctggacatcctggatatccataatagtgtctagagatagtcttcattctttttttactgtatagtaatccactgtgtacttgtaccatagtttattcaacctattgatgggcatttgggtagtttccaaatgtatcacagagaggattacagtgaatagccttgtgtatgcatcctgctttacttttgctgactactggtaatattaacattttttatgttctgtatttaaaaaatggtggttattattcatctataacttttattatacatgactttggttagcatgctttaaccttttagcataacatttgcaagctacttgttttaattaaaattttggttaaatgtaaaaaatagtgagctattttgtaatctagattcaatagaatcttatacttcctttacaaatgatagctgagttgatcatttgtgtaaatgactgtgaacttaaaaattacagcattttttaaaataaatttttttaacattttaaaattatttaaaataatagacacacaaagtaaaaagagaagaaaaaaaaaagagacagggtcttgctatgttgcccaggctggtctcaaactcccaggctcaaatgatcctcctgccttggcctcctaaagtgtaagccaccacacttggcaaaaattagtttctttaaaacaaaaacattacaggttatctggtaccatggtagcttctttaacactaggttcacttagaacaaagcttaggaacaaagtcagactttcacaaagagcttgtgtggcaatggggtattttttgcaaattccattggtggggtcaagatgtgagtttagaaggaactcttagcctgactcttctggccatggaaaaagatggttgcttctaaatgctgacctggtgattttacactgtcacatctcaaattgtggtcatcttttatacattattaacaacaaaagggaaaaattgagttgactttaagaggaagtggaaaataacgagatcacatctgtactctacaggctctccacagaggtcagactgaggtggtaaaattgttgtgcactaaattagggcattaacgtttcatggaaactgaagctatatctaaatagctgatggcctgctttctagatctcctatatacctgcttctcaaattcagtctgttttaaaaaattgccctttgaggttggaaccagcgaaataaggctgaaaacagaataagccattattgaaaaaattaggaacttggaagcagatactcataatctaaatcctctgaagctaaagtttgatccacaatagcaaagcattatcattttagtgattgtaccttagttgtttcctggcaggtgataaatttgggatcactttcttcttacagtgtgctctgatagtctttaaaacaaaccagagctctaaattgtaatgccattggtaatttaactctgatttgtctctatgcctgtctcctggtgttctgtaaaattctacacgtcatttcaggtatcactatccagaagacgttacttttgcctttgatgcactttaaaatgtgaagtctcttgtgaagctctttggttattttctcctttgctgctgaaataaattcaggttgatgattttcttgtaggatatgttgtgtgatctagacattgcaaacccaagtctttgatttttttttccctacagattgcctgtttcttttttattttaatttttattagttattattatttttgagatggagtctcactctgtcacccaggctggagtgcagaggtgtgatagctcactgcaacctccacctcccgggttcttgtgcctcagccacccaggtagctgggattacaggcacgtaccaccactctcagctaatttttttgtatttttagtagggatgggatttctccatgttggccaggctgatctcaaactcctgaccttaagtgatcttcctgccttggtctctgaaagtgttgggattacaggtgtgagccactgtgcctggccagttattaatttttttaaagagatggggtctcactatcttgcccaggctggagtgcagtggctctttacaggcactgttgtagtgcactgcagccttgaactcctgggctcaagtgatcctcctgagaggctggaattacaggcacacaccactgtgtccaacagattgcccatttgtgatctgtgtaaatatctctcacttcctgcagtatctctgctcaagaatgtaaagagatggataatatttttagatttgttgaaacaaagtaaagttctgctcaaatgagaatgacactaactaaatgaaaaggccggttataattctgtaattttgtgcctgcaatgtgtgtgttattgtacacttgaatcggccctgtgcattgtggcgaggtgcatattgcatggttgtattgaaaaggtgcttgggccgggcgtggtggctcacacctgtaatcccagcaatttgggaggctgaggcagctggattacctgaggttaggagttcaagaccagcctggccaacatggtgaaaccctgtttctagtaaaaaatacaaaaaattagctgggtgtggtggtgggtgcctgtaataccagctactagggaggctaaggcagggagaattgcttaaacctgggaggcagaggttgcagtgagctgagattgtgccactgcactccagcctgagtgtatcacaaaaaaaaaaaaaaaaggtttttgccctctctctgtgcctgctgctccctgttgagtcctataggcctgagctgccagggggtactgtgggctgagactggacattgcaaccgactgcaaggcaccgtgggacccaggttgtggatggactgtctctcgggctttcttctttccattcatcttcctcctctaactcccctctgtatccagtatccttgctctccatacacctgcttcattctttttccttcagtagatttttctgcttcttgacttacaaaccctacttctagcccctttcagatattgaaactagcaactttcaggctttgtaccaaagtctcagagattctcattgactcggatgccatccatctctagtccaaagaacaatgtcaaggacatgaacatgtggaacaaaagtgtctgctgtggacacctttggggagaaatagttttcagtgatgagggttgtagtgagttgggcagatatcccaaaaatatctgccaaaaactatagacacttctggttgcagtgacttattccttccttcattcagcaaatactgattgaacaccgactgtatgtctggatctattctaggttttgggggtggagcagtgaacaaatcagtctttatctttatagagtgtacagtcaagtgggagagacaggcagtaaacaaagaaacagttcaatattcaatctgtgagatggtgataagtgctacagagaaaacaaactagtgtaagataaaaagggtgttttgataggcctttactatttaggtctctttgataaggtggcatttgaacaaagctctgaaggaaataatggagccaaccatgcatataacctcagggagaacattctaggtagagggaacagcaagtgcaaaggccctgaagtgggggtttgtttaccttgttgcacaatctgcacacaggccagtacaattggaatggatgggaaatgtaaaagagagaagttgaaaaggccaggtgcagtggctcatgcctacaatcccagcattttgggaggctgaagtgggaggaatttgagatcagcctgggcaacagaaccagacctcgggctaatttttgtatttttagtagagacagggtttcaccatattggccaggctgatctcaaactcctgacctcaggtgatcctcctgcctcagcctcccaaagtgctaggattacaggtgtgagccatggcccccagccgtatctttgtcttaaaaagtaatctctgtgcttggtaggccaagaatttaaaatataaaaaatttaagaaagaaaaaaaataagtaaagtaactatacaggttggtctggccgtaatggtgagtgtcattatttttcttccctaggtattttggctctgttgctcagagcagtgcaggcgaaatggtcattagggcatcgtcatggtgcctggggatgcctggctcagccagtttattttctgtctgcctctctccttggtccttttcctccactttcattcatgaaattctagtcaagagctgggtccagtggttttcaatccaagggctttggaagcctctggggtctattttggtcattgcagtcactgggctgctgctcctggcatttaggttggcaggggtctgggctgggaagcaggaatgttcagtggccataaatgtaagggttggtcttacatttacataagggagacaatgaaaacttaactcctccacagtagtggagtagtgccgttgggtactcacagtcagtagtgccgttgggtactcacatgtacaacatggatcaggacattgactttctgtggataccttttaatagtttattagatgtgttaggctgttttgcactgctctaaaggaatatctgagtctaggtaatttataaagacaagaggtttaattggctcatggttctgaaggctgtacaagcatggctccagcatctgcttctggtgagggcctcaggaagcttccggtcatagtggaaggcaaaaggagggcagacgatcacatggccggagtggtggcaagggtggggtgggagccacgctctttttttaattttattttaatttgagacagtgtctcactcttttgcccagcctggagtgcagtggcgtgatctcagctcactgcagcctctgcctcccaggttcaagcaattctcctgcctcagcctcctgagtagttgggactacaggcgcgcatcacaatgcccagctgatttttgtatttttagcagagacagggtttcaccatgttggccaggctggtctcggactcctgatctcaagtaatccgcctgcctcggcctcccaaagtgctgggattacaggcatgagccactgcgcacggccaccacactgttttaaacaaccagattgcacgtgaacttagagtgagaactcactgtgaggatggcaccaaaacattcatgaaggatccaccaccttcctttaggccccacctccaacactggaggtcatatttcaacttgagatttggaggggacagacatccaaaccgtatcattaaatttaatagttttatgcagtttttttggctctagatctgtttagactcctgcagtcaggtgtctgtaactagcctctggtcctttttgagagttcacagtttggtgcaaaccctttggatgtattatttgggaaaatgggatatctggcagcctgtgtccctgctttacattatcctttttgctgcctgccccaagcctcctcattagcatccctgccaaggccagtggagaaggatggagatgcggtgacattcagcttgacaggtcattagcagcttttgtgccctagggactgctggtgggagggaggttgtggaagataaaccctgacaggaatgtattctcctcgagggcagggtttatttgatatttttctggagcttagaaccataagcctggtgctggggaggaagcgcccttagcatttggtagcctctgtgggcagagcatggaaagtcacaacttctgaattgtttgtattttcagtctcactctagatggatggcatcttctgctatgggaaatgaaatatgtttaggcaacttgagtcccaggtgcagatgaggctgggctaattggtgcactagggaaggagccgggggagagatgtgctgttagctattatcaatctgtgacaactgtcagctgctggcagttagcacccacctgagcctgggatgcaggggtgcctctcctgtcctctgtggaagcctctggacccagcagccatcttgactgtgcactgttcaagccccaagtccgcctggaagaggtgattgagaacttactgcaggataaggaaagcgcaggacaggtgcagtggctcacgcctgtaatctcagtgctttgggaggctgaggccggaggagggctggagtccttgagtgcgagaccagcctgggcaacatagtgagaccctgtctttacaaaaaggaaaagaattagccagatgtggtggtgcgtgcctgtagtcccagccactcaagaggctgaggtgcgaggatcacttgagcccaggagtttgaggttacagtgagctatgatcataccactgcattccagcctgggtgagagagcatgactctgtcccaacaacaaaaaaaaagattaagggaagcctctggcagacctgatgatgggtggcccagccaaaatgagtattgatgaggatttccctggtctggaactctgaatttagtctggcaaagtattccctttgtgttgtgagatgattcttggtgttaccccatcacggtaggtaagatgaattagcaaatgagaaaggctttctctttttcatccttatctagtccgtagatgaagcctgaagaaggtctccatatggtagtagtaagtgtttaacatctacctctaacacttgcctgtgtctttttttttttgcaaagcctcaggaatgccccagtatctaggtagaatttgataatatttcatttttgttatattcccttttctgtttaccttctatatacagcaaaatgaaaaaatttttaaaatttgtgcaagtaagggcaatttcttttttctttttctttttttttgagacagggtcttgctctggcacccaggctggagtgcagtgacacaatctcggctcactgcaacctctgcttcctgggtttaagcgattctcctgcctcaggcttccaagtagctgggattacaggtgcctgccaccactcccagctaattttcatatttttagtagagaccaggttttgccatgttgactgggctggtcttgaactcctgacctcaggtgatccatccaccttggcctcccaaagtgctgggattataggcttgagccactgggcctggctgaggcagtttctttttgaaatatattttgtgaaggagaaaaagaggagttcagtttaaagaaacaaatgacataagaggtggtatgcagagatgccaaagcatcttgaaggtgcttttttttttggaaacagagtcttgcttcattgcccagtctggtctgcagtggtgcaatcatggttccctgcagccttgaccttctgggctcaagtaatcctcccacctcagcctctcaagtagctgggactacagatgcatgccactatgtctggctaatctttaaattttttgtagaagccagctctcaccatattgcccaggctggtcttgacctcctgtcctcgagcaaaaataccgattttgattaagtctggggtaggacctggggctgggattctaaccagctcccaggtggtgctaatgctgctggtctacagaccacacgtggagtagccagtgtagagttcatgtagcaatagtgatgtcatagaaatagccagtatctgtatacttgctttgttgtatgtcacgcactgtatagtgatgtacatgcatctcatttgaccctcaccccgcccctttgggggtagaaaggattgtgctcatttcacactcaaggaaactgaggcacagacaggcaaagtagcttggcgaaacagaaaggaacttagaggcaggccctgattagctcagagactagaaggccttgtgcgtcatcctgaacagcttggacttgatcttgaaggtggagggagaaattgaagggtaattaaacaggaactgtaggaaattcaccttgcatagtgattgctttggccacgtgtgccctgccaccgcccccccacctcagtgaagtgtcatgcgaagttgggttcgtaaatgaaggcccgaatgctttcctgacaagtttgttttaaatcaagctgctaattagtcccagtccccctcccccggtatgtatttttttgttgatgtcgtttcacttcatttagttgaagtgattgattcagttcagtgtttgaacttctttttgaacctcaccttaataacctgtctaaacatcaaggttaaaccttcttgctaacacagcagtattgcttggtaagactggctcacagtccaaggaaatgcttgcccagagagggcaaactgccttaactccttaacctgagctcattaaaaaaaattcaaatgactgattccttgtcacagttctacctacattgtttttatttttgtccaggtttcagctagttaaatgcttttgtgatgagcttatgtccaggctgaaggttgcattttgaaactgagcgtcaaataccaatttaaagtccagacctttacacttgtgaaattcagataaatgaaatggaaataaaacagggctgctgtgttgtgaaatatgactgtgtttttccttgtaggactctttgagggtagccattttggcattttatatataaattttcttttcttagcctaccttttactttcttgatttgcctatttgtgatttcccattaaacactaggctttttgtaaaccaattatcccttgaaattgactttttttttttttgagacaggatcttgttttgccacacaggctggagtgccgtggctccatcatatgataaacagaaagagagagagagagagagagagagagagagagagagaccctgtcttatttaaaacaaaaaaagaagaagaaaaaaagaatatagatcacagctgttatttgtatatgctacgccaatccttgttgggtttcattctttataattgttatttttaaagatttttcttatgaatattctattgtttcattgtagaaaatttaagggagaacacagtgggaaaaaaaaaacaagaaaaggacttcataatcctgctaccctgggagaaaaaaaaaatcaccattacctatttggttcttctcccacttttttttttttcgagatggagtctccctttgttacccaggctggagggcagggacgtgatcttggctctctgcaacctctgcctcctgggttcaagcgattctcgtgcctcagcctcccgagtatctgggattacaggggtgtgccatcacacctggctaatttttgtatttttagtagagacggggttttgtcatgttggccaggctggtttgttggccatgtctggttttttgtcatattggccagtctgtttgtcatgtcaggctgacatgttttgtcatgttggccaggctggtctttaactcctgacttcaggtaatcctgaagtgctaggattataggcgtgagccattgcacctggccttctgccttttttttaaagaaaaaaaattaaaacatttttttctttttaagatagcgtctcattttgttgcccaggctggtcttgaactcctgggctcaagtgatcctccagcctcagcctctggagtagctgggactacagatgcacatcatggtgtccttatgccatttcttttgtacgtaggtgaatgcaagtgtatgattacatcatatgctattttggaggtttgactttcttttcactttcatcatctttccaaggtgttattttcctagtacatctttttaaatggacatagaacattcttttgtatgaacaaacaatagttttatttaggcggtcctttcctgttggacatttatattattttcagcatttctccacagttgttgcagcattcagatgaaccttctttttttttttttttgagacggagtctcgctctttcgcccaggctggagtgcagtggcacaatctctcctcaagtgattcctgtgtcaccctcccacgtagctgggattacaggtgcccatgtctggctaatttttgtgtttttggtagagctgtggttttaccatgttggccaggctggtttcgaactcctgccctgaagtgatctgcccacctcagcctcccaaagtgtggggattacaggtgtaagccatcacgcctgacccagatgaacattcttgtagctatcgcacacaattctgaacatttcctaggatgaattccttaaagaagtaatgctgatccaggcttttttctttttctgtgactctttgacacgtaataatattgacttttctttctttccagacactacaacaacaggagtgcaaacttctctacagccgaaaagagggtcaaaggcaagaaaacaaaaacaaaaatagatataaaaacatcctgccctgtaagtatcaatattccgctcagtaatagtcactcttggagattttgattcctagcacctctgtacctttcctcagggtcgtgtgctcttgttagcacatcggaggccttagcttctttaattgcaagcagtttccaaaataatcaaccatggtgggtgttgatgacttcattcactgagctcccgtgatgctgattactgagtaaagttgccactaggtggctttgtctgtggttggttccttctgttaattaattttctgtctgcccaagatagatcatctcaaggcttgggatctctcagtgtcagggaccttagggtgccagatttgtgtcttgactcctcctcactgggcctgtgagtcctgggtaaggcctgcctcctttctgggactcagttcccttaagtgggaaacagacaaacacctcctgagggctcctagaactgttctgcttgctgatcccctgagctcaagttactggagaaagggtatatacctaaactgctcagaagaagactttgtgggccgggcgcagtggctcacacctgtaatcccagcactttcggaggccgaggcaagcggatcacctctgatcaggagttcaagaccagcctggccaacatggtgaaaccccatctctactaaaaatacaaaaattagccatatgtggtggtgtgcgcctgtaatcccagctactcgggaggctgaggcgggaaattggttgaacccaggagatggaggttgcagtgagccgagatgtgccattgcactccagcctgggtgacaagagcaaaactccgtctcaaaaaaaaaaaaggaagactttgtgaatattcgcaaagctgtaaagctgtacctttcaatttttttttgagacatagtctcactctgttgctcagggtgcagtcacagctcactgtagcctcaacctcctgggctcaagcgattctcccacctcagcctcctgattagctgggacaataggcaggcaccagtacacctggttgattttacagtttttctgtaggccggcgcagtggcttacgcctgtaatcccagcaccctgggaggccgaggtgggcggatcacctgaggttaggagttcgagagtagcctggccaacatggtgaaaccccatctctattaaaaattacaaaaattagctgggcgtggtggtggatgcctgtaatcccagctacttgggaggctgaggctgaggcaggagaatcgcttgaacctgggaggcggaggttgcaatgagccggaggtgctatgtgcaccactgcactccaggctgggcgacagagtgagactctgtctcaaaacaaaaaacgatttaaaaaataataaaattttttctagggcggggtctccctatgttgcccaggctggtcttgaactcctgggctcaagtagtcctcctgcctcagcctcccaaactgttgggattaccagtgcaagccattgtgcctggctgtaccttctgtaacacccaaatgccacctggcaaagcccaagttgaatcatgaggaaaaaaggcctggaaggatgtagaccttccttttttctacttatttatttatttatttttgagatagggtcttactctgttgcccaggctggagtgcagtggcatgatcatgggtcactgcagcctcaacctcccgggctcaagtggtccttcccaccccagcctgcaatgtagctgggactacaggcatgtgctaccatgcccagctaatttttgtattttttgtaattattttttttgtagagacagggtttcgtcatgttgcctaggctggtctcgaattcctgggctcaaacgatctgcctgcatcggcctcccaaagtgttgggattacaggtgtgaaccactgtgtctggctatatcttctgtaacacccaaatgccaccaggcaaagcccaagttgaaccaggagggaaaaaggcctggcaggatgtaggccttgcatgaggatctcagaaactgcactaaaccagtcacagttcctctctcccgaggtctaactctatgctgaactctttgcatttttatctcacttaatccatatcacatgcacaggaaggaagcattcgtagtatcctggtttcctagaccattttagcaaggttataagtgaaggggagtgggtgggagaactggcactagagcccccaaagtcactgttcttagcaccactctaatgcatggggttctccattgatgtgctatgcaaggcagtgcactgaggagaaaggaaggaacatttacaacttctctttatttatatcctgtccctaaaaaaaaaagaaaaagaaaaatttgtctgaggcctagattgattgcagggagtgcataatgttttattgattgattgattgattgtatatagagatggggggtctcactatattgcccaggctgatctcgaactcctaggctcaagcaatcctcctgctttggcttcccaaagtgctgggattacaggcatgagcgactgcacctggctatgcatactatatttatccaacttacaaataaggcttgcttgcctgtagtgcatatgtgtatacatttcagcatagaaaaactgtgtgattgggggttgtgatcaaatttggagagcattgctctcatgtcttatcaggtcagagtcattttgtcaaatcttgtaaaccattctttgtgtgtgtctatgcatgaaacatagtctttctctttctgcatgcatatgtacatatacatggtatatatgtatatcatatctacatggatattgtaatgtatatgtatgaggatgggggaaagtggagacatttgtaatactgagaaaaggcagtgaggaatttgcagagaagcagtttgagctgtagcatggtactagtgaccttgaggaagccttatcctttttttttggaatttattttttcaatttttagaaatagacaagagtttctctatgttgcccaggctggtcttgacctcctgggcccaaactatcctcctgccttggcttcccaaagtgccaggattacaggtgtggaccaccatgcctggccaccttgtcctttctatgtctaagttgtgacatctgctcaggggtcaggtggtattaaatggtataaaatgtatgggaaagtgaagggatcaatggtatgcagtatctaaatagaatatcgctttttcctcccttaaaggtctcattcagatgtttcctctgatgaacatctcatttccttaaagatgaggagtctgaagcaaaaaagacattattcttttaagacacatggctgtcttactaattcccattgcaaaatatgttgtttaggtagagcactcagatttttatacgaataatagacttttgtacagaatttggacagttgatactatcagagccttgtgatattccactgcattatgcttcactaaaaaatacctggctgggtgcggtggctcacaactgtaatcccagcactttgggaggctgaggtgggcagatcacctgaggtcaggagttcaagatcagcctggctaacatggcaaaaccccatctctactaaaaatacaaaaattagccagatgtggtggcacgctcctgtaatcccagttactcaggaggctgaggtatgagaattgcttgagcccaggaggcagaggttgcagagagccgagatagtgctattgcactccaacctgggtgacagaggaaaaccctgtctcaaaaaataaatttaaaacaacaacaacaacaacaacaaaaacccctctttattatggaaattttcaaatatattcaagagcataaagaacccacatgtacccatcacccagcttcaacaattatcaactcatgcccagtcttggtttcatctatactctgatccacatctcctctctccttgaattattttgaagcccatctcagacatcatgtcatatatgtatacttcaatcttctttttttttaaaactccccctccccttttcttttttcttgagactgtgtctcactctgtcatccaggctggagtgatcttggctcactgcaatgtccgcctctcgggttcaagcgatttttgtacctcagcctccctagtagctaggattacagatgtggaccaacatgcctggctaatttttgtatttttaatagagacagggttttgtcatgttggccaggctggtcttgacctcctgacctcatatgatccacctgccttggcctcccaaagtgctgaaattataggccactgcgcccagcccaaaatttcttggtttgaaataattttggaactcataagaagttacacatatagtagagagaattttcttgtaccttctctgagcttcctatatacccaatgataacatcctatatacccatagtatatgatcaaaactaggaaattgtgaagatggcattttgagacatcaggcagtgttcacgttactgttttgcttacctgggctttaatttttatgtgtttttttttcaatcattgaatgaacaaaacttggactaggctggggagtaactgatttgaactgttttttcctgaagcagtccaggacttatgtgaccgtggtctctttttcttctagttgatcataccagggttgtcctacacgatggtgatcccaatgagcctgtttcagattacatcaatgcaaatatcatcatggtaagctttgcttttcacagtgttttctgaccatacatttctagcctatttttgtattttaaatccttcctcatgtcctgaaagtaactttaaggtgtttgaaggattttcttcctaaatttctagcctgaatttgaaaccaagtgcaacaattcaaagcccaaaaagagttacattgccacacaaggctgcctgcaaaacacggtgaatgacttttggcggatggtgttccaagaaaactcccgagtgattgtcatgacaacgaaagaagtggagagaggaaaggtaaatcacagaaacttcttttctgctaaactgtttttaaagtatcagacatgtcagattggccatgtttaggaattgaataaatgaattaagcttactgtaactgattctctggaaaaaagggactaggagaaatttgattatgttattccttggtgtagttttctttatgtttcttctgcttgggatttgttgagcttcttggctccatggatttgtagttttccttaaatttggataatgttcagtcttagtttcttcagatacatatcctgggctgggcatggtggctcatgcctgtagtcccagcactgtggggtgttgaggtgggcggatcacttgaggtcaggagtttgagaccagcctgggcaatgtagtaagaccccatctcttaaaaaaaaaaaatgtaccctgcacaaccttgtcctaggacagcagtcatacgtgtattagactacttgaagttgtctcatagcccactgatacttggtttattttattcagttttttctccccgtgtttcatttcgaatagcttcttttgctatgtctccaagttaatcttctgcaatatgtcatccgctcttaatcctatccagagtatttttcatcacagacattgtatttttcatctctagaagtgttaatgtcatctatagctttccttttaacatgtgtagcattttccttaccttttgaatgtatggagtatttctgttgttgttttttgttttgtagagacagggtctcggtctgttgcccaggccggagtgcagtggcatgatctcagctcactgcagcctctgcctcccggttcaaatgattctcatgcctcagcctcccaagtagctgggactacaggtgcgtgccaccacgcctggctaatttttgtatttttagtagagatggggttttgccatgttggccaggctggttttggaacccctgagcttaggtgatccaccttccttgacctcccaaagtgttgggattataggtgtgagccaccatgcctggccatgttgtctgttttaattaactctgcctaactgtcctcccaaatggttgctgcagtgctcactcccaccagcagcacctgcctaggactcattactccatactcttcaagacacttcagattaaaaaaataaattgtaacaccccacacctacagaagagcggacagatcttattgagtgacagccctctgtgttatctcaaagtgagcccaccatggtggttttttttttaaatatggaaaagttctgtgtttttgtttgtgttctagtgaaagttcttttttagatatcctttaattggtttatataagattttatgtggaatgtagcagtcatacctataaattaaacctaaggcagatggagaactttggagttgagccttcctactgtaattttcatattggatgtgaagggcagtgtgattttcataagactttcattgttgtactcctagttggtatacttctgaatacctttgaggccagttctggtcatcgtgaaacaaaggtttccttcagcaaatgcctgtggtaacattaggtgttcttgaattaatggaccaatgaaaacatctttgtagtttctgcttcaggcaagggttttttgccctaaatgtggataggaagaatgaagcccttcatcctcctttttgcctgattatagctataggaggttcacctgttctcagaagacatgaggattgtgaagagaggggtcttgtgttgcttcagaggaatcagtatcagtccctttcagaagctctcctggatagacaggcattagggccaaatcactctgccccacccctcaccaccatgtcctactctctgctccctgtctcattcttcctctttactttggtggtgccgagaggatgacatgatgggtattgattctctccacagacctttctgacatcctactttcagtatccccccagtgcacagaagacaagccagactgtggactgtgtttgattcctgggctctattttaaaagacagtgtattagttctcacattttagaatttgtttgccaaggtttccacgggagtttagaaactagggggagggctgatgtttaaagttagctaaaatgttcttttcagggtcatgatttaattttatattctctggtgagttccctatagtgactgggagcagtcctcagtcttgattggccagtgacagcatagagtacaattaatattaggagtgctcatttggggaaactaaaatttgcatcaaatctgtcagaggtgtttggatctacaaaataccggagggaaagctgaattgagaatcataataaataaaagaccacatcgttcttttttttttttttttttgggactgtatcttgctctgtcactcaggctgcagtgcagtggcactatcttggatcactgcaggctccgcctcccggattcaagcgattttcctgcctcagtgcctgagtagctgggattacaggcgtgtgccactacacctggctaatttttgtaattttagtagagacaggtttcaccatgttggccaggctggtctcaaactcctggcctcaagtgatccacccggcttcccaaagtgctgggattacaggcgtgagccactgcgcccaaccaagaccacatccttttattgaacgttcctcctaccatgttttcttttttctttcaattaatcattgactcattgactctcactgttgatgtctgtagctgctctcttatttccagttttatagctgtaaatttctctgtcttcctaagatacaaggtaaatttctcttgctgatattggtggttttggaaagtgagtggtgtggatgactgcccagaaaacaacagaacacaaaagcattctctgcccagaacacatcaccaaatagatacaaactcatctcttactgagtgaaatagcttcctttttggcagcaagaatgattttcttggtgccatatttttcaatccgcctgctcttgaagccagcagctattgcagacttggcattcccaggcacccagttaagggaaagtgacgtgtagaggaggtatcagatgggtctggatatagaaaaagcagctggttcaaaaccccatgggctgcctttctgtgatagagttattcacacttgggttagataaggcacagagtcctcctacactggtgcggaaatgaaacagacagtctggctcgttgggcagcctagcctcctccagaatctgtgcttgccttccctatggagtgactggtagatcttagaattcagacctcagtggttgctagccagcactctcacattggttggtccttctctctgcatctttgattctttagagatagataaaccaagcaccgactctcctttgacatgtgcttggaacagacacctgcacgagctgcctttctcctcccacttctgcctggtcttccaaacacctgcttttcttgtttgaactcttcctttttttttgagacagaacctctctctgtcacccaggctggagtgcagtggcatgatctcagctcactgcaacctctgcctcccaggttcaaataattctcctgcctcagcctcccaagtagctgggattacaggtgcctgctatcacgcctggctaatttttgtatttttagtagagacacggtttcaccatttggccaggttggtctcaaacctctggtctcaagtgatctgcccgcctcggccacccgaactgctgggattacaggcatgagccactgcgccccagctgattctttacagataaacaaacattgactctgctttgacatgtgcttggatcaggtaactgcaccagctgcctttctcctcccacttctgcctggtcctccgaatgcctgcttttcttatttgaactcttctgtccttttctgaaaacctaacagatgcgaaacaggccattttccatgttggtggttattaagcaagacttgaacatttgtttgttgcttgtttaggcttttatttcagagttcacagaattaactttctttttttctgatctcttccagagtaaatgtgtcaaatactggcctgatgagtatgctctaaaagaatatggcgtcatgcgtgttaggaacgtcaaagaaagcgccgctcatgactatacgctaagagaacttaaactttcaaaggttggacaagtaagtatattgtcgtattctagagactttgggaactgttgatggtgtgtaggaattcagggtcttgccgttactcatgtttgcatacatgcatgcattcgctcactcattgattcagtagccatttattagcttccttctatgtgccaggtacagtttaagcagtactggtacattgtgaacaaggcaggtagtgttcctgccctcatcgagcctagggagatagacaatttaaaaacaaataactggccaggcgccgtggctcaggcctgtaatcccagcactttgggaggctgaggtgggtggatcgcttgagccggggagttcgagaccagccctgggtgggagactgggatagggtgacctgagtggctacaaggtctgttaggaggcctccgcaggggcctatgttgatggcctcctctccaagtatccacagacttcagcagttgttcttttttgttccttcctttggaatggaatattatataaaatggcagaataaactggaagagaagcagtagatgtgagaggtgccggggggtgaagtctgcaggatgtggggattgtttggcttttggaggaggaaggagggattcaagacacattgtagaggtttgagtctgagcggacagtggtgctgtggcagacaccacaaaagctggaaggagaactgatgtgggcagtgatttgttttcttctggatgtgttcagctgggcatctgaacagtcatgtggacattcatctattcattcagagatatttgttcaatgacctcttggttcctggcaccatgctgcttgctggagatagagctggggaacaaaacagatggaatccctgcactcccaagtgtacactatactggccagtaatctaccagcccagtaattgcacatataaatatatcattataaactgtaatcagggctagaaagaaaaaatgcaggagtttagggttcatttggagggggaagggacttttttttttttttttttgaaacagaatcttgttctgtcacccagactggagtgcactggtgcattcacggctcactgcagccacaacctcctaagctcaagtgatcctctcacctcagcctcccatgtagctgggggctacaggtgtgtgccaccatgcccacccaattgttaaattttttatagagacggttgtctcattatgttgcccaggctggtcttgaactcctgggcttaagcgatcctgctgccacatgcagcctcccaaggtgctggaattacaggcgtgagccagcgcacccggccaagggaggggaggttcttaaggcatagggaacaatgtgtttgagtcagcaaaggaggttgtgggggtttgtcctaagtgtggtaagcagccagagttggatttaagtttttaagagattcccctccaccctgtagagactggagggggcaggagttgttctagggattaggaccaatttggaggtagtgcagccgtcagagtaaaaaataatagggattgaactaggccagtgcccagggtgcctgaaagaagaggacccagtagagctgactggaggcagacatgcagggattcagtgaaggagtgtaccaagggcgagggtggtgtgcagggtgactggcaattttctagcttgagaaaggtccggggggatggcagtggagttgaggaagctgggaggatcaaggacctttttgtgaacacacaaagtttgagatgccttggacacattgaagtggagcggtcagggaggcaagggtggaggtgggatgcggaggggaggtgggatgcagagcgtcgtggatggatcagttttgctcgatagagggacatgtttttctgtggcaacaggagggcaaaaggagaaggtggccacagatgccggtagatgagctgagagtgattgtattccctatcctctcggaagcttgaggcaaggccatcaacagacaatcagagggaataagaagagatagaatatatgaagaaagggagaaaagatgaaatcgtaattgtgtagcagggcaagaagtccagaaatttctgtgctgtgccaagttcccagttgaggcggtgaacatgaaaatatactgatacccattgcctggtttttctccaaggacacttggctcctagggcacaaaacagaaagtacgtggtttgtccaggccgagggctttgcatagttgcagtggatggagaggaggtcaaggaatggaggcacatggtagagagagactgtccccagagcacggggactcctggccggatgagggggacaggggcaggaggaggcaggtggaaagtagagggagggctcagtggtctggaggctacaggaagtgacggggggaccagaaggagctggaaaccagtgtggttgtggcccagggtgggatgtttggatttctgatgtcagagagggtccagtccttctgatgatggggaggggtggaggctgaatctatggtagagatagtgagaggaactggaacaatgtagctgtcaagtggaaatgggagaaagggctgggcgtggtggctcacgcctgtaatcccagcatattgggaggctgaggcaagaggatcgtgttagctcaggagttctgggctgcattgagctgtgattgtgccactgcactccagccttggcaacagagtgcccagttaaaaataaaaataaaataaaataaaaaaattaaaaaaaaaagaagaagaaaaaagagaaaagtgtccttttacatcccttttaaaaatgtcacttaaggctgggcaaagtggctcatgcctgtaatccctgcactttgggaggctgaagtgggtggattacttgaggtcaggagtacaagaccagcctggccaacatggcgaaactccttctctactaaaattagctggatgtggtacatgcctgtagtcccagctactcgggagtcgagtctgaggcccaagaattgcttgaatcggggaggcgtaggttgcagtgagctgtgatcaggtcactgtgcaccagcctggatgacagagtgagactctgtctcaaaaaaaaaagtcacttagcttagattgtctctacatatataggaagaagatgtaggaatgaatggtgctgctacaattacgtcatctggatagacccagaaacatgatactttttggttttctgtagccttggtgccattgttgatctttattaattatcattatcctcaaaatagccataatgtgctgagtctcttcctatttgctgggcagaggctgagtatttcagcgagctcactgagtccttaaaattgcattatgatagagagaaagagattattatttgcattttgcaaaatgaagaaattgaggtttagagatacccaagggccacgtgagtgtgagtgcctggaattggagcctaaatctagtcatctgatagcaaagcctgttttcttatctgctttgcattaaatataagtttaaaatagaacaatactggccaggctgggtggctcacgcctgtaatcccagcactttgggaggtcgaggcaggcagatcacctgaggtcaggagtttgcaaccagcctggccaatatggcgaaagaaaccccatcgctactaaaaatacaaaaattagccaggcatggtgatgtgtgcctgtaatcccagctacttgggaggctgaggcaggagaatggcttgaacccgggaggcagaggttgcagtgagccaagatcacgccactgcactccagcctgggcaacagagtaagactctgtcttggaaaaaaaaaaaaaaaagaatgatactatagtctgtgtttatatggtggggaaggttgagtatcaaaaaaataacaaagaggaatgaatgtcttaagtgaatgcctgtttccccatctgcttcctcttctgctgggaggagagacctggatccctagaggtttcagttgcctccagagctgagtgccacagggatgcaggggaatagggatgttacctgtcgctggtaattcagagagatgattcagggtatagttacctgaaagaacaaattgccatgccagacgtcttggttcttatgacagaggcaaagagttgcctccaggattgcccaaaaggagacgagttctgggaacctcacgaagaggacctttcagtggaacctggggagattctcttcctctccattggatttaggaaagcttagaaccgggtgattcctcaacctcttgatttatttaattcttttctggtttttcttggctctactccaggggaatacggagagaacggtctggcaataccactttcggacctggccggaccacggcgtgcccagcgaccctgggggcgtgctggacttcctggaggaggtgcaccataagcaggagagcatcatggatgcagggccggtcgtggtgcactgcaggtgacagctcctgctgcccctctaggccacagcctgtccctgtctcctagcgcccagggcttgcttttacctacccactcctagctctttaactgtaggaagaatttaatatctgtttgaggcatagagcaactgcattgagggacattttgatcccaaggcatatttctcctagaccctacagcactgccattggccatggccatggcaacatgctcagttaaaacagcaaagactaagtcagcattatctctgagtccaccagaagttgtgcattaaacaacttcatcctggctctgcagtttctccttattcttcatgatgtttgctttgtagctgttgactgctttgtaggtattgaggtggtgggggtgtggtggaaataggcctgactcttgaggatcccttaagtcatttttgcttggttctctttttccttcttttcttctactcttctatgattcatctctttgattgtgattctgttctctctctctctctctcttttttttttttcgtttttgagacagagtcttgttttgttgcccaggctagagtgcagtggtgccatcttggctcactgcaacctccgcctcccgggttcaggccattctcctgcctcagcctcccaagtagctgggattacaggcatctgacactacgcccggctaatttttgtattttaatagagacaaggttttgtcatgttggccaggctggtctcgaacccttgacctcaggtgatccacctgccttgtccttccaaagtgctgggattacaggtatgagctaccatgcccggcccattctgttctcttctaccataaatatatttctcccctaacactatatttgtttgcttcacaagattccagctgcttttccaccaaggcctttgatggaagctgtgctgtgacctctgtaatgagtctgtgggctgctgattctccagtttgggcttcatgattatactggggaatattgggtttcctaaatctcattcatttcttgggcaagtagatatatgtgaaagtgtttatttgtccagttgttaaagaagctaccatttattgagccagcctctgagcacaatgttttttgttttgttttgtttttaatttttaaaattatttacttcttctatttcaataactttattattattattttttgagacagagtctcactctgtcacccaggctagagtgcaattgagcgatcttagctcactgcaacctctgctttctgggttcaagcaattctcatgtctcagcctcccgagtagctgggattactggtacgtgacaacatgcctggctaatttttgtgtttttagtagagacgaggttttgctatgttggccaggctggtctggaactcctggccccaagtgatcctcctgcctcggcctcccaaagtgctggtattataggtgagagccactgcgcccggccctctttcagtaattttgatgtatttttttgtatatgattcctgtttcattctgtccaaccagcactctgtatggtatgtgctgttgtccccatttcacagatgcagaaattaagggtcagagaggttaagggacttacctcaggcacgttgtactggagaagctgaactccaagagcaggtttgggctgactccaaagccctatgctttttgccaacatattttcaaacataaatagacaattttataaatagctccaaagagtagacattgtttctgttgatattaatggcttggttttgagtctgaaacccccatgaatgattctgttgtccctgctttttgtccttctgcccgcagtgctggaattggccggacagggacgttcattgtgattgatattcttattgacatcatcagagagaaaggtgggtcatctggtgggcaagaagcgacagtttctgtttttagtttatggaaggaaagtgctcacgaaaacagtctggggaagagaggttgaatgggaaaattctttcacaaaaatctgggctgaagacttcagtgtgtctgcctgagaacagaagtgacactatttgagcttttggcataaaatgaagtctaggagctgcagaacccactgccatggccttttgttgcatacacagtggtggtctctatccagccacctgaccttgtttacagtatggggtgatttgttggcaagtgagggaatcctgacttctgccacttcgttatttatgtagtcttctgggatcattggtattggtcagaagttcaacactgtagccattgcaacatgctcagttaaaacagcaaagactaaattagcattgtctctgagtccactaaaagttgtgcattaaacaacttcatcctggctctgcagtttctctttattcttcatgatgtttccttcgtaggtgttgactgcgatattgacgttcccaaaaccatccagatggtgcggtctcagaggtcagggatggtccagacagaagcacagtaccgatttatctatatggcggtccagcattatattgaaacactacagcgcaggattgaagaagagcaggtaccagcctgagggctggcatgcggattctcattctcttgctaggcctcttggatacgctctccttttgagcaggaggacaggctctgatagacaactgtttgatttcggaatgggaaacaaactcccaactaaaagggcctctggaaactgtcaattattctccacttctcagctctgatttttcactgcagaggagcttagggaagggcaccatcctatcagcctggcctgccagattgaagaactgccatgcagaaaggttctgatgttctcaggctcatgtggcaagcgtaaaactcaaagccttgaagtttctagcctgttccagccttgatccaggccatgtttatcctgattccatcctttaaaacgaatgcctcactcttaatagcgcacggcagtttgaaccactaatttggtcgagttggaaacagtgaaatttcaattttaataagctgtgcataatgaagaggaatgtggaattggagcctttccatctgaagctattcataacaggcacaaagctgagttaattaggaatatgctgagatgaaggaaatgaggagagctgctcttttgggggctgtgcttctctccccaacccctcaaccccattgccatgctgcagatggggtggtgtctaaacatcagtggcgagtgcctgcattactctgctcgttgccttccagagaactcagcttctccaaatgctgagctcttttcagaatgggacctgccaccagtatttgaaagatttctagcctagcagaacagcagccacgttatcaaagtttggttggccaaaggaaggtacttgctaattagtttagtaggttttcagtccgcacagacatacgggattgttttattgtacatagacatcttcagaaacagtgtatgtatagaaatgtaaggtcaaaatttgaacctcagtgctttaaatctgaatttgtattaactgatatgaaatatttagacggttactttattttatatctgtcttccattatacttaatttggctcaagaatagttaggcaaaaagttgcccaaagagaaggatctcctagtaaatacaaagagaatgtaacatagttgctacaagttggagcatgttcagggatgtctttttttttttttttttttgagagagaggtctctctctgttgcccaggctggagtgcagtggtgtaatcatggctcactgcagcctcaatctcccaggcttaagcgatcctcccacctcagcctcccaagtagctgggactataggcatgcgccaccacacctagctaattttcgcattttttgtagtgtcacagtttcgccatgttgcccaggctagtctcgaattcctaggctcaagcagtgcttctgcctcagcctctctgagtagttaggactacaaatttgtggctccatgcccggctaatttttttatctttattttgtagagacaaggtctcactgtgttgcccaggctagtcttgaactcctgggctcaaacaaccctcccactttgggtttccaaagtgctgggattacaagtgtgagccactgagcccagtgacctctgggttttaaaaatgtgtaggcttcaattatttattttaaaaaatgaaatcctgcaatatatagttttctgcgttgtgtggtttgaatcaatctgggaactggcttgctggctgattgtggtaaagtaagaagtacttaatttagtagaaagtttaaatggcagacataacattaaacccagctgatttataaatgaagcaaaagaacaaaactcattcaggataattggttattctaaaatacagtcatttctaaaattatgaagtgttcaggacctttgggagtgaaagaatttgctaaagaaggatcagtgaaaaaaaggaatgatgggtgaagagctgtggagaaggaagagaagaaacagcacaaggaaggaagaatataaaatcagatgtgggaatccaggggaaagtgcaaacgaagcaagattgagaaaattctcaagtttttataaacagttctcacactctgccagttccttggaggtagacttttttgttaacttccaactacagtagtgaaaaaaaaaaaaaaaccctcaaatttgcaaaagcagtctgtggaattttctttacccagctttcctgactgttaactttttagcacacttaactttatcattcgtttattctctctgtttaaaattaaaaatgtaaattttaaaaagtaaaatgtttgttggttacaaacatttatacccctttgtctctaaatatcatttcattttaaaaaatgaataatctaagcctacacattctaaaatgtgtatattttctaaaaataagggcattctcttacataaccaatgtcacaattatttgatacagtgatcaaaatcaggaaactaacattgatataacactattatctaacctacagaccatcttcaaattttgtcctgctagtatcttttatgggtccagggtcacacagtgcatttggctataatgtatcttttttctctttttttgagacagggtctcactttgttgcccaggttggagtgcagtggtgcaattatggctcacggcagccttgacctccttgggctcaggtgatcctcccacctcagcctctcgagtagctggagaccacaggtgtgcaccaccatgcctggctaagttttgtattttttgtagagatggagcttcgccgtgttgccccggctggccttgaactcctgggctcaagtgaccctcccgccttggcctcccaaagtgctgggattacaggcgtgagtcaccacacctggccagttattagtatgtttagtctctttaatctggaacagtttctcagtcattctttatttttcatgacctggatgtttttgaagagtttaggccagctatttagcagaatgcctttcagtttggatttgtccagtgttttctcttgactatattctagtcatgcatttttggcaggactgtcacagaaatgttgttgtagtcttcttagtacatcacatcaggtacacactgttgatctgattcattactagtggtgttaactttgatcacttgaataaggtggtgtctgtcaaatttgtccaccgtaaagttacttgagcaaaacgtagctgggactacaggcgtagcaaaaaatgtagcaaaaagtagtatttttgctacattttttttttaggaacaaagtatttttcccttttaagttaatctcttgtccataaagttattatttttcccttttaagttaatatcttgtgggtagatactggagactgcgtaaattacctatttctcataatactttttttttttttgagatggagtctcgcaccgtctcccaggctggagtgcagtggtgcaatctcgggtcactgcaagctccacctcccgggttgacgccattctcctgcctcagcctcccaagtagttgggactacaggcgcccgccatcacacctggctaattttttgtatttttagtagagacggggtctcaccgtgttagccaggatggtcttgatctcctgaccttgtgatctgcccgccttggcctcccaaagtgctgggattacagatgtgagtcactgcgcccggctctcataatactttttgcctactaattttatattcattgattaaattcttgcctgaaaaaattattactgtggtatttgccaaatggcaattttctgtttccatcattgcctttcccccgcttttaaaagtataagtgacaaagaaaaactgtatataaagtgtacaccatgatattttgatatatgtatactttgtgaaatgattatcaaaattgagttaaataatgcatccaacatctcagttacttttttttttttttgagacagagtcttggtttgtcactaaggctggagtgcagtgccacaatctcggctcattacaacctccacctcccaggttcaagtgattctcctgccttggcctccccagtagctgggattacaggtgcccaccatcacacccggctaatttttgtatttttagtagaggtggggtttcactacgttggccaggctggtctcgaactcctgacctcaaatgatcctcccgtctcagctttccaaagtggtgggattacaggcgtgagccactgtgcccggccactcttagtaaattttaagtgtacatttttttttttttttttttgagatggagtctcactttgtcaccctggctggagtgcagtggcatgatcttgccacactggaacctctgcctcctgggttcattcaggtgcttctcccacctcagcctcccaagtagctgagactacaggtacccgccaccatgcctggctaattattgtatttttagtagagatgggggttcaccatgttagccaggctggcctcaaactcctgacctcaggtgatctacccacctcggcctcccaaagtactgagattacaggcatgagccaccacacccagccacattacgttagtattaactataatcaccatgctgtacattagatctccaaaatgtattcatcttatgtaacttcaagtttgtaccctttgaccaaagtctccttgttttccctacccccaacccctggtaatcactgctttaatctcagtttttatgagtttgactggtttagattccacatacaaatgagatcaggcagtgatggtttatttcacttagcataatgtcatccatgttcttgcaaatgacaggattttcttctttttaaaactaatatccatgctggacacggtggctcatgcctgtaatcccagcactttggaaggctgaggagggtggatcacttgaggtcaggagttcgagaccagcctggccaacatggtgaaaccccatctctaccaaaaatataaaaaattagctggatgtggtggcgcacacctgtgatcccagctacttgggacactgaggcaggaggatcgcttgaacccgggaggcggaggttgcagtgagccaagatggtgccactgcactttagcctggatgttgatgttgttccacttgtttatttttattttgttccctgtgcttttggtatcaaatcctaaaaaccattgccatgaccattgtcatgttactttccccatatgctttcttctagaacttttaaggttcatcattcccttttctgtttttagttgcaagcctactataaggaagggcttttctttcttccttatttatttattcatgtctatcagaatgggcaccttactactatttttgttgttattgcttgaattgacttgaatttggctagtggaaaccttttcagatcgggtactctgtccttttgatctctttccattttcaagcacttctttagacttaagatggtctaggctcatcttctcctttcccagccatttttcaaaggaacctgattccttttagtgaagagcagtattttgaaaccaagatctgggcactgggtctacttgtttgtactggtacagtgttctttgaattgctaattagctgatcaattactgctctatttgagttccctctttctaaaacctcacatatgtgtacagacggtccctgacttatgatggttcgacttatgatttttgattttatgatggtttgagagcaatacatccattctgtttttcacttttcattcaacactttattttaaaatagggattgtgagatgatattgcccacgtgtaggctaatgtaagtgttctgagcacgtttaaagtaggctaggctaagctgtggtgtttggtaggttagatatgttaaatgcattttcgactagtgatattttcaacttatgatgagtttattgggatgtatccccataaagtcgaggagcattatacatatctctgtataacagagtgagttccttatacctttcatccactttcccctgaagttaacattttacctaaccatgatacatttatcaaaactaaaacattaacatcaatacattgctattaactaaactagagtttaattggattttgccagttttccaatgaatatcctttttctgttccttgatccaattcatggtcacacactgagtttggtcacttgtcactgtagtcttctccaatctgcgacagcttcttaggctttccttgtttttcatgtactcttgacgatttttaagagtactggtcagatatcttgtaggatatcccacaacttgtgtttaatcttatgttttctcatgattagacttgagtaatggatttttgggaagaataccacagaggtatattgttaagtgttctcatcacttggaggtaaatgttatcaacatggcctggtgatgttaaacttgtcagtttgtttagttagtatctgccagatttttctcactgcataattacaaatcctccttaacttatgatggggttacagcctgataagcccatcataaattgaaaatatcataagtcaaaaatgcatttaatgcatctaaactactaaacatcacagcttagcctagcctgccttgaacgtattcaggacacttacattagcctacagttgggcaaaatcatctcatgggaagcctgttttataatgtgttgcatatcttatgtaatgtgttgagtactgtactcagaatgaaaaacagaagggttgtattgcttttgcaccatcataaaatcaaaaaaaccataaggcaaaccatcatgaagttggggactgcctgtacttttttcctctttccctgttcaattccttggaagaaagtcatttagttcagaccatactcaagaaaagggaaataaagctccatctcttggagcttaattgaaactggaatgactagtttctatatacattatttagaatccttttgtaagaaagatttgttccttctctccatttatttattccattatttatattgatagagacgcatgtacatttattttatactttgggttataatctatttttcttgctcaaattgttacagctttggtcactgggaggttcttcagattggctcctgtgtcatttgacatgtccccaccctctcgtttctgagtacttctctactttggcattacaaaagatgttccaggctcctcttatatttttccctgccgcagccctagaatcatccatttttctatggtgccctggttccttttactttagatgggggtttagaaaccaatctgggtgttgggtgtgctcattgctactggaatcactgcttctaggccctctcagcagatagagctagaaaacatatggctgtatatgaatccatggattcatatatatctataattgttttctgtatctggccatctatatatatattaagctaaacatgaattcatactgatgtctcagactcgaatccattgccgcagggctcattcttgccttcctcttgcttatttgtgacttctttctctaacagggagaaaccccagtctcattatcaccaacctatctactcatttgttcaaccctggtataggtgtaaagtagtttcagaattactaacctatacccatgtgagaattgtatttgcacttcttgtttgaaggaaatacatacaacacaggtagcgtctctacacttcagtatacagagatctgaacagtgttctctctgagtgaatcatattgcaggacagaaattacttttaaaaattctgtaatgggtcaggcctataatcctagcactttgggaggctgaggtgggcagatcacctgaggtcaggagttcgagaccagcctggccaaaatggtaaaaccccatctctacaaaaaatacaaaaattagccaggcgtagtggtgtgtgcctgtaatcccagctactcaggaggctgaggcacgagaatcacttgaacctgggaggcagagcttgcagtgagctgagattgagccactgcactccagtctgggcgacagagcgagactctgtctcaaaaaaaaaaaaaaaaaaaaattccataatgatagcagagctggaatagaaatgggattgcacaggctgaatctgagttgttgcaacagtaaacgagcaagatttaaactggccttgtgtagcacttgctatttggctcctcatattttattagacgcttattcttttttgtttggtgtcattcctttgagaaatatttgagtgccttttctgttgcagacattgattagatgctgaggttgtaacaatgaagaagatagccatcgctgttgcctcatggaactgaagttttactagatgtaaaatttgagttaacatgaggccgtgcccctatgtgccctattgtttcttcacacagctcccttcatctccttggtccaatgaaaaggttttttcatacttgttcattcattcctgcattaattaaagtaggttgtactgtgccaggcactgggaatatttaagtagttgtgttcctgaattggaaatgaatccagcatggttggagtagaaggagctggggggcaatgtggagtgtgatggggagattggaaaagtaagctgagaccagatttttcagtttggagggagaggtgggccttgtaggccatattacagattgtagactttatttggagggacatggaagtcattgaggagtctgaagcaggggaatgacataaaaagatcctcattttaggccggatgtggtggctcacgcctgtaatcccagcactttgggaggttgaagtgggtggattgcttgaggccaagagtttgagactagcctgggcaacatggtgaaaccctgtctctatcaaaaatacaaaaattagctgggcatggtggctcacacctgtagtcccagctacttgggaggctgaggcatgagaatcgcttgaacccgggaggcagagattgcagtgagccgagattgtgccactgcattccagcctgggtgacagagtgagacttcgtgtcaaaaaaaaaacaaaaaacccctcattttgaaagggaaccctggcttgagggtgaagaatgggtgggcactaggctagagcagctgcagggtcagtgaggagctgccgcagtgctgcacgtgagaacccgtcatggtttggtcagggtgggcaggactgacagtgagcacagagcgaagtaaaaccagcaaaatttcatgattggatagtggaaggaatcatggtgtttgtagtcttcaaatgtgaacccagagtgcactggacaagtagtctaggctgctctgtaaccaaggcaagtgttttcattttaccctctcttcctgctcttggcctttggattttttgtaatttaaggtttatgaatgtaatcagttacttaacatggaaagatacttaataccagatgattttggagtcttgtgatcaataccttctctcaatcttgggtgtgtgtcagttggcaaggccataaaatttgttataaacattgcagaaggcttggttactgtgctgtgacgttgaatttgggtggagatagatcaatttcagttgattttctaggcttcagaaacacattaccctctactccacaaacacaaatcaaaacaaaacaatccctattccctgagcatttctcttgatctataacacagcctgggctgtcacagtactaagacaagcccatctgatttgtgagtcagttttatttcttggtcttctacataagctaaaaagtttcaacattttaatgcttttccttggattcctttgagtcattgaagtaattcctgtttcatttgtactaattattccacactagaaaattctgttgtaatcactttatgtattaatagaaatactgatttttattttcaaggaagtattgagtagggagggggaaatagggatttgctgttcaatgggtatagagtttcagtaatacaagacaaaaaacttcagagatcttctatacagcagtgggtatatagttaacaatactgcacatctaacagtttgttaagagggtagatctcatgtcatgtgtttttaaaaattgcttttaaaaaaagtatcgagtaaaaaagcagttttactcctcagtttctatttatatttaaaatttttatttaaaaagtgagttgagatttttaaacctcaggataagttttattttttaaaaaatttattttttattattttttgagatggagtctcactccatctcaagtcacccaggctggagtgcagtggtgtcttggctcactgcgacctctatctcccaggttcaagtgtttctgctgcttcagcctcctgagtagctgggattacaggtctgcaccaccacgcctggctaatttttgtatttttagtagagatggggtgtcaccatgttggccaggtttgtcttgaactcctaacctcaagtgaccacctgccttggcctctcaaagtgctgggattacaggtatgagccacagtgcccggcgggataagttttaaaataatattctctgctggctgggcatggtggctcatgcctgtaaacccagcactttgggaggctgaggcaggagcatcactcgaggccaagagtttgagaccagtctgggcaacataatgagaccccctctctacaaaaaataaaaaaaatttggctgagtgtggcatgttcctgtagctatcgggaggctgagatgggaggattgcttgagcccaggagtttgaggctgcagtgagctatgattgcaccactgcgctctagtctgggtgacagtgtgagaccctgtctcttaaaaaaaaaaaaaaaaaaggccaggcacagtggctcaggcctgtaaccccagcactttgggaggccgaggcgggtggatcacttgaggccaggaatttgagaccaggctggccaacatgatgaaaccccgtctctactaaaaatacaaaaataagctgggtgttgtggtgcacacctgtaatcccagctacttgggaggctgagggagagaattgcttgaacctgggaggcagaggctacagtgagccgagatcacaccactgcactccagcctgggtgacagagcaagactccatctcaaaaacaacaacaacaaaaaaaccaaatgttcttgccaattcttccatttaatatttaattttgaattatattgtatctttctaaggattgtttcttatataagcaaagatttttcagtgctaaacatttacgactgctattcagaaatggttatttacaagtctttttgttttaagaaaatggctgttcaaaaaattaaaatagtatataaaccaaacaaaatatttttgctttggatgtctgttttgcagcttcttccctacactataagttcttactgactgctttatcacttaataaattggtttggctactttaacagaggcaaatagtatcaggcaaaaaattattttttatttttattttttgagacagtctcactccatcacccaggctgcagtgcagtggcctgatcttggctcactgcaacctccacctcccaggttcaagcgattctcatgcctcagcctcctgagtagctggaattataggcatgcaccaccacactcagctaatttttgtatttttagtagagacagggttttgccatgttgaccaggctagtcttgaactcctgacctcaagtgatccatctgctttggcctcccaaagtgctgggataacaggcatgagccaccatgcccagccctattttttattttttagagatgggtctcgctttttagagatgggtcttgttgcccaggccagagtgcagtggtgcgatcatagcttactgcagccttgaattcctgggctcaagcaattctcctgcctcagcctcccgagtagctgggactacaggcctgtgccaccaggcctggcttgtacattagtatttgatatggctaccctaagggcaatcctatagtgaagtcaacattagataatgatgctcatctgatggattagattttcagagttggctgtttccaggtgcctataggagtagaaaagggtgacaaacctcctaactagatgtcctaccaaatatagttcactccacatctgagatgagactgcatgactgctggttttctttgccttttcccccccagggtatcatcagaaccaaaaataaagttttaaaggtgggtcaggtgtgtgttggctcatgcctgtaatcctagcactttgggaggctgaggcaggtggatcatctgagctcaggagttcaagaccagcctggctaataacatggttaagccccatctctactaaaatacaaaaagttagctgggcatggtggtgggcacctgtaatcccagctactcaggaggctgaggcatgaaaatcgcttgaaccccagaggcgggggttgcagtgagccgagatcatgccactgcacactagcctgaacaacagagcaaggctctgtctccaaacaaacaaaaatggtgccagagtcttttccagggctgaggggagatacaatgaagtgtgttattttttctgataagagtgctaccatctttcattcttgtgtgccatttctagttggggtgaatttgttttcggagttcctttcccagctgtttgcctgaaaaaccatgaaatgtgttccacatgaactatgaaatgattagatgctaatgtggcaaagaaagtgtgaattctcttgtagaaacagggacatttggttcggtacagtaagttgttaatgcgtgactctgtgctttcaaattctgtggttcaaaagtacttttcactcctactgtgtatttaccttgagaaggtgaatcccctaacaatttggtcaatgtatcagtattctcaacccgtctatcaatttttttttctttctccctcttttttctttttttgggcaaaataccttttttgctttttatccccttaaaataaccattgtccctcacatgtgcactcttccaaatttcagaaaagcaagaggaaagggcacgaatatacaaatattaagtattctctagcggaccagacgagtggagatcagagccctctcccgccttgtactccaacgccaccctgtgcagagtaagtagtgctgaaggaaattctttttacctggtcatggtggtttaaaaaggtttaaaaaacaaaaacaaaaacaaaacacaagtttgtagcacatgcctttcactggtgcacgttcctgttgccctactgttagtgtatctgtgactggtgatatctattgattgtgttaatgctatctcaaccacgttttaattttcctaagctggccaggcacggtggctaacgcctgtaatcccagtgctttgggaggccgaggttcatggattactttgaagtcaggagttcgagaccagcctggccaacatggtgaaaccctgtctctactaaaaatacaaaaattagccgggcatggtggcgcatgcctgtaatcccagctactcaggaggctgaggcaggagaatcgcttgaacccaggaaacggatgttgcagtgagccgagatcatgccactgcactccagcctgggcgatagagtgagcctctgtctaaaaataaaataaaataaaataaattcctaaactgaaggctgactgctatgctagctaggattatatgggattttaagtatatcaagtggtggttctccaagaagaatctaatttttcttttgatgggctggggattgtaacaaaggaaggtcatatgtcttaatgatgtgttaaggctctttgcaaaatcaaagtaaataaattgaccactaatgtgtcagcccagccatgttctgctcatttgccaccagtcaacagaaatctactttgggtgtttaaaccaggagtcagcaaactacagctcacaaggccagatgtgggccatggcctgttactgtatggcctgttaatggttttaaagggttgtaaaacaaaagaacacaaaacaaagacccaataacaaaacaaagcccgaagaataatatgcgacagagaccatgtatggcatatagagcctaaaatactgactctcaagcccttcccagaaatccttcccgactccttgttgaaaacacggtaggaaagcatttgtcaaattgaggatatgaatagcaattgtaagttattatttttctatatattcgaaagtcacttgctagtataacatttaccttttatttttccctaagaatcttctctctgtttgctttcgacatggatttttaaacccctgcagattttaatattctatataaatgttttaggtggcatatatgaggtttgtattaacatttgctttctatttaacattgaaatgaaattatacagcagaggtattttctcgtccaagttgccacttctttctatcttttttcttttctttcccagtggactgcctgggaaaattgatattttaaattgctctctgcaataatttgcaatggaactggaatgccagggttctgagtccttgccagacagctcgtccctcctgttggcatgactgagtcagctgtcatgattccctcagtaccagtggcatgcctgtgacagacagcctgtctgcctttcattcccgtcgtctcccttgtagggttcagatccaggatacactggtcctggagcccctctcagcctggcacccacagctgctgggttccttactctcctggactgctctgatgtcatctccctgctcagcagaaagaagtctgggatcttgatgctttggccctctgtcctaggccctaaaccacccattgcccttcacataacctgagctggggctaaatagatctctcatcactgcctgcctgctcctgtattttcccttcttggagcttttgcctgttcagatccctctactggaaattaataggatttcattctatgtgtgcatttccaacctttcttcacagtgcgatccaaatgcctcatcctacaggcctccttaaaacaacctgctttctgccagaccccagggagcaccaggacttgaggcttttattgcacttctgttgtttttttgagatggagtctcgctctgtcgcccaggctggagtgcagtggcacgatctctgctcactgcaacctccatctcccgagttcaagagattcttctgcctcagcctctcaagcagctgggactacaggcatgtgccatgacacccggataatttttgtatttttagtagagacggggttcaccatattggccaggctggtctcaaactcctgacctcgtgatccacccacctgggcctcccaaagttctgggattacaggcgtgagccaccatgcccagcgttatttcacttctgcctctgtaattatattgctgtatggctatctcttctctccctgggaatgtcaggtcctaggcacaggaactgtgtctgtaccatatctggtgcccaaagaatgtagtatgtgttttatagatatcatgtaagcttaaacagcgtggtctacatttttgtaaatgtctttctttttcttttctctccagaatgagagaagacagtgctagagtctatgaaaacgtgggcctgatgcaacagcagaaaagtttcagatgagaaaacctgccaaaacttcagcacagaaataggtatttaaatgcaagtgctctattggttaattgtttatataattggcagtatttttaagcaggcaagcaatttgggaatgttttagcaaagtgtaccataattgagttttacaaaccaggctcctttttcctctccctgtacttctttttccaagatggttttagtttagagttcattaaacattaaaatcaaacacagaattaattctgcatgaggcaaggctagcacttattccagagaaatggctgatactggtggtagagtgcaggtatcactgttcctgcaatttttattagagttggttagcccaggctgtgctgggggatgatctgtagggatctgggaagcatcgggactcagcactgggtggttgggagtcaggaagcctgagttctcatttcagtcagtctctgaccaactgtgtggcatggggtgctagaccacttggctgccgactgggtcaccgacatcccttccagctctgctgctggaaattcatctctcccatatgttgcctccccatcaattacgttttttaagtgtgacccaagtatatgatgtatgttttcatgataaattagaaacttatctgggcatggtggctcatacctgtaatcccagcactttgggaggctgaggtgggcggatcacctgaggtcaggagttcgagaccagcctgaccaactaaaatagtagagaccaacccgtctctactaaaaatagaaaattagctgagcatggtggtgcatgcctataatcccagctactcaggaggctgaggcaggagaggcagcggttgcagtgtgccaagatcgcgccattgcactccacctgggccacaagagtgaaactccatctcaaaaaaaaaaaaaaaaaaaaaaaaactcagtgtcagtatttcatgtcgaaattccacttcaatgggtagtgtagttaaaagctctaagtctaccttaaaatcacctaatgctttgttaagcttttagatatatgttccttaaaaactcttaacttatttcttccccagatgtggactttcaccctctccctaaaaagatcaagaacagacgcaagaaagtttatgtgaagacagaatttggatttggaaggcttgcaatgtggttgactaccttttgataagcaaaatttgaaaccatttaaagaccactgtattttaactcaacaatacctgcttcccaattactcatttcctcagataagaagaaatcatctctacaatgtagacaacattatattttatagaatttgtttgaaattgaggaagcagttaaattgtgcgctgtattttgcagattatggggattcaaattctagtaataggcttttttatttttatttttatacccttaaccagtttaattttttttttcctcattgttggggatgatgagaagaaatgatttgggaaaattaagtaacaacgacctagaaaagtgagaacaatctcatttaccatcatgtatccagtagtggataattcattttgatggcttctatttttggccaaatgagaattaagccagtgcctgagactgtcagaagttgacctttgcactggcattaaagagtcatagaaaaagaatcatggatatttatgaattaaggtaagaggtgtggcttttttttttttcttttttccagccgttgaccaattatagttcggctgttgactgagaagtttgtggtgggaaaacgtttgccatattttctttgcatttgaataattgtcttgtacttagaaaaaaggcgtctatgaatgaccagtgtttttggtcgccaaatgttgctgacaaacttatcccaaaactttagtggcttaaaaaaacctgcccccaactgttagtcaatctgagctgggctcagctgggctgttcttctgccagcctgcaggtggccactcatgtggtcagcaggtcggcggagagactgggatggctgggcttctctctctgcctgcagtcctgagtctctccttcttcgtgtagtctctttcagtggcctggctggcagggtagctagacctctcacatgcagctcagagctcccaagagctcaaaagcagaaatggccaggccttctgaaaacttaagtccagaattgtcacagtgtcccttctacttccctctattgatgatgatgatgatgatgatgatgatgatgatgatgatgatgatggttttttctaatcagaagaaagctggggtatgccctctacttactaaacaagtcacaagcccagctcagattcaagaaaagggtgtgaagtagaggtgcagttaagtggggggccactagtctaacagacggtcacaaccagtgccatggaaaaccaaggatattagcaaaagcagaagttgctagtgaccttgggaagccgaagctgcttacagtagctgggacaagctgaaagtcagactaagaaataaagagagggccttcaagaagcttcctgaatgatttctgctagccctgagcctatttttggaaccagcacttggggaaactgatcttgtgaggatggatgtgtttagggacacagggcttttgagagcagcaccaccccactggggcatccccagacttgggaaacgtgactctttcttaatgccactgggttttagtcaggccacagtgagaaggaacagccctaacaggcctccagccaggttgaatgagctcatttttgttgtagccaaccagtaagatttgctaatgttctacattaagtgccttctccaaagacatccctctttgcctcatatgttgaatcatccagtgcggatatttcaatgaaaatatcattggttgacttttgtgatggtaataatgctatggcatctttgccatgaagttgtggcctccttggattcttctgactttggcttctgaaaggaaggcctagatccagccctggtggtagttcctttctgaggtctctcagtcccttgagactttggggtagtttggctgccattctcactgacaaaatgtatatcagcccccacctccaccccccaatattccttgaactttgaattgcttcagaacacaggtgtggcctgaaggtattcccttattagggaagtgtcactgctgtcttctagtcaaacttgtaaagaaaaagattccagttcagtatttgcagcaagaagcttgaatgctgttctttttatcgcattgttacatcgactcattctccattttgctttggttttgtcttgacttgacttgactttgggggtaaagtctttcaccagcacacaagagtttgattgtacaaatatatcttctgcattaacatctctgcctgttgcttaagatcagttgcttttatactcagaatggaaatacctgatcttggctagttttgttataagatattgatttcatttagatttccctccacgaggtcagcaaactatcatgttcttatgtaaacttaggccaaggccagagttatcatagtccctaggttgctacggcttatcatgtgcttggtaaaaggtgatcgcaggttctcagacgagtttactttacatgagatggaatcaggcagagaggctgggatgatggagaaagctcgaggtgaagttttaaaaaaaaagttgtggaaaggaaagttccaaagaggtggtttctgaggaagtcagagcgcccagggccagagcagtcagtaatgggtgaatgaggttgtttggaaagtcggtgtgacagacacatggatgccatctacttctaggttgctggtgggtattaaatatgcacaatattccatagctcactgaggattttaaaattataagcataggattttatattttggggtgaaagaattatctggcacattaggtattggagtttaaaaaaaaagccaaatttcacagtcttaataactttttttaaaaaaaactaaaaggcgcttcatgtccagtgtgtggcccttctgaaacttatggtcatctctcccactgaaaccaaggtcttttcaaatgtggctaaatggggatgaggagacacgggtaggactttcttggtgtgtgtgcattctttaaagagccaagttgcttcggggaaacagccaggaaaatggtcaagattatttttagaggttattttattggggattttaagaactaataacatcttgagttatttttaattcagggggatgtggaaaggtttgcaattgtcaagtgttttgttgtagcttagtatccataagggaaacttagactatagacataactacaaagccagtgcagcttttgttttctgtatgttgttgggggatcaactttcacacatagcaagcacatggcctccctgatgtcaggatgcctttgttaggatctgtatttgcccttaattttgttgaaatcttttttccttcttcctcttgaaaagttccaaaatatagtttattgtatctttcatcactaaaaatttgttcctttttcactatgggcagttcacacaaggcaaaaactattgaacagttggttttagtgtgttgtataactttgctgtatatcaaactaattttgacaagttttcatcctaagcctcaaatcatgtaattaataatttgcctgtttatttatgacctaattgtgattcttttattaataaaagctaatgggaaaaggatccctgattaagctgatgactagacctacaattaattttcctgcagtatatgaagtattgtaccagagtattaaaagatatgtaatattttattgataaatctatcctttaaaaggaatacgttttaggatgtcatcattttgatgtgaatcatgtaaatgttgataatatgctgtttattatacatttagtgtttcaagagattcacttaattgcctttttgcccacgtatattatgtagtctatttgcaactgttcttaaaaaaatgacattaaaagaatagtttatgtagagaaacattagtggatgttaattgtctccccacctatatttatgggtgttagcgcaactgctttgctagttgcaaagctgtattatcagagtaaaagtgtatttgtaaactgtatgggaactaaaaattaggaataaaaccattttcttatatg

SEQ ID NO: 37345 - DNA, 91181 bp, Homo sapiens; identical to SEQ ID NO: 37344
